US011098302B2

(12) United States Patent
Robinson et al.

(10) Patent No.: US 11,098,302 B2
(45) Date of Patent: Aug. 24, 2021

(54) IDENTIFICATION OF POLYNUCLEOTIDES ASSOCIATED WITH A SAMPLE

(75) Inventors: William H. Robinson, Palo Alto, CA (US); Yann Chong Tan, Palo Alto, CA (US); Jeremy Sokolove, Mountain View, CA (US)

(73) Assignees: The Board of Trustees of the Leland Stanford Junior University, Stanford, CA (US); The United States Government as Represented by the Department of Veterans Affair, Washington, DC (US)

( * ) Notice: Subject to any disclaimer, the term of this patent is extended or adjusted under 35 U.S.C. 154(b) by 0 days.

(21) Appl. No.: 13/261,763

(22) PCT Filed: Apr. 27, 2012

(86) PCT No.: PCT/US2012/000221
§ 371 (c)(1),
(2), (4) Date: May 19, 2014

(87) PCT Pub. No.: WO2012/148497
PCT Pub. Date: Nov. 1, 2012

(65) Prior Publication Data
US 2015/0133317 A1    May 14, 2015

Related U.S. Application Data

(60) Provisional application No. 61/517,976, filed on Apr. 28, 2011, provisional application No. 61/575,652, filed on Aug. 24, 2011, provisional application No. 61/599,870, filed on Feb. 16, 2012, provisional application No. 61/608,571, filed on Mar. 8, 2012.

(51) Int. Cl.
C12N 15/10    (2006.01)
C07K 16/00    (2006.01)
C07K 16/12    (2006.01)
G01N 33/68    (2006.01)

(52) U.S. Cl.
CPC .......... *C12N 15/1065* (2013.01); *C07K 16/00* (2013.01); *C07K 16/1242* (2013.01); *C07K 16/1271* (2013.01); *G01N 33/6854* (2013.01); *C07K 2317/21* (2013.01); *C07K 2317/76* (2013.01); *G01N 2458/10* (2013.01); *G01N 2500/00* (2013.01)

(58) Field of Classification Search
CPC .... C12N 15/1065; C12N 15/11; C07K 16/00; G01N 2458/10; C40B 40/08
See application file for complete search history.

(56) References Cited

U.S. PATENT DOCUMENTS

| 6,274,321 | B1  | 8/2001  | Blumberg |
|-----------|-----|---------|----------|
| 6,927,025 | B1* | 8/2005  | Carr ................... C12N 15/1037 |
|           |     |         | 435/6.14 |
| 8,835,358 | B2  | 9/2014  | Fodor et al. |
| 9,290,808 | B2  | 3/2016  | Fodor et al. |
| 9,290,809 | B2  | 3/2016  | Fodor et al. |
| 9,315,857 | B2  | 4/2016  | Fu et al. |
| 9,708,659 | B2  | 7/2017  | Fodor et al. |
| 9,816,137 | B2  | 11/2017 | Fodor et al. |
| 9,845,502 | B2  | 12/2017 | Fodor et al. |
| 2004/0161741 | A1* | 8/2004  | Rabani ................. C12Q 1/6825 |
|           |     |         | 435/6.14 |
| 2007/0141048 | A1* | 6/2007  | Oleksiewicz .......... C07K 16/00 |
|           |     |         | 424/133.1 |
| 2008/0152657 | A1* | 6/2008  | Horowitz ................ C40B 40/08 |
|           |     |         | 424/159.1 |
| 2008/0227660 | A1* | 9/2008  | Kastrup ............... C07K 16/005 |
|           |     |         | 506/17 |
| 2009/0054254 | A1* | 2/2009  | Throsby ............... C07K 16/005 |
|           |     |         | 506/9 |
| 2009/0233806 | A1* | 9/2009  | Carr ................... G01N 33/6845 |
|           |     |         | 506/9 |
| 2010/0024075 | A1  | 1/2010  | Aroian et al. |
| 2010/0034807 | A1  | 2/2010  | Moyle et al. |
| 2010/0069614 | A1  | 3/2010  | Houtzager et al. |
| 2010/0099103 | A1* | 4/2010  | Hsieh ..................... C07K 16/00 |
|           |     |         | 435/6.14 |

FOREIGN PATENT DOCUMENTS

| CN | 101845500 A | 9/2010 |
| JP | 2006271390 A | 10/2006 |
| JP | 2008-295415 A | 12/2008 |
| JP | 2009-520468 A | 5/2009 |
| WO | WO2005042759 A2 | 5/2005 |
| WO | WO2007032255 A1 | 3/2007 |
| WO | WO 2007/071061 A1 | 6/2007 |

(Continued)

OTHER PUBLICATIONS

Garman et al. (Proceedings of the National Academy of Sciences 83.11 (1986): 3987-3991).*
Ozawa et al. (BioTechniques 40.4 (2006): p. 469-478). (Year: 2006).*
Hueber et al. "Autoantibody Profiling for the Study and Treatment of Autoimmune Disease," Arthritis Research, vol. 4, No. 5, Jan. 2002, pp. 290-295.
Meyer et al. "Targeted high-throughput sequencing of tagged nucleic acid samples," Nucleic Acid Research, vol. 35, No. 15, Jan. 2007, pp. e97.1-e97.6.
Snir et al. "Antibodies to Several Citrullinated Antigens Are Enriched in the Joints of Rheumatoid Arthritis Patients," Arthritis & Rheumatism, vol. 62, No. 1, Jan. 2010, pp. 44-52.
Tan et al. "Barcode-Enabled Sequencing of Plasmablast Antibody Repertoires in Rheumatoid Arthritis," Arthritis & Rheumatology, vol. 66, No. 10, Oct. 2014, pp. 2706-2715.

(Continued)

*Primary Examiner* — Sahana S Kaup
(74) *Attorney, Agent, or Firm* — Bret E. Field; Bozicevic, Field & Francis LLP

(57) ABSTRACT

Disclosed herein are compositions and methods for sequencing, analyzing, and utilizing samples such as single samples. Also disclosed herein are compositions and methods for matching together two or more sequences from a sample. Also disclosed herein are compositions and methods for expressing and screening molecules of interest.

26 Claims, 48 Drawing Sheets

Specification includes a Sequence Listing.

(56) References Cited

FOREIGN PATENT DOCUMENTS

| WO | 2009/036157 A1 | 3/2009 | | |
|----|----|----|----|----|
| WO | WO-2009123748 A1 | * | 10/2009 | ......... C07K 16/2896 |
| WO | WO 2010/039852 A2 | | 4/2010 | |
| WO | WO2010054007 | * | 5/2010 | |
| WO | WO-2010054007 A1 | * | 5/2010 | ............. A61P 43/00 |
| WO | 2010115154 A1 | | 10/2010 | |
| WO | WO2010117620 | * | 10/2010 | |
| WO | WO2011025826 A1 | | 3/2011 | |

OTHER PUBLICATIONS

Geha; et al., "Hyper immunoglobulin M immunodeficiency. (Dysgammaglobulinemia). Presence of immunoglobulin M-secreting plasmacytoid cells in peripheral blood and failure of immunoglobulin M-immunoglobulin G switch in B-cell differentiation.", J. Clin. Invest. (Aug. 1979), 64(2):385-91.

Boyd et al. "Measurement and Clinical Monitoring of Human Lymphocyte Clonality by Massively Parallel V-D-J Pyrosequencing", Science Translational Medicine, vol. 1, No. 12, Dec. 23, 2009, 12ra23, 10 pages.

Boyd et al. "Supplementary Materials for 'Measurement and Clinical Monitoring of Human Lymphocyte Clonality by Massively Parallel V-D-J Pyrosequencing'", Science Translational Medicine, vol. 1, No. 12, Dec. 23, 2009, 12ra23, 30 pages.

Boyd et al. "Individual Variation in the Germline Ig Gene Repertoire Inferred from Variable Region Gene Rearrangements", The Journal of Immunology, vol. 184, No. 12, Jun. 15, 2010, pp. 6986-6992.

Binladen, "The Use of Coded PCR Primers Enables High-Throughput Sequencing of Multiple Homolog Amplification Products by 454 Parallel Sequencing", PLoS One., pp. 1-9, 2007.

* cited by examiner

FIGURE 27

| Antibody | Bound H3 Perth? | Bound H1 California? | Ka | Kd | $K_D$ |
|---|---|---|---|---|---|
| FLU 14 | Y | N | 7.12E+05 | 1.13E-02 | 3.04E-08 |
| FLU 16 | Y | N | 5.35E+05 | 5.86E-03 | 1.36E-08 |
| FLU 18 | Y | N | 2.89E+05 | 1.60E-03 | 6.00E-09 |
| FLU 19 | Y | N | 1.96E+05 | 5.08E-02 | 2.59E-07 |
| FLU 20 | Y | N | 3.77E+05 | 6.28E-02 | 4.62E-07 |
| FLU 22 | Y | N | 1.39E+05 | 6.75E-03 | 5.38E-08 |
| FLU 26 | Y | N | 5.24E+05 | 1.52E-04 | 3.13E-10 |
| FLU 34 | Y | N | 1.40E+05 | 1.26E-02 | 9.25E-08 |
| FLU 35 | Y | N | 1.96E+04 | 2.35E-02 | 1.20E-06 |
| FLU 46 | Y | N | 3.39E+04 | 4.13E-02 | 1.24E-06 |
| FLU 21 | N | Y | 2.23E+05 | 5.29E-02 | 2.38E-07 |
| FLU 15 | N | N | -- | -- | -- |
| FLU 17 | N | N | -- | -- | -- |
| FLU 29 | N | N | -- | -- | -- |

FIGURE 28

| Antibody tested | Neutralization of Infectivity ||
|---|---|---|
| | H1N1- A/California/07/2009 | H3N2 A/Perth/16/2009 |
| mAb F15 | No | No |
| mAb F16 | No | Yes, Neutralizes at ≤1.5 µg/ml |
| mAb F18 | No | Yes, Neutralizes at ≤1.5 µg/ml |
| mAb F19 | No | Yes, Neutralizes at 3.1 µg/ml |
| mAb F20 | No | Yes, Neutralizes at 12.5 µg/ml |
| mAb F21 | Yes, Neutralizes at ≥ 1.5 µg/ml | Yes, Neutralizes at 100 µg/ml |
| | | |
| Polyclonal Control | Yes, Neutralizes at ≥1/128 diln | Yes, Neutralizes at ≥1/128 diln |

FIGURE 31

| Antibody | Target Accession # | Protein Name |
|----------|-------------------|--------------|
| S04 | Q6G7S2 | Phenol-soluble modulin alpha 1 peptide |
| S04 | P0C7Y8 | Delta-hemolysin |

IDENTIFICATION OF POLYNUCLEOTIDES ASSOCIATED WITH A SAMPLE

STATEMENT REGARDING FEDERALLY SPONSORED RESEARCH OR DEVELOPMENT

This invention was made with government support under N01-HV-28183 NHLBI Proteomics Center and N01-HV-00242 NHLBI Proteomics Center awarded by the National Heart Lung and Blood Institute of the U.S. National Institutes of Health. The government has certain rights in the invention.

CROSS REFERENCE TO RELATED APPLICATIONS

This application is related to U.S. provisional patent application No. 61/517,976, filed Apr. 28, 2011, U.S. provisional patent application No. 61/575,652, filed Aug. 24, 2011, U.S. provisional patent application No. 61/599,870, filed Feb. 16, 2012, and U.S. provisional patent application No. 61/608,571, filed Mar. 8, 2012; the disclosure of which is hereby incorporated by reference in its entirety for all purposes.

SEQUENCE LISTING

This instant application contains a "lengthy" Sequence Listing which has been submitted via CD-R, in lieu of a printed paper copy, and is hereby incorporated by reference in its entirety. Said CD-R, recorded on Dec. 30, 2014, are labeled "STAN-815_SeqList Copy 1", "STAN-815_SeqList Copy 2", and "STAN-815_SeqList Copy 3" respectively, and each contains only one single self-extracting file named STAN-815_SeqList.exe (81,292 kilobytes), which subsequently contains one uncompressed ASCII text file named STAN-815_SeqList.txt (850,897 kilobytes).

BACKGROUND

Producing therapeutic monoclonal antibodies from human sources is biologically and technically challenging. To date, several approaches have been described, including generating human hybridomas, using transgenic mice expressing human immunoglobulins, and using human immunoglobulin phage display libraries.

Human hybridomas can be difficult to generate because human myeloma fusion partners, unlike their mouse counterparts, are inefficient at generating hybridomas. Human hybridomas also have a tendency to spontaneously lose the expressed antibody genes after prolonged culture. Epstein-Barr virus (EBV) transformation immortalizes B cells, but only extremely small fractions of all of the EBV-transformed B cells are affinity matured or recognize the target antigen. The generation of hybridomas typically includes large screens to obtain therapeutic monoclonal antibodies. None of the therapeutic monoclonal antibodies currently approved by the U.S. F.D.A. were created through the generation of human hybridomas or EBV transformation of B cells, attesting to the technical difficulties and challenges posed by these methods.

Phage display libraries of human antibody sequences represent another method for producing therapeutic human monoclonal antibodies. This method utilizes recombinant DNA technology to randomly express human antibody heavy- and light-chain sequences together to enable screening for combinations that bind to the target antigen. However, this strategy does not produce affinity-matured antibodies, and antibodies produced in this way usually bind to antigen with low affinity and avidity. Successive mutation and selection/screening steps are then needed to generate high-affinity antibodies.

Another way to produce therapeutic human monoclonal antibodies is by creating or using transgenic mice that possess a human antibody repertoire. When immunized, such mice produce antibodies that target the immunizing antigen, and hybridomas can then be generated for the production of therapeutic human monoclonal antibodies. Such transgenic mice are proprietary and not commonly available for use in generating human antibodies.

Thus the inventors have identified a need for compositions, kits, and methods that can, e.g., produce large numbers of affinity-matured human antibodies, avoiding the need for laborious and time-consuming humanization of an antibody, or the need to conduct extensive screens. The compositions, kits, and methods described herein address this need. In addition, the compositions, kits, and methods described herein are broadly applicable outside the human antibody space and can be used in a number of different applications including, e.g., matching together two or more polynucleotides of interest that are derived from a single sample and present in a library of polynucleotides.

SUMMARY

Disclosed herein is a composition comprising a polynucleotide, wherein the polynucleotide comprises a first region and a second region, wherein the first region comprises an expressed B cell variable immunoglobulin region and the second region comprises at least one identification region, and wherein the first region is coupled to the second region.

In some aspects, the variable immunoglobulin region comprises a VDJ region of an IgG immunoglobulin nucleotide sequence isolated from an activated human B cell greater than or equal to 8 μm in diameter, and wherein the 5' end of the immunoglobulin region is coupled to the 3' end of the identification region. In some aspects, the composition is comprised in a clonal family.

In some aspects, the immunoglobulin region is isolated from a B cell, and wherein the B cell is an activated B cell. In some aspects, the immunoglobulin region is isolated from a B cell, and wherein the B cell is a plasmablast. In some aspects, the immunoglobulin region is isolated from a B cell, and wherein the B cell is a single B cell. In some aspects, the immunoglobulin region is isolated from a B cell, and wherein the B cell is a single activated B cell. In some aspects, the immunoglobulin region is isolated from a B cell, and wherein the B cell is a single activated B cell located in the blood of a subject. In some aspects, the immunoglobulin region is isolated from a B cell, and wherein the B cell is a human activated B cell. In some aspects, the immunoglobulin region is isolated from a B cell, and wherein the B cell is a memory B cell. In some aspects, the immunoglobulin region is isolated from a B cell, and wherein the B cell is a plasma cell. In some aspects, the immunoglobulin region is isolated from a B cell, and wherein the B cell is an antigen-specific B cell. In some aspects, the immunoglobulin region is isolated from a mammalian B cell. In some aspects, the immunoglobulin region is isolated from a human B cell. In some aspects, the immunoglobulin region is isolated from a mouse B cell. In some aspects, the immunoglobulin region is isolated from a B cell from a subject with a disease or condition of interest. In some aspects, the immunoglobulin region is isolated from a B cell from a subject recovering from or recovered from a disease or condition of interest. In some aspects, the immunoglobulin region is isolated from a B cell from a subject administered with at least one antigen of interest. In some aspects, the immunoglobulin region is isolated from a B cell from a subject administered with at least one antigen of interest and an adjuvant. In some aspects, the immunoglobulin region is isolated from a B cell located in the blood of a subject. In some aspects, the immunoglobulin region is isolated from a B cell located in the bone marrow of a subject. In some aspects, the immunoglobulin region is isolated from a B cell located in the spleen of a subject. In some aspects, the immunoglobulin region is isolated from a B cell located in at least one lymph node of a subject. In some aspects, the immunoglobulin region is isolated from a B cell located in lymphoid tissue of a subject. In some aspects, the immunoglobulin region is isolated from a B cell located in the gut of a subject. In some aspects, the immunoglobulin region is isolated from an activated B cell that is about 8-20 μm in diameter. In some aspects, the immunoglobulin region is isolated from an activated B cell that is 8, 9, 10, 11, 12, 13, 14, 15, 16, 17, 18, 19, 20, or greater than 20 μm in diameter. In some aspects, the immunoglobulin region is isolated from an activated B cell that is about 60, 70, 80, 90, 100, 120, 130, 140, 150, 200, 250, 300, 350, or greater than 350 μm$^2$ in area. In some aspects, the immunoglobulin region is isolated from an activated B cell that is about 250, 268, 300, 400, 500, 600, 700, 800, 900, 1000, 2000, 3000, 4000, or greater than 4000 μm$^3$ in volume. In some aspects, the immunoglobulin region is isolated from an activated B cell that has a diameter of 10% or greater in size than the median diameter of a control resting B cell. In some aspects, the immunoglobulin region is isolated from an activated B cell that has a diameter of 15% or greater in size than the median diameter of a control resting B cell. In some aspects, the immunoglobulin region is isolated from an activated B cell that has a diameter of 20% or greater in size than the median diameter of a control resting B cell. In some aspects, the immunoglobulin region is isolated from an activated B cell capable of secreting immunoglobulin. In some aspects, the immunoglobulin region is isolated from a B cell in the gap 1 (G1), synthesis (S), gap 2 (G2), or mitosis (M) phase of the cell cycle. In some aspects, the immunoglobulin region is isolated from a B cell is not in the gap 0 (G0) phase of the cell cycle. In some aspects, the immunoglobulin region is isolated from a B cell characterized as having an FSC greater than 1.2× of the FSC mean of resting B lymphocytes by flow cytometry. In some aspects, the immunoglobulin region is isolated from a B cell characterized as having an FSC mean between 0.7-1.15× of the FSC mean of human monocytes by flow cytometry. In some aspects, the immunoglobulin region is isolated from a single CD19 positive B cell. In some aspects, the immunoglobulin region is isolated from a single CD38 positive B cell. In some aspects, the immunoglobulin region is isolated from a single CD27 positive B cell. In some aspects, the immunoglobulin region is isolated from a single CD20 negative B cell. In some aspects, the immunoglobulin region is isolated from a single CD19$^+$CD20$^-$CD27$^+$CD38$^{hi}$ B cell.

In some aspects, the 5' end of the immunoglobulin region is coupled to the 3' end of the identification region.

In some aspects, the variable immunoglobulin region comprises a VDJ region of an immunoglobulin nucleotide sequence. In some aspects, the variable immunoglobulin region comprises a VJ region of an immunoglobulin nucleotide sequence. In some aspects, the variable immunoglobulin region comprises a V, D, and/or J region of an immunoglobulin nucleotide sequence. In some aspects, the variable immunoglobulin region comprises a heavy and/or light chain of an immunoglobulin nucleotide sequence. In some aspects, the variable immunoglobulin region comprises an IgG, IgM, IgD, IgE, or IgA immunoglobulin sequence. In some aspects, the variable immunoglobulin region comprises a human IgG1, IgG2, IgG3, or IgG4 immunoglobulin sequence. In some aspects, the variable immunoglobulin region comprises a mouse IgG1, IgG2a, IgG2b, or IgG3 immunoglobulin sequence. In some aspects, the immunoglobulin region is about 200-2000 nucleotides in length. In some aspects, the immunoglobulin region is less than 200, 200, 300, 400, 500, 600, 700, 800, 900, 1000, 1100, 1200, 1300, 1400, 1500, 1600, 1700, 1800, 1900, 2000, or greater than 2000 nucleotides in length.

In some aspects, the identification region comprises a plurality of identification regions. In some aspects, the identification region comprises a plurality of identification regions, and wherein each identification region in the plurality has a distinct sequence. In some aspects, the identification region comprises at least one sample identification region and at least one plate identification region. In some aspects, the identification region comprises a sequence distinct from the sequence of the immunoglobulin region. In some aspects, the identification region is about 2-100 nucleotides in length. In some aspects, the identification region is 2, 3, 4, 5, 6, 7, 8, 9, 10, 11, 12, 13, 14, 15, 16, 17, 18, 19, 20, 30, 40, 50, 60, 70, 80, 90, 100, or greater than 100 nucleotides in length. In some aspects, the identification region is 2-1,000 nucleotides in length. In some aspects, the identification region is equal to or greater than 100 nucleotides in length. In some aspects, the identification region comprises a contiguous non-coding nucleotide sequence. In some aspects, the identification region comprises a non-coding nucleotide sequence. In some aspects, the identification region comprises a non-contiguous, non-coding nucleotide sequence. In some aspects, the length of the sequence of the identification region is less than the length of the sequence of the immunoglobulin region.

In some aspects, a composition described herein can include a third region, wherein the third region comprises an adapter region. In some aspects, the third region comprises an adapter region, and wherein the third region is located between the first region and the second region. In some aspects, the third region comprises an adapter region, and wherein the adapter region comprises at least one G nucleotide located at its 3' end.

In some aspects, the identification region is 2-100 nucleotides long and has a sequence distinct from the immunoglobulin region sequence, and wherein the adaptor region comprises at least one G nucleotide at its 3' end and is located 3' of the sample identification region and 5' of the immunoglobulin region, and wherein the immunoglobulin variable region has undergone hypermutation and differs from the germline sequence of a nave B cell.

In some aspects, the composition is present in a container. In some aspects, a plurality of the compositions are present in a container. In some aspects, a plurality of the compositions are present in a single well of a single plate comprising a plurality of wells.

In some aspects, the composition is in a library of compositions, wherein each composition is present in a separate container, wherein each composition comprises a polynucleotide comprising a first region and a second region, wherein the first region comprises an expressed B cell variable immunoglobulin region and the second region comprises an identification region, wherein the first region is coupled to the second region, wherein the nucleotide sequence of each identification region o is distinct from the nucleotide sequence of the other identification regions present in the library, and wherein the last nucleotide sequences of a plurality of variable immunoglobulin regions in the library share at least 80-99% sequence identity.

In some aspects, the composition is comprised in a library comprising a plurality of polynucleotide compositions, wherein each composition is present in a separate container, wherein each composition comprises a polynucleotide, wherein the polynucleotide comprises a first region and a second region, wherein the first region comprises an expressed B cell variable immunoglobulin region and the second region comprises an identification region, wherein the first region is coupled to the second region, and wherein the nucleotide sequence of each identification region is distinct from the nucleotide sequence of the other identification regions present in each separate container in the library.

Also described herein is a polynucleotide composition library comprising a plurality of polynucleotide compositions, wherein each composition is present in a separate container, wherein each composition comprises a polynucleotide, wherein the polynucleotide comprises a first region and a second region, wherein the first region comprises an expressed B cell variable immunoglobulin region and the second region comprises an identification region, wherein the first region is coupled to the second region, and wherein the nucleotide sequence of each identification region is distinct from the nucleotide sequence of the other identification regions present in each separate container in the library.

Also described herein is a polynucleotide library comprising a plurality of polynucleotides, wherein each polynucleotide of the plurality is present in a separate container, wherein each polynucleotide of the plurality comprises a first region and a second region, wherein the first region comprises an expressed B cell variable immunoglobulin region and the second region comprises an identification region, wherein the first region is coupled to the second region, wherein the nucleotide sequence of each identification region is distinct from the nucleotide sequence of the other identification regions present in the library, and wherein at least two variable immunoglobulin regions in the plurality share at least 80-99% sequence identity.

Also described herein is a polynucleotide library comprising a clonal family of polynucleotides, wherein each polynucleotide in the family comprises a first region and a second region, wherein the first region comprises an expressed B cell variable immunoglobulin region and the second region comprises an identification region, wherein the first region is coupled to the second region, wherein the nucleotide sequence of each identification region is distinct from the nucleotide sequence of the other identification regions present in the family, and wherein each of the variable immunoglobulin regions in the family exhibit at least 80-99% sequence identity. In some aspects, the library comprises a plurality of clonal families.

Also described herein is a clonal family of immunoglobulin sequences wherein each sequence in the family is coupled to an identification region. In some aspects, each identification region is distinct from the other identification regions. In some aspects, the immunoglobulin sequences comprise heavy chain immunoglobulin sequences. In some aspects, the immunoglobulin sequences comprise light chain immunoglobulin sequences. In some aspects, the immunoglobulin sequences comprise heavy chain and light chain immunoglobulin sequences. In some aspects, one or more of the identification regions comprise a light chain immunoglobulin sequence. In some aspects, one or more of the identification regions comprise a heavy chain immunoglobulin sequence.

Also described herein is a set of two or more of the clonal families described herein.

Also described herein is a set of 2, 3, 4, 5, 6, 7, 8, 9, 10, 11, 12, 13, 14, 15, 16, 17, 18, 19, 20, or more of the clonal families described herein.

Also described herein is a clonal family of immunoglobulin sequences wherein each sequence in the family is operatively coupled to at least one contiguous nucleotide sequence. In some aspects, the immunoglobulin sequences comprise heavy chain immunoglobulin sequences and the at least one contiguous nucleotide sequence comprises a light chain immunoglobulin sequence. In some aspects, the immunoglobulin sequences comprise light chain immunoglobulin sequences and the at least one contiguous nucleotide sequence comprises a heavy chain immunoglobulin sequence.

Also described herein is a method of producing a clonal family of immunoglobulin sequences comprising obtaining a plurality of immunoglobulin sequences each having V, D, and/or J regions and each coupled to an identification region; and grouping two or more sequences from the plurality to produce the clonal family wherein each sequence in the clonal family is a mutated version of the same germline immunoglobulin sequence having a V, D, and/or J region or the germline immunoglobulin sequence having the V, D, and/or J region.

In some aspects, each identification region is distinct from the other identification regions.

Also described herein is a method of producing a clonal family of immunoglobulin sequences comprising obtaining a plurality of immunoglobulin sequences each having V, D, and/or J regions and each coupled to an identification region, and wherein each identification region is distinct from the other identification regions; removing one or more identification regions; and grouping two or more sequences from the plurality to produce the clonal family wherein each sequence in the clonal family is a mutated version of the same germline immunoglobulin sequence having a V, D, and/or J region or the germline immunoglobulin sequence having the V, D, and/or J region.

Also described herein is a method of identifying a second cDNA coupled to a first identification region comprising selecting a first cDNA coupled to the first identification region and identifying the second cDNA based on the shared identity of the identification region coupled to each cDNA.

Also described herein is a method of producing a 3' tail on a second nucleotide sequence comprising obtaining a first nucleotide sequence and contacting the first nucleotide sequence with a thermal stable RNase H⁻ reverse transcriptase having template switching activity at less than 50° C., wherein the contacting produces the 3' tail and the second nucleotide sequence. In some aspects, the first nucleotide sequence is contacted at about less than 50, 49, 48, 47, 46, 45, 44, 43, 42, or less than 42° C. In some aspects, the first nucleotide sequence is contacted at 42° C. In some aspects, the first nucleotide sequence is contacted at 45.5° C. In some aspects, the transcriptase is a Moloney Murine Leukemia Virus (MMLV) RNase H⁻ reverse transcriptase. In some aspects, the transcriptase is SuperScript III.

Also described herein is a method for determining the naturally occurring sequence of a first sequence of interest comprising obtaining a plurality of sequences related to the first sequence and each coupled to a first identification region, wherein each first identification region is identical, and wherein one or more of the sequences in the plurality is distinct from the naturally occurring sequence; and comparing the sequences in the plurality to determine the naturally occurring sequence of the first sequence of interest. In some aspects, the plurality of sequences comprise immunoglobulin sequences. In some aspects, the plurality of sequences comprise immunoglobulin sequences. In some aspects, the plurality of sequences comprise immunoglobulin sequences. In some aspects, the plurality of sequences are each coupled to a second identification region and each second identification region is identical. In some aspects, the first sequence of interest is an immunoglobulin sequence. In some aspects, the plurality of sequences are immunoglobulin sequences.

Also described herein is a composition comprising a polynucleotide comprising a first region and a second region, wherein the first region comprises a B cell-derived variable immunoglobulin region and the second region comprises an identification region, and wherein the first region is coupled to the second region.

Also described herein is a polynucleotide composition library comprising a plurality of polynucleotide compositions, wherein each composition is present in a separate container, wherein each composition comprises a polynucleotide comprising a B cell-derived variable immunoglobulin region and an identification region, wherein the variable immunoglobulin region is coupled to the identification region, wherein the nucleotide sequence of each identification region is distinct from the nucleotide sequence of the other identification regions present in each separate container in the library.

Also described herein is a method for producing a polynucleotide composition, comprising: obtaining a polynucleotide comprising a first region, wherein the first region comprises an expressed B cell variable immunoglobulin region associated with a subject; and generating the polynucleotide composition comprising the first region and a second region by coupling the first region to the second region, wherein the second region comprises an identification region.

In some aspects, obtaining the polynucleotide comprises obtaining a B cell associated with the subject and processing the cell to prepare the polynucleotide. In some aspects, obtaining the polynucleotide comprises receiving the polynucleotide directly or indirectly from a third party that has processed a B cell associated with the subject to prepare the polynucleotide. In some aspects, obtaining the polynucleotide comprises receiving the polynucleotide directly or indirectly from a third party that has solubilized a B cell associated with the subject to prepare the polynucleotide. In some aspects, obtaining the polynucleotide comprises obtaining a B cell using a flow cytometer. In some aspects, obtaining the polynucleotide comprises obtaining a B cell using a microfluidic device.

In some aspects, the variable immunoglobulin region comprises a VDJ region of an IgG immunoglobulin nucleotide sequence isolated from an activated human B cell greater than or equal to 8 μm in diameter, and wherein the 5' end of the immunoglobulin region is coupled to the 3' end of the identification region. In some aspects, the composition is comprised in a clonal family.

In some aspects, the immunoglobulin region is isolated from a B cell, and wherein the B cell is an activated B cell. In some aspects, the immunoglobulin region is isolated from a B cell, and wherein the B cell is a plasmablast. In some aspects, the immunoglobulin region is isolated from a B cell, and wherein the B cell is a single B cell. In some aspects, the immunoglobulin region is isolated from a B cell, and wherein the B cell is a single activated B cell. In some aspects, the immunoglobulin region is isolated from a B cell, and wherein the B cell is a single activated B cell located in the blood of a subject. In some aspects, the immunoglobulin region is isolated from a B cell, and wherein the B cell is a human activated B cell. In some aspects, the immunoglobulin region is isolated from a B cell, and wherein the B cell is a memory B cell. In some aspects, the immunoglobulin region is isolated from a B cell, and wherein the B cell is a plasma cell. In some aspects, the immunoglobulin region is isolated from a B cell, and wherein the B cell is an antigen-specific B cell. In some aspects, the immunoglobulin region is isolated from a mammalian B cell. In some aspects, the immunoglobulin region is isolated from a human B cell. In some aspects, the immunoglobulin region is isolated from a mouse B cell. In some aspects, the immunoglobulin region is isolated from a B cell from a subject with a disease or condition of interest. In some aspects, the immunoglobulin region is isolated from a B cell from a subject recovering from or recovered from a disease or condition of interest. In some aspects, the immunoglobulin region is isolated from a B cell from a subject administered with at least one antigen of interest. In some aspects, the immunoglobulin region is isolated from a B cell from a subject administered with at least one antigen of interest and an adjuvant. In some aspects, the immunoglobulin region is isolated from a B cell located in the blood of a subject. In some aspects, the immunoglobulin region is isolated from a B cell located in the bone marrow of a subject. In some aspects, the immunoglobulin region is isolated from a B cell located in the spleen of a subject. In some aspects, the immunoglobulin region is isolated from a B cell located in at least one lymph node of a subject. In some aspects, the immunoglobulin region is isolated from a B cell located in lymphoid tissue of a subject. In some aspects, the immunoglobulin region is isolated from a B cell located in the gut of a subject. In some aspects, the immunoglobulin region is isolated from an activated B cell that is about 8-20 μm in diameter. In some aspects, the immunoglobulin region is isolated from an activated B cell that is 8, 9, 10, 11, 12, 13, 14, 15, 16, 17, 18, 19, 20, or greater than 20 μm in diameter. In some aspects, the immunoglobulin region is isolated from an activated B cell that is about 60, 70, 80, 90, 100, 120, 130, 140, 150, 200, 250, 300, 350, or greater than 350 μm$^2$ in area. In some aspects, the immunoglobulin region is isolated from an activated B cell that is about 250, 268, 300, 400, 500, 600, 700, 800, 900, 1000, 2000, 3000, 4000, or greater than 4000 μm$^3$ in volume. In some aspects, the immunoglobulin region is isolated from an activated B cell that has a diameter of 10% or greater in size than the median diameter of a control resting B cell. In some aspects, the immunoglobulin region is isolated from an activated B cell that has a diameter of 15% or greater in size than the median diameter of a control resting B cell. In some aspects, the immunoglobulin region is isolated from an activated B cell that has a diameter of 20% or greater in size than the median diameter of a control resting B cell. In some aspects, the immunoglobulin region is isolated from an activated B cell capable of secreting immunoglobulin. In some aspects, the immunoglobulin region is isolated from a B cell in the gap 1 (G1), synthesis (S), gap 2 (G2), or mitosis (M) phase of the cell cycle. In some aspects, the immunoglobulin region is isolated from a B cell is not in the gap 0 (G0) phase of the cell cycle. In some aspects, the immunoglobulin region is isolated from a B cell characterized as having an FSC greater than 1.2× of the FSC mean of resting B lymphocytes by flow cytometry. In some aspects, the immunoglobulin region is isolated from a B cell characterized as having an FSC mean between 0.7-1.15× of the FSC mean of human monocytes by flow cytometry. In some aspects, the immunoglobulin region is isolated from a single CD19 positive B cell. In some aspects, the immunoglobulin region is isolated from a single CD38 positive B cell. In some aspects, the immunoglobulin region is isolated from a single CD27 positive B cell. In some aspects, the immunoglobulin region is isolated from a single CD20 negative B cell. In some aspects, the immunoglobulin region is isolated from a single $CD19^+CD20^-CD27^+CD38^{hi}$ B cell.

In some aspects, the 5' end of the immunoglobulin region is coupled to the 3' end of the identification region.

In some aspects, the variable immunoglobulin region comprises a VDJ region of an immunoglobulin nucleotide sequence. In some aspects, the variable immunoglobulin region comprises a VJ region of an immunoglobulin nucleotide sequence. In some aspects, the variable immunoglobulin region comprises a V, D, and/or J region of an immunoglobulin nucleotide sequence. In some aspects, the variable immunoglobulin region comprises a heavy and/or light chain of an immunoglobulin nucleotide sequence. In some aspects, the variable immunoglobulin region comprises an IgG, IgM, IgD, IgE, or IgA immunoglobulin sequence. In some aspects, the variable immunoglobulin region comprises a human IgG1, IgG2, IgG3, or IgG4 immunoglobulin sequence. In some aspects, the variable immunoglobulin region comprises a mouse IgG1, IgG2a, IgG2b, or IgG3 immunoglobulin sequence. In some aspects, the immunoglobulin region is about 200-2000 nucleotides in length. In some aspects, the immunoglobulin region is less than 200, 200, 300, 400, 500, 600, 700, 800, 900, 1000, 1100, 1200, 1300, 1400, 1500, 1600, 1700, 1800, 1900, 2000, or greater than 2000 nucleotides in length.

In some aspects, the identification region comprises a plurality of identification regions. In some aspects, the identification region comprises a plurality of identification regions, and wherein each identification region in the plurality has a distinct sequence. In some aspects, the identification region comprises at least one sample identification region and at least one plate identification region. In some aspects, the identification region comprises a sequence distinct from the sequence of the immunoglobulin region. In some aspects, the identification region is about 2-100 nucleotides in length. In some aspects, the identification region is 2, 3, 4, 5, 6, 7, 8, 9, 10, 11, 12, 13, 14, 15, 16, 17, 18, 19, 20, 30, 40, 50, 60, 70, 80, 90, 100, or greater than 100 nucleotides in length. In some aspects, the identification region is 0.2-1,000 nucleotides in length. In some aspects, the identification region is equal to or greater than 100 nucleotides in length. In some aspects, the identification region comprises a contiguous non-coding nucleotide sequence. In some aspects, the identification region comprises a non-coding nucleotide sequence. In some aspects, the identification region comprises a non-contiguous, non-coding nucleotide sequence. In some aspects, the length of the sequence of the identification region is less than the length of the sequence of the immunoglobulin region.

In some aspects, a composition described herein can include a third region, wherein the third region comprises an adapter region. In some aspects, the third region comprises an adapter region, and wherein the third region is located between the first region and the second region. In some aspects, the third region comprises an adapter region, and wherein the adapter region comprises at least one G nucleotide located at its 3' end.

In some aspects, the identification region is 2-100 nucleotides long and has a sequence distinct from the immunoglobulin region sequence, and wherein the adaptor region comprises at least one G nucleotide at its 3' end and is located 3' of the sample identification region and 5' of the immunoglobulin region, and wherein the immunoglobulin variable region has undergone hypermutation and differs from the germline sequence of a naïve B cell.

In some aspects, the composition is present in a container. In some aspects, a plurality of the compositions are present in a container. In some aspects, a plurality of the compositions are present in a single well of a single plate comprising a plurality of wells.

In some aspects, the composition is in a library of compositions, wherein each composition is present in a separate container, wherein each composition comprises a polynucleotide comprising a first region and a second region, wherein the first region comprises an expressed B cell variable immunoglobulin region and the second region comprises an identification region, wherein the first region is coupled to the second region, wherein the nucleotide sequence of each identification region o is distinct from the nucleotide sequence of the other identification regions present in the library, and wherein the last nucleotide sequences of a plurality of variable immunoglobulin regions in the library share at least 80-99% sequence identity.

In some aspects, the composition is comprised in a library comprising a plurality of polynucleotide compositions, wherein each composition is present in a separate container, wherein each composition comprises a polynucleotide, wherein the polynucleotide comprises a first region and a second region, wherein the first region comprises an expressed B cell variable immunoglobulin region and the second region comprises an identification region, wherein the first region is coupled to the second region, and wherein the nucleotide sequence of each identification region is distinct from the nucleotide sequence of the other identification regions present in each separate container in the library.

Also described herein is a method for producing a polynucleotide composition, comprising: obtaining a B cell associated with a subject; isolating polynucleotides from the cell comprising an expressed B cell variable immunoglobulin region; and generating the polynucleotide composition comprising the variable immunoglobulin region and an identification region by coupling the variable immunoglobulin region to the identification region.

Also described herein is a method for producing a polynucleotide composition, comprising: obtaining a polynucleotide comprising a B cell-derived variable immunoglobulin region associated with a subject; and generating the polynucleotide composition comprising the variable immunoglobulin region and an identification region by coupling the variable immunoglobulin region to the identification region.

In some aspects, obtaining the polynucleotide comprises obtaining a B cell and processing the cell to prepare the polynucleotide. In some aspects, obtaining the polynucleotide comprises receiving the polynucleotide directly or indirectly from a third party that has processed a B cell to prepare the polynucleotide.

Also described herein is a method for producing two or more polynucleotide compositions, comprising: obtaining a polynucleotide library comprising a plurality of polynucleotides associated with a plurality of samples obtained from one or more subjects, wherein one or more polynucleotides comprises an expressed B cell variable immunoglobulin region, wherein each sample is associated with a B cell, and wherein each polynucleotide associated with each sample is present in a separate container; and generating two or more polynucleotide compositions each comprising a polynucleotide from the plurality of polynucleotides and an identification region by coupling the polynucleotide to the identification region, wherein the sequence of each identification region is distinct from the sequence of the identification regions coupled to the other polynucleotides in the library.

In some aspects, obtaining the polynucleotide library comprises obtaining a plurality of B cells and processing the cells to prepare the polynucleotide library. In some aspects, obtaining the polynucleotide library comprises receiving the polynucleotide library directly or indirectly from a third party that has processed a plurality of B cells to prepare the polynucleotide library.

Also described herein is a method for producing two or more polynucleotide compositions, comprising: obtaining a polynucleotide library comprising a plurality of polynucleotides associated with a plurality of samples obtained from one or more subjects, wherein one or more polynucleotides comprises a B cell-derived variable immunoglobulin region, and wherein each polynucleotide associated with each sample is present in a separate container; and generating two or more polynucleotide compositions each comprising a polynucleotide from the plurality of polynucleotides and an identification region by coupling the polynucleotide to the identification region, wherein the sequence of each identification region is distinct from the sequence of the identification regions coupled to the other polynucleotides in the library.

In some aspects, obtaining the polynucleotide library comprises obtaining a plurality of B cells and processing the cells to prepare the polynucleotide library. In some aspects, obtaining the polynucleotide library comprises receiving the polynucleotide library directly or indirectly from a third party that has processed a plurality of B cells to prepare the polynucleotide library.

Also described herein is a polynucleotide composition library comprising a plurality of polynucleotide compositions, wherein each composition is present in a separate container, wherein each composition comprises a single sample-derived cDNA region comprising the nucleotide C at the 3' end of the cDNA region and a sample identification-adapter region comprising a sample identification region coupled to an adapter region, wherein the nucleotide sequence of the sample identification region of each sample identification-adapter region is distinct from the nucleotide sequence of the sample identification region of the other sample identification-adapter regions present in each separate container in the library, wherein the adapter region comprises the nucleotide G at the 3' end of the adapter region, and wherein the sample identification-adapter region is attached to the cDNA region by binding between the C and G.

In some aspects, the cDNA region comprises an RNA polynucleotide hybridized to a DNA polynucleotide. In some aspects, the cDNA region comprises an mRNA polynucleotide hybridized to a cDNA polynucleotide. In some aspects, the cDNA region comprises at least one C at the 3' end and wherein the adapter region comprises at least one G at the 3' end.

Also described herein is a polynucleotide library comprising a plurality of polynucleotides, wherein each polynucleotide comprises a sample identification region, an adapter region, and a single sample-derived cDNA region, wherein the 3' end of the sample identification region is coupled to the 5' end of the adapter region, wherein the cDNA region is coupled to the 3' end of the adapter region, wherein the sequence of the sample identification region of each polynucleotide from a first single sample is distinct from the sequence of the sample identification region of the other polynucleotides in the library from one or more samples distinct from the first single sample, and wherein the sample identification region is double-stranded. In some aspects, each polynucleotide comprises a plurality of sample identifications regions.

Also described herein is a polynucleotide library comprising a plurality of polynucleotides, wherein each polynucleotide comprises a universal primer region, a sample identification region, an adapter region, and an amplicon region from a single sample, wherein the 3' end of the universal primer region is coupled to the 5' end of the sample identification region, wherein the 3' end of the sample identification region is coupled to the 5' end of the adapter region, wherein the amplicon region is operatively coupled to the adapter region, wherein the sequence of the universal primer region is substantially identical on each polynucleotide in the plurality of polynucleotides, and wherein the sequence of the sample identification region of each polynucleotide from a first single sample is distinct from the sequence of the sample identification region of the other polynucleotides in the library from one or more samples distinct from the first single sample.

In some aspects, the 5' end of the amplicon region is coupled to the 3' end of the adapter region, wherein the universal primer region comprises the sequence CACGACCGGTGCTCGATTTAG (SEQ ID NO:796593), and wherein the adapter region comprises at least one G. In some aspects, the sequence of the universal primer region is not fully complementary to any human gene exon, and wherein the universal primer region has minimal secondary structure that does not interfere with the adapter region. In some aspects, the universal primer region is the sequence CACGACCGGTGCTCGATTTAG (SEQ ID NO:796593). In some aspects, the amplicon region comprises a cDNA region comprising a cDNA nucleotide sequence. In some aspects, the sequence of the sample identification region of each polynucleotide from a first single sample differs by at least 1 nucleotide from the sequence of the sample identification region of the other polynucleotides in the library from one or more samples distinct from the first single sample. In some aspects, the sequence of the sample identification region of each polynucleotide from a first single sample differs by at least 2 nucleotides from the sequence of the sample identification region of the other polynucleotides in the library from one or more samples distinct from the first single sample. In some aspects, the sample identification region is at least 10 nucleotides in length. In some aspects, the sample identification region is at least 1 nucleotide in length. In some aspects, the sequence of each sample identification region is selected from Tables 2 and 7. In some aspects, the sequence of the adapter region comprises at least one G nucleotide at its 3' end. In some aspects, the amplicon region comprises an immunoglobulin heavy chain amplicon sequence, an immunoglobulin light chain amplicon sequence, a T cell receptor alpha amplicon sequence, or a T cell receptor beta amplicon sequence.

Also described herein is a polynucleotide library comprising a plurality of polynucleotides, wherein each polynucleotide comprises the sequence 5'-A-B-C-D-3', wherein A is a universal primer region, wherein B is a sample identification region, wherein C is an adapter region, wherein D is an amplicon region from a single sample, wherein the sequence of the universal primer region is substantially identical on each polynucleotide in the plurality of polynucleotides, and wherein the sequence of the sample identification region of each polynucleotide from a first single sample is distinct from the sequence of the sample identification region of the other polynucleotides in the library from one or more samples distinct from the first single sample.

Also described herein is a polynucleotide comprising a universal primer region, a sample identification region, an adapter region, and an amplicon region from a single sample, wherein the 3' end of the universal primer region is coupled to the 5' end of the sample identification region, wherein the 3' end of the sample identification region is coupled to the 5' end of the adapter region, and wherein the amplicon region is operatively coupled to the adapter region.

In some aspects, the 5' end of the amplicon region is coupled to the 3' end of the adapter region, wherein the universal primer region comprises CACGACCGGTGCTCGATTTAG (SEQ ID NO:796593), and wherein the adapter region comprises at least one G.

Also described herein is a polynucleotide comprising the sequence 5'-A-B-C-D-3', wherein A is a universal primer region, wherein B is a sample identification region, wherein C is an adapter region, and wherein D is an amplicon region from a single sample.

Also described herein is a polynucleotide library comprising a plurality of polynucleotides, wherein each polynucleotide comprises a first plate identification region, a universal primer region, a sample identification region, an adapter region, and an amplicon region from a single sample, wherein the 3' end of the universal primer region is coupled to the 5' end of the sample identification region, wherein the 3' end of the sample identification region is coupled to the 5' end of the adapter region, wherein the first plate identification region is operatively coupled to the universal primer region, wherein the amplicon region is operatively coupled to the adapter region, wherein the sequence of the universal primer region is substantially identical on each polynucleotide in the plurality of polynucleotides, and wherein the sequence of the sample identification region of each polynucleotide from a first single sample is distinct from the sequence of the sample identification region of the other polynucleotides in the library from one or more samples distinct from the first single sample.

In some aspects, the sequence of the first plate identification region of each polynucleotide from a first set of single samples is distinct from the sequence of the first plate identification region of the other polynucleotides in the library from one or more single sample sets distinct from the first set of single samples. In some aspects, the sequence of the first plate identification region of each polynucleotide from the first set of single samples differs by at least 1 nucleotide from the sequence of the first plate identification region of the other polynucleotides in the library from one or more single sample sets distinct from the first set of single samples. In some aspects, the sequence of the first plate identification region of each polynucleotide from the first set of single samples differs by at least 2 nucleotides from the sequence of the first plate identification region of the other polynucleotides in the library from one or more single sample sets distinct from the first set of single samples. In some aspects, the first plate identification region is at least 10 nucleotides in length. In some aspects, the sequence of the first plate identification region is selected from Tables 3 and 6. In some aspects, the 3' end of the first plate identification region is coupled to the 5' end of the universal primer region, wherein the 5' end of the amplicon region is coupled to the 3' end of the adapter region, wherein the universal primer region comprises CACGACCGGTGCTCGATTTAG (SEQ ID NO:796593), wherein the adapter region comprises at least one G, wherein each polynucleotide further comprises a second plate identification region, a first sequencing region, and a second sequencing region, wherein the 5' end of the second plate identification region is coupled to the 3' end of the amplicon region, wherein the 3' end of the first sequencing region is coupled to the 5' end of the first plate identification region, and wherein the 5' end of the second sequencing region is coupled to the 3' end of the second plate identification region. In some aspects, the sequence of the second plate identification region is identical to the sequence of the first plate identification region on each polynucleotide. In some aspects, the sequence of the second plate identification region of each polynucleotide from a first set of single samples is distinct from the sequence of the second plate identification region of the other polynucleotides in the library from one or more single sample sets distinct from the first set of single samples. In some aspects, the sequence of the second plate identification region of each polynucleotide from the first set of single samples differs by at least 1 nucleotide from the sequence of the second plate identification region of the other polynucleotides in the library from one or more single sample sets distinct from the first set of single samples. In some aspects, the sequence of the second plate identification region of each polynucleotide from the first set of single samples differs by at least 2 nucleotides from the sequence of the second plate identification region of the other polynucleotides in the library from one or more single sample sets distinct from the first set of single samples. In some aspects, the second plate identification region is at least 10 nucleotides in length. In some aspects, the sequence of the second plate identification region is selected from Tables 3 and 6. In some aspects, the first sequencing region comprises GAGAGACTGACAGCGTATCGCCTCCCTCGCGCCATCAG (SEQ ID NO:796594). In some aspects, the second sequencing region comprises CTATGCGCCTTGCCAGCCCGCTCAG (SEQ ID NO:796595).

Also described herein is a polynucleotide library comprising a plurality of polynucleotides, wherein each polynucleotide comprises the sequence 5'-A-B-C-D-E-3', wherein A is a plate identification region, wherein B is a universal primer region, wherein C is a sample identification region, wherein D is an adapter region, wherein E is an amplicon region from a single sample, and wherein the sequence of the universal primer region is substantially identical on each polynucleotide in the plurality of polynucleotides, and wherein the sequence of the sample identification region of each polynucleotide from a first single sample is distinct from the sequence of the sample identification region of the other polynucleotides in the library from one or more samples distinct from the first single sample Also described herein is a polynucleotide comprising a first plate identification region, a universal primer region, a sample identification region, an adapter region, and an amplicon region from a single sample, wherein the 3' end of the universal primer region is coupled to the 5' end of the sample identification region, wherein the 3' end of the sample identification region is coupled to the 5' end of the adapter region, wherein the first plate identification region is operatively coupled to the universal primer region, and wherein the amplicon region is operatively coupled to the adapter region.

In some aspects, the 3' end of the first plate identification region is coupled to the 5' end of the universal primer region, wherein the 5' end of the amplicon region is coupled to the 3' end of the adapter region, wherein the universal primer region comprises CACGACCGGTGCTCGATTTAG (SEQ ID NO:796593), wherein the adapter region comprises at least one G, wherein each polynucleotide further comprises a second plate identification region, a first sequencing region, and a second sequencing region, wherein the 5' end of the second plate identification region is coupled to the 3' end of the amplicon region, wherein the 3' end of the first sequencing region is coupled to the 5' end of the first plate identification region, and wherein the 5' end of the second sequencing region is coupled to the 3' end of the second plate identification region.

Also described herein is a polynucleotide comprising the sequence 5'-A-B-C-D-E-3', wherein A is a plate identification region, wherein B is a universal primer region, wherein C is a sample identification region, wherein D is an adapter region, and wherein E is an amplicon region from a single sample.

Also described herein is a polynucleotide library comprising a plurality of polynucleotides, wherein each polynucleotide comprises a first restriction site region, a universal primer region, a sample identification region, an adapter region, an amplicon region from a single sample, and a second restriction site region, wherein the 3' end of the universal primer region is coupled to the 5' end of the sample identification region, wherein the 3' end of the sample identification region is coupled to the 5' end of the adapter region, wherein the first restriction site region is operatively coupled to the universal primer region, wherein the amplicon region is operatively coupled to the adapter region, wherein the second restriction site region is operatively coupled to the amplicon region, wherein the sequence of the universal primer region is substantially identical on each polynucleotide in the plurality of polynucleotides, and wherein the sequence of the sample identification region of each polynucleotide from a first single sample is distinct from the sequence of the sample identification region of the other polynucleotides in the library from one or more samples distinct from the first single sample.

In some aspects, the first restriction site region comprises one or more restriction sites. In some aspects, the first restriction site region comprises one or more restriction sites selected from the group consisting of: NheI, XhoI, BstBI, EcoRI, SacII, BbvCI, PspXI, AgeI, ApaI, KpnI, Acc65I, XmaI, BstEII, DraIII, PacI, FseI, AsiSI and AscI. In some aspects, the second restriction site region comprises one or more restriction sites. In some aspects, the second restriction site region comprises one or more restriction sites selected from the group consisting of: NheI, XhoI, BstBI, EcoRI, SacII, BbvCI, PspXI, AgeI, ApaI, KpnI, Acc65I, XmaI, BstEII, DraIII, PacI, FseI, AsiSI and AscI. In some aspects, the 3' end of the first restriction site region is coupled to the 5' end of the universal primer region, wherein the 3' end of the adapter region is coupled to the 5' end of the amplicon region, wherein the 3' end of the amplicon region is coupled to the 5' end of the second restriction site region, wherein the universal primer region comprises CACGACCGGTGCTCGATTTAG (SEQ ID NO:796593), and wherein the adapter region comprises at least one G.

Also described herein is a polynucleotide library comprising a plurality of polynucleotides, wherein each polynucleotide comprises the sequence 5'-A-B-C-D-E-F-3', wherein A is a first restriction site region, wherein B is a universal primer region, wherein C is a sample identification region, wherein D is an adapter region, wherein E is an amplicon region from a single sample, wherein F is a second restriction site region, wherein the sequence of the universal primer region is substantially identical on each polynucleotide in the plurality of polynucleotides, and wherein the sequence of the sample identification region of each polynucleotide from a first single sample is distinct from the sequence of the sample identification region of the other polynucleotides in the library from one or more samples distinct from the first single sample.

Also described herein is a polynucleotide for insertion into a vector, comprising a first restriction site region, a universal primer region, a sample identification region, an adapter region, an amplicon region from a single sample, and a second restriction site region, wherein the 3' end of the universal primer region is coupled to the 5' end of the sample identification region, wherein the 3' end of the sample identification region is coupled to the 5' end of the adapter region, wherein the first restriction site region is operatively coupled to the universal primer region, wherein the amplicon region is operatively coupled to the adapter region, and wherein the second restriction site region is operatively coupled to the amplicon region.

In some aspects, the 3' end of the first restriction site region is coupled to the 5' end of the universal primer region, wherein the 3' end of the adapter region is coupled to the 5' end of the amplicon region, wherein the 3' end of the amplicon region is coupled to the 5' end of the second restriction site region, wherein the universal primer region comprises CACGACCGGTGCTCGATTTAG (SEQ ID NO:796593), and wherein the adapter region comprises at least one G.

Also described herein is a polynucleotide for insertion in a vector, comprising the sequence 5'-A-B-C-D-E-F-3', wherein A is a first restriction site region, wherein B is a universal primer region, wherein C is a sample identification region, wherein D is an adapter region, wherein E is an amplicon region from a single sample, and wherein F is a second restriction site region.

Also described herein is a polynucleotide adapter molecule, comprising a universal primer region, a sample identification region, and an adapter region, wherein the 3' end of the universal primer region is coupled to the 5' end of the sample identification region, and wherein the 3' end of the sample identification region is coupled to the 5' end of the adapter region. In some aspects, the universal primer region comprises CACGACCGGTGCTCGATTTAG (SEQ ID NO:796593), and wherein the adapter region comprises at least one G.

Also described herein is a polynucleotide primer, comprising a universal primer region and a plate identification region, and wherein the 3' end of the plate identification region is coupled to the 5' end of the universal primer region. In some aspects, the universal primer region comprises CACGACCGGTGCTCGATTTAG (SEQ ID NO:796593), wherein the primer further comprises a sequencing region, and wherein the 3' end of the sequencing region is coupled to the 5' end of the plate identification region.

Also described herein is a vector comprising a polynucleotide described herein. In some aspects, the vector comprises a plurality of polynucleotides. In some aspects, the vector is selected from the group consisting of: pEE6.4 and pEE12.4

Also described herein is an isolated host cell comprising a vector described herein or a polynucleotide described herein. In some aspects, the host cell is selected from the group consisting of: CHO cells, CHO-K1 cells, CHO-S cells, NS0 cells, CHO cells that are dhfr–, CHO-dhfr–, DUKX-B11 CHO cells, and DG44 CHO cells.

Also described herein is a method for producing one or more polynucleotides of interest, comprising: obtaining a cDNA library comprising a plurality of cDNAs associated with a plurality of samples obtained from one or more subjects, wherein each cDNA is associated with a single sample in the plurality of samples, and wherein each cDNA associated with each sample is present in a separate container; and adding an adapter molecule to the cDNA associated with each sample to produce the one or more polynucleotides of interest, wherein the adapter molecule comprises a sample identification region and an adapter region, wherein the 3' end of the sample identification region is coupled to the 5' end of the adapter region, and wherein the sequence of the sample identification region of each adapter molecule is distinct from the sequence of the sample identification region of the other adapter molecules added to each cDNA in the library.

In some aspects, the method further includes allowing the 3' end of the adapter region to attach to the 3' end of each cDNA in the library to produce the one or more polynucleotides of interest. In some aspects, obtaining the cDNA library comprises obtaining the plurality of samples and processing the samples to prepare the cDNA library. In some aspects, the adapter molecule further comprises a universal primer region, wherein the 3' end of the universal primer region is coupled to the 5' end of the sample identification region. In some aspects, each cDNA region comprises an mRNA polynucleotide hybridized to a cDNA polynucleotide. In some aspects, each sample comprises a cell. In some aspects, the cell is a B cell. In some aspects, the B cell is a plasmablast, memory B cell, or a plasma cell. In some aspects, each sample comprises a plurality of cells. In some aspects, obtaining the cDNA library comprises receiving the cDNA library directly or indirectly from a third party that has processed the plurality of samples to prepare the cDNA library. In some aspects, the adaptor is added by annealing the adaptor to the '3 tail of a cDNA generated during a reverse transcription reaction. In some aspects, each cDNA comprises at least one C nucleotide, wherein C is located at the 3' end of each cDNA, wherein the adapter region comprises at least one G nucleotide, wherein G is located at the 3' end of the adapter region, and wherein the adapter region is attached to each cDNA via binding between the G and C. In some aspects, the adapter molecule is single-stranded, and further comprising incorporating the adapter molecule into each cDNA by allowing an enzyme to make the adapter molecule double-stranded. In some aspects, the adapter molecule is incorporated into each cDNA to produce the polynucleotide of interest by an MMLV H⁻ reverse transcriptase.

Also described herein is a method of producing one or more polynucleotides of interest for sequencing, comprising: obtaining a polynucleotide library comprising a plurality of polynucleotides, wherein each polynucleotide comprises a universal primer region, a sample identification region, an adapter region, and an amplicon region from a single sample, wherein the 3' end of the universal primer region is coupled to the 5' end of the sample identification region, wherein the 3' end of the sample identification region is coupled to the 5' end of the adapter region, and wherein the amplicon region is operatively coupled to the adapter region, wherein the sequence of the universal primer region is substantially identical on each polynucleotide in the plurality of polynucleotides, and wherein the sequence of the sample identification region of each polynucleotide from a first single sample is distinct from the sequence of the sample identification region of the other polynucleotides in the library from one or more samples distinct from the first single sample; and amplifying the polynucleotide library with a set of primers to produce the one or more polynucleotides of interest for sequencing, wherein the one or more polynucleotides of interest for sequencing comprises a first sequencing region, a first plate identification region, a universal primer region, a sample identification region, an adapter region, an amplicon region from a single sample, and a second sequencing region, wherein the 3' end of the universal primer region is coupled to the 5' end of the sample identification region, wherein the 3' end of the sample identification region is coupled to the 5' end of the adapter region, wherein the first plate identification region is operatively coupled to the universal primer region, wherein the amplicon region is operatively coupled to the adapter region, wherein the first sequencing region is located at the 5' end of the polynucleotide of interest, and wherein the second sequencing region is located at the 3' end of the polynucleotide of interest.

In some aspects, the method further includes sequencing the one or more polynucleotides of interest. In some aspects, the method further includes sequencing the one or more polynucleotides of interest with 454 sequencing. In some aspects, the method further includes sequencing the one or more polynucleotides of interest with SMRT sequencing. In some aspects, the method further includes sequencing the one or more polynucleotides of interest with SOLiD sequencing. In some aspects, the method further includes sequencing the one or more polynucleotides of interest with SOLEXA sequencing. In some aspects, the method further includes sequencing the one or more polynucleotides of interest with tSMS sequencing. In some aspects, the set of primers is selected from the primers shown in Tables 1 and 5. In some aspects, obtaining the polynucleotide library comprises preparing the polynucleotide library in a laboratory. In some aspects, obtaining the polynucleotide library comprises receiving the polynucleotide library directly or indirectly from a third party that has prepared the polynucleotide library.

Also described herein is a method for analyzing sequencing data, comprising: obtaining a dataset associated with a plurality of polynucleotides, wherein the dataset comprises sequencing data for the plurality of polynucleotides, wherein each polynucleotide in the plurality of polynucleotides comprises a sample identification region, and wherein each sample identification region on each polynucleotide is unique to a single sample, wherein the sequence of the sample identification region of each polynucleotide from a first single sample is distinct from the sequence of the sample identification region of the other polynucleotides in the plurality of polynucleotides from one or more samples distinct from the first single sample; and analyzing the dataset to match together polynucleotides with identical sample identification regions, wherein a match indicates that the polynucleotides originated from the same sample.

In some aspects, each polynucleotide in the plurality of polynucleotides further comprises a first plate identification region, wherein each combination of each first plate identification region and sample identification region on each polynucleotide is unique to a single sample, wherein the sequence of the first plate identification region of each polynucleotide from a first set of single samples is distinct from the sequence of the first plate identification region of the other polynucleotides in the plurality of polynucleotides from one or more single sample sets distinct from the first set of single samples, and further comprising analyzing the dataset to match together polynucleotides with identical first plate identification regions and identical sample identification regions, wherein a match between both regions indicates that the polynucleotides originated from the same sample. In some aspects, obtaining the dataset comprises obtaining the plurality of polynucleotides and sequencing the plurality of polynucleotides to experimentally determine the dataset. In some aspects, obtaining the dataset comprises receiving the dataset directly or indirectly from a third party that has sequenced the plurality of polynucleotides to experimentally determine the dataset. In some aspects, the dataset is stored on an electronic storage medium. In some aspects, the single sample is a single cell. In some aspects, the single sample comprises a single cell. In some aspects, the single sample comprises a single B cell. In some aspects, the single sample comprises a plurality of B cells. In some aspects, further comprising selecting one or more polynucleotides for cloning.

Also described herein is a method for identifying a second polynucleotide of interest based on selection of a first polynucleotide of interest, comprising: obtaining a dataset associated with a plurality of polynucleotides, wherein the dataset comprises sequencing data for the plurality of polynucleotides, wherein each polynucleotide in the plurality of polynucleotides comprises a sample identification region, and wherein each sample identification region on each polynucleotide is unique to a single sample thereby associating each polynucleotide in the plurality of polynucleotides with a distinct single sample, wherein the sequence of the sample identification region of each polynucleotide from a first single sample is distinct from the sequence of the sample identification region of the other polynucleotides in the plurality of polynucleotides from one or more samples distinct from the first single sample; and selecting a first polynucleotide of interest associated with a first single sample from the dataset and identifying a second polynucleotide of interest in the first single sample based on the sample identification region of the first polynucleotide of interest.

In some aspects, each polynucleotide in the plurality of polynucleotides further comprises a first plate identification region, wherein each combination of each first plate identification region and sample identification region on each polynucleotide is unique to a single sample, wherein the sequence of the first plate identification region of each polynucleotide from a first set of single samples is distinct from the sequence of the first plate identification region of the other polynucleotides in the plurality of polynucleotides from one or more single sample sets distinct from the first set of single samples, and further comprising identifying a second polynucleotide of interest in the first single sample based on the sample identification region and first plate identification region of the first polynucleotide of interest. In some aspects, the first single sample comprises a B cell. In some aspects, the first single sample comprises a plurality of B cells. In some aspects, the first single sample comprises a B cell, wherein the first polynucleotide of interest comprises an antibody heavy chain nucleotide sequence, and wherein the second polynucleotide of interest comprises an antibody light chain nucleotide sequence. In some aspects, the first single sample comprises a B cell, wherein the first polynucleotide of interest comprises an antibody light chain nucleotide sequence, and wherein the second polynucleotide of interest comprises an antibody heavy chain nucleotide sequence. In some aspects; obtaining the dataset comprises obtaining the plurality of polynucleotides and sequencing the plurality of polynucleotides to experimentally determine the dataset. In some aspects, obtaining the dataset comprises receiving the dataset directly or indirectly from a third party that has sequenced the plurality of polynucleotides to experimentally determine the dataset. In some aspects, the dataset is stored on an electronic storage medium.

Also described herein is a method of producing one or more polynucleotides of interest for cloning, comprising: obtaining a polynucleotide library comprising a plurality of polynucleotides, wherein each polynucleotide comprises a universal primer region, a sample identification region, an adapter region, and an amplicon region from a single sample, wherein the 3' end of the universal primer region is coupled to the 5' end of the sample identification region, wherein the 3' end of the sample identification region is coupled to the 5' end of the adapter region, and wherein the amplicon region is operatively coupled to the adapter region, wherein the sequence of the universal primer region is substantially identical on each polynucleotide in the plurality of polynucleotides, and wherein the sequence of the sample identification region of each polynucleotide from a first single sample is distinct from the sequence of the sample identification region of the other polynucleotides in the library from one or more samples distinct from the first single sample; and amplifying the polynucleotide library with a set of primers to produce the one or more polynucleotides of interest for cloning, wherein the one or more polynucleotides of interest for cloning comprises a first restriction site region, a universal primer region, a sample identification region, an adapter region, an amplicon region from a single sample, and a second restriction site region, wherein the 3' end of the universal primer region is coupled to the 5' end of the sample identification region, wherein the 3' end of the sample identification region is coupled to the 5' end of the adapter region, wherein the amplicon region is operatively coupled to the adapter region, wherein the first restriction site region is located at the 5' end of the polynucleotide of interest, and wherein the second restriction site region is located at the 3' end of the polynucleotide of interest.

In some aspects, obtaining the polynucleotide library comprises preparing the polynucleotide library in a laboratory. In some aspects, obtaining the polynucleotide library comprises receiving the polynucleotide library directly or indirectly from a third party that has prepared the polynucleotide library.

Also described herein is a method of producing a molecule of interest, comprising: obtaining a host cell comprising a polynucleotide comprising a sample identification region, an adapter region, and an amplicon region from a single sample, wherein the 3' end of the sample identification region is coupled to the 5' end of the adapter region, and wherein the amplicon region is operatively coupled to the adapter region; and culturing the host cell under conditions sufficient to produce the molecule of interest. In some aspects, obtaining the host cell comprises preparing the host cell comprising the polynucleotide in a laboratory. In some aspects, obtaining the host cell comprises receiving the host cell comprising the polynucleotide directly or indirectly from a third party that has prepared the host cell. In some aspects, the molecule of interest is a protein. In some aspects, the molecule of interest is an antibody. In some aspects, the molecule of interest is a human monoclonal antibody. In some aspects, further comprising collecting the molecule of interest.

Also described herein is a kit, comprising a polynucleotide, a polynucleotide library, a vector, or a host cell described herein and instructions for use.

Also described herein is a method of linking and barcoding a plurality of non-contiguous polynucleotide sequences of interest, said method comprising: (a) providing a plurality of cDNA molecules; (b) physically linking cDNA molecules of interest; and (c) adding a barcode sequence to the cDNAs of interest prior to, during, or after physical linkage.

In some aspects, the physical linking is by ligation. In some aspects, the physical linking is by recombination. In some aspects, the physical linking comprises using an overlap-extension sequence. In some aspects, the barcode sequence is located at one or both of the ends of the physically linked cDNAs. In some aspects, the barcode sequence is located in between the physically linked cDNAs. In some aspects, the ligation is performed by annealing and ligation of compatible ends. In some aspects, the compatible ends are a restriction site. In some aspects, the ligation is performed by blunt end ligation. In some aspects, the overlap-extension sequence is added during the course of amplification using a primer comprising the overlap-extension tail. In some aspects, the overlap-extension sequence is added during the course of reverse transcription using a primer comprising the overlap-extension tail. In some aspects, the overlap-extension sequence is added by annealing an adaptor to the 3' tail of a cDNA generated during a reverse transcription reaction. In some aspects, the barcode sequence is added by ligation. In some aspects, the ligation is performed by annealing and ligation of compatible ends. In some aspects, the compatible ends are a restriction site. In some aspects, the ligation is performed by blunt end ligation of an adaptor comprising the barcode sequence. In some aspects, the barcode sequence is added during the course of an amplification reaction using a primer comprising the barcode sequence. In some aspects, the barcode sequence is added during the course of a reverse transcription reaction using a primer comprising the barcode sequence. In some aspects, the barcode sequence is added by annealing an adaptor to the 3' tail of a cDNA generated during a reverse transcription reaction. In some aspects, the '3 end of the cDNA comprises at least one C nucleotide, and wherein the 3' end of the adaptor comprises at least one G nucleotide, and wherein the adaptor is attached to each cDNA via binding between the C and G. In some aspects, the adaptor is single-stranded, and further comprising incorporating the adaptor into each cDNA by allowing an enzyme to make the adaptor double-stranded. In some aspects, the adaptor is incorporated into each cDNA by an MMLV If reverse transcriptase. In some aspects, the overlap-extension sequence comprises a barcode sequence. In some aspects, the polynucleotide sequences of interest comprise antibody heavy and light chains. In some aspects, further comprising (d) adding a sequencing region to the cDNAs of interest prior to, during, or after physical linkage. In some aspects, the sequencing region is added with an adaptor. In some aspects, further comprising (e) sequencing of the physically linked cDNA molecules of interest using a NextGen sequencing platform. In some aspects, the NextGen sequencing platform is 454 sequencing. In some aspects, the NextGen sequencing platform is SMRT sequencing. In some aspects, the NextGen sequencing platform is SOLiD sequencing. In some aspects, the NextGen sequencing platform is SOLEXA sequencing. In some aspects, the NextGen sequencing platform is tSMS sequencing. In some aspects, the plurality of cDNA molecules is from single samples contained in a plate with at least 6 wells, at least 12 wells, at least 24 wells, at least 48 wells, at least 96 wells, at least 384 wells, at least 1536 wells, or more wells. In some aspects, the plurality of cDNA molecules is from single samples contained in at least one, two, three, four, five, six, seven, eight, nine, ten, twenty, thirty, forty, fifty, seventy five, one hundred, or more plates with at least 96 wells each.

Also described herein is a method of linking and barcoding a plurality of samples containing polynucleotide sequences of interest, said method comprising: (a) distributing the samples into a plurality of containers; (b) synthesizing polynucleotide sequences of interest using templates from the sample, wherein said synthesis results in the addition of a barcode sequence; and (c) effecting linkage of the polynucleotide sequences of interest synthesized in step (b).

In some aspects, each sample comprises a cell. In some aspects, the cell is a B cell. In some aspects, the B cell is a plasmablast, memory B cell, or a plasma cell. In some aspects, each sample comprises a plurality of cells. In some aspects, the polynucleotide sequences of interest comprise antibody heavy and light chains. In some aspects, said synthesis comprises an RT-PCR amplification. In some aspects, said RT-PCR amplification is performed in a single step. In some aspects, said linkage of the polynucleotide of interest is performed during the course of an RT-PCR amplification using an overlap-extension primer. In some aspects, further comprising (d) adding a sequencing region to the polynucleotide sequences of interest prior to, during, or after barcode sequence addition or linkage. In some aspects, the sequencing region is added with an adaptor. In some aspects, further comprising (e) sequencing of the linked polynucleotide sequences of interest using a NextGen sequencing platform. In some aspects, the NextGen sequencing platform is 454 sequencing. In some aspects, the NextGen sequencing platform is SMRT sequencing. In some aspects, the NextGen sequencing platform is SOLiD sequencing. In some aspects, the NextGen sequencing platform is SOLEXA sequencing. In some aspects, the NextGen sequencing platform is tSMS sequencing. In some aspects, the plurality of samples are single samples contained in a plate with at least 6 wells, at least 12 wells, at least 24 wells, at least 48 wells, at least 96 wells, at least 384 wells, at least 1536 wells, or more wells. In some aspects, the plurality of samples are single samples contained in at least one, two, three, four, five, six, seven, eight, nine, ten, twenty, thirty, forty, fifty, seventy five, one hundred, two hundred, five hundred or more plates with at least 96 wells each.

Also described herein is a method of linking and barcoding a plurality of non-contiguous polynucleotide sequences of interest, said method comprising: (a) distributing cells into a plurality of containers to obtain isolated one or more cells; (b) amplifying polynucleotide sequences of interest using templates from said isolated one or more cells, wherein said amplification results in the addition of a barcode sequence; and (c) effecting linkage of the polynucleotide sequences of interest amplified in step (b).

In some aspects, the nucleotide sequences of interest comprise antibody heavy and light chains. In some aspects, said amplification comprises an RT-PCR amplification. In some aspects, said RT-PCR amplification is performed in a single step. In some aspects, said linkage of the nucleotide of interest is performed during the course of an RT-PCR amplification using an overlap-extension primer. In some aspects, further comprising (d) adding a sequencing region to the polynucleotide sequences of interest prior to, during, or after barcode sequence addition or linkage. In some aspects, the sequencing region is added with an adaptor. In some aspects, further comprising (e) sequencing of the linked polynucleotide sequences of interest using a NextGen sequencing platform. In some aspects, the NextGen sequencing platform is 454 sequencing. In some aspects, the NextGen sequencing platform is SMRT sequencing. In some aspects, the NextGen sequencing platform is SOLiD sequencing. In some aspects, the NextGen sequencing platform is SOLEXA sequencing. In some aspects, the NextGen sequencing platform is tSMS sequencing. In some aspects, the one or more cells are contained in a plate with at least 6 wells, at least 12 wells, at least 24 wells, at least 48 wells, at least 96 wells, at least 384 wells, at least 1536 wells, or more wells. In some aspects, the one or more cells are contained in at least one, two, three, four, five, six, seven, eight, nine, ten, twenty, thirty, forty, fifty, seventy five, one hundred, or more plates with at least 96 wells each.

Also described herein is a polynucleotide library comprising a plurality of polynucleotides, wherein each polynucleotide comprises the sequence 5'-A-B-C-D-3', wherein A is a sample identification region (barcode sequence), wherein B is a first cDNA region from a single sample, wherein C is a linker region, wherein D is a second cDNA region from the same single sample, and wherein the sequence of the sample identification region of each polynucleotide from a first single sample is distinct from the sequence of the sample identification region of the other polynucleotides in the library from one or more samples distinct from the first single sample.

Also described herein is a polynucleotide library comprising a plurality of polynucleotides, wherein each polynucleotide comprises the sequence 5'-A-B-C-D-3', wherein A is a first cDNA region from a single sample, wherein B is a linker region, wherein C is a second cDNA region from the same single sample, wherein D is a sample identification region (barcode sequence), and wherein the sequence of the sample identification region of each polynucleotide from a first single sample is distinct from the sequence of the sample identification region of the other polynucleotides in the library from one or more samples distinct from the first single sample.

Also described herein is a polynucleotide library comprising a plurality of polynucleotides, wherein each polynucleotide comprises the sequence 5'-A-B-C-3', wherein A is a first cDNA region from a single sample, wherein B is a linker region comprising a sample identification region (barcode sequence), wherein C is a second cDNA region from the same single sample, and wherein the sequence of the sample identification region of each polynucleotide from a first single sample is distinct from the sequence of the sample identification region of the other polynucleotides in the library from one or more samples distinct from the first single sample.

In some aspects, said first cDNA region comprises an antibody heavy chain and said second cDNA region comprises an antibody light chain. In some aspects, the library comprises at least 2, at least 3, at least 10, at least 30, at least 100, at least 300, at least 1000, at least 3000, at least 10,000, at least 30,000, at least 100,000, at least 300,000, at least 1,000,000, at least 3,000,000, at least 10,000,000, at least 30,000,000, or more members. In some aspects, the library comprises at least 2, at least 3, at least 10, at least 30, at least 100, at least 300, at least 1000, at least 3000, at least 10,000, at least 30,000, or more genes of a cell sample's whole transcriptome. In some aspects, the library comprises at least 1, at least 2, at least 3, at least 10, at least 30, at least 100, at least 300, at least 1000, at least 10,000, at least 100,000, at least 1,000,000, at least 10,000,000, at least 100,000,000 or more of the different antibody species present in the blood of an individual. In some aspects, the antibodies are expressed by plasmablasts, plasma cells, memory B cells, long-lived plasma cells, other B lineage cells or combinations thereof.

BRIEF DESCRIPTION OF THE SEVERAL VIEWS OF THE DRAWINGS

These and other features, aspects, and advantages will become better understood with regard to the following description, and accompanying drawings, where:

FIG. 25. Paired antibody heavy chain (HC) and light chain (LC) from an influenza vaccinated human exhibit variation across the complement determining regions (CDRs).

FIG. 27. Recombinant anti-influenza antibodies representative of clonal families bind influenza virus hemaglutinins with picomolar affinities. The recombinant anti-influenza virus antibodies representative of clonal families from the Fluzone-vaccinated human (FIG. 7) that bound influenza vaccine in an ELISA assay (FIG. 26) were tested using a surface plasmon resonance (SPR) instrument (ProteOn System, Bio-Rad Laboratories) to determine their binding affinities for influenza hemagglutinin (both the H3N2 A/Perth/16/2009 and H1N1 A/California/07/2009 strains present in the vaccine). The recombinant anti-influenza virus antibodies were bound to the surface using EDAC-NHS chemistry, and the H3N2 Perth and H1N1 California hemaglutinins were independently tested as the ligands, with hemagglutinin as the analyte. Ka column denotes the on-rates, Kd column the off-rates and $K_D$ the dissociation constant. Multiple recombinant antibodies bound either the H3N2 Perth or the H1N1 California hemagglutinin with picomolar affinities.

FIG. 28. Recombinant anti-influenza antibodies neutralize influenza virus infectivity in microneutralization assays. Six antibodies exhibiting reactivity on the Fluzone ELISA (FIG. 26) were sent to the contract research organization (CRO) Virapur, LLC, (San Diego, Calif.) for testing in a microneutralization assay using the H1N1 California/07/2009 influenza virus strain and the H3N2 A/Perth/16/2009 influenza virus strain, 2 of the three stains of influenza virus in the Fluzone vaccine. 5 out of the 6 recombinant antibodies neutralized influenza virus in the microneutralization assay, preventing infectivity at microgram per milliliter levels and possibly sub-microgram per milliliter concentrations. The recombinant antibody F21 neutralized H3N2 Perth, and although it bound Fluzone in the ELISA assay it did not show binding in the SPR analysis (FIG. 27) likely because the concentrations of the hemagglutinin analyte that were used were too low for binding to be detectable.

FIG. 29. Recombinant anti-*Staph. aureus* antibodies bound to fixed *S. aureus* by flow cytometry. Analysis of the evolutionary tree (FIG. 8) of the heavy and light chain antibody repertoire dataset generated from the human who controlled (without antibiotics) a chronic *Staph. aureus* osteomyelitis (as described in FIG. 7) enabled selection of antibodies representative of the clonal families identified. The heavy and light chains for the selected antibodies representing both clonal families as well as several singlet branches were cloned by PCR and co-transfected into 293T cells (as outlined in FIG. 2), and supernatants collected from transfectants as described in FIG. 24. The recombinant anti-*Staph. aureus* antibodies were then tested for reactivity against fixed *S. aureus*. The secondary antibody used was a FITC-conjugated mouse anti-human IgG, and samples were analyzed on a BD LSR II or LSR Fortessa. The percentage of positive staining is shown, with 2 anti-influenza antibodies used as negative controls. The 2° antibody alone did not result in binding over background, as protein A binds weakly to mouse IgG1, which is the isotype of the 2° antibody. The staining observed above background is due to the binding of the recombinant anti-*Staph. aureus* antibodies to the small percentage of the Wood strain of *S. aureus* that express protein A. (a). Flow cytometry plots are shown for the 2 positive binding anti-*Staph. aureus* antibodies, S6 and S11, along with the isotype-matched negative control anti-influenza antibodies (b). The level of binding of the anti-*Staph. aureus* antibodies to *S. aureus* was proportional to the amount of antibody used. The dark solid line represents an antibody concentration of 10 ug/ml, the dark dotted line 5 ug/ml, and grey dotted line 1 ug/ml (c).

FIG. 30. Anti-*Staph. aureus* antibodies reduced the number of *S. aureus* colony forming units. Recombinant anti-*Staph. aureus* antibodies were incubated with *S. aureus* in combination with baby rabbit serum as a complement source, before being serially diluted and grown overnight on 5% trypticase soy agar (TSA) blood agar plates. Colony forming units (CFUs) were then counted and graphed. Two recombinant anti-*Staph. aureus* antibodies (Ab-a and Ab-b) resulted in killing of the *Staph. aureus* and thus a reduced number of CFU/ml.

FIG. 31. Identification of *S. aureus* antigen targets of recombinant anti-Staph. *aureus* antibodies generated from a human mounting an effective immune response against a chronic *Staph. aureus* infection. A protein lysate was generated from a clinical Staph. *aureus* isolate. Recombinant anti-*Staph. aureus* antibodies representative of clonal families identified in the antibody repertoire from a human mounting an immune response that was preventing progression of a chronic *Staph. aureus* osteomyelitis infection were used to immunoprecipitate proteins from a *Staph. aureus* $Spa^-$ clinical isolate. The immunoprecipitates were separated by SDS-PAGE, identified bands excised, and mass spectrometry (an Agilent XCT-Plus ion trap mass spectrometer) used to identify the immunoprecipiated proteins which are presented in the Figure.

FIG. 32. Generation of anti-lung adenocarcinoma antibodies from a human with metastatic lung adenocarcinoma who was a long-term non-progressor. A human with metastatic lung adenocarcinoma who became a long-term non-progressor following chemotherapy exhibited persistently elevated blood plasmablasts, indicating a persistently activated immune response (FIG. 7). The patient's peripheral blood plasmablasts were sorted, the antibody repertoire sequenced, and antibodies representative of clonal families (FIG. 8) were cloned and expressed recombinantly. One of the expressed recombinant antibodies, which is representative of one of the identified clonal families, bound to an independent lung adenocarcinoma in immunohistochemical stains. Tissue arrays were then used to further characterize the reactivity of this antibody. Tissue arrays containing multiple independent lung adenocarcinomas, squamous cell carcinoma and healthy lung tissue were blocked overnight with 100 ug/ml of F(ab) goat anti-human antibody. Slides were stained with anti-lung adenocarcinoma antibodies or an anti-influenza antibody as a negative control, and visualized with Vector Red. Slides were counterstained with hematoxylin. Hematoxylin blue color was removed using Photoshop so that only nuclei and Vector Red (red) staining shows up as darker grey in the image. This recombinant antibody bound to 4 out of 5 independent lung adenocarcinoma tissue samples tested (contained in tissue arrays), but did not bind to lung squamous cell carcinoma or to healthy lung tissue.

FIG. 33. The identified anti-lung adenocarcinoma antibody (FIG. 32) binds to the surface of a lung adenocarcinoma cell line. The recombinant anti-lung adenocarcinoma antibody (FIG. 32) strongly stained the surface of the lung adenocarcinoma cell line H1650, and exhibited only low-level staining of a kidney epithelial and a lung squamous tumor cell lines. This anti-lung adenocarcinoma antibody did not bind a second lung adenocarcinoma cell line (H2009), consistent with our observation that this antibody bound 4 out of the 5 independent lung adenocarcinoma tissue samples tested by immunohistochemistry (FIG. 32).

FIG. 34. Generation of rheumatoid factor antibodies from rheumatoid arthritis (RA) patients. Recombinant antibodies representative of clonal families identified in the evolutionary trees of antibody repertoires generated from humans with RA (FIG. 8) were selected, cloned and recombinantly expressed. Recombinant antibodies derived from RA patients were used as the primary antibody in a direct ELISA and anti-human IgG-HRP was used as the secondary antibody, and binding visualized with TMB substrate. Recombinant antibodies RA2 and RA3 exhibited reactivity, and thus represent rheumatoid factor antibodies.

DETAILED DESCRIPTION

Figure 1:
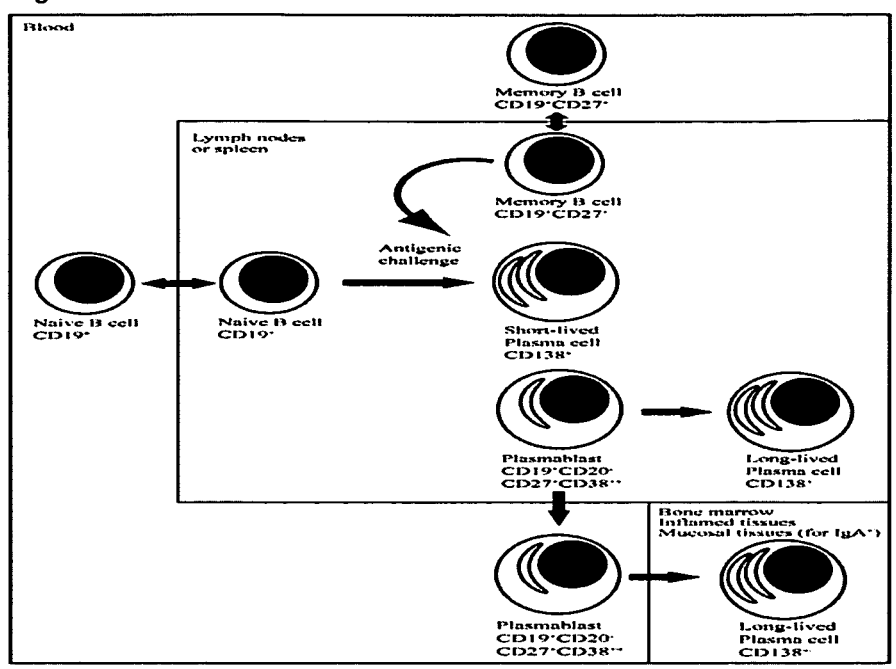
FIG. 1. B cell differentiation. Mature naive B cells are $CD19^+$ and can be activated to proliferate and differentiate upon antigenic challenge in secondary lymphoid tissues such as lymph nodes and spleen. They proliferate and differentiate in either extra-follicular foci or in germinal centers. Differentiating B cells in extrafollicular foci typically differentiate to become short-lived plasma cells and usually reside in the secondary lymphoid tissue they originated from. B cells differentiating in germinal centers can either become memory B cells, which can be further stimulated to differentiate via subsequent antigenic challenge, or become plasmablasts that have the potential to become long-lived plasma cells. These plasmablasts can enter the circulation and are trafficked to the various tissues in which long-lived plasma cells reside, such as the bone marrow, mucosal tissues (for IgA+ plasma cells) and inflamed tissues. Some transiting plasma cells are also present in blood. All of the above mentioned cell types can also be found in circulation in the blood.

Compositions
Polynucleotides

In some aspects, a composition can include a polynucleotide. The term "polynucleotide(s)" refers to nucleic acids such as DNA molecules and RNA molecules and analogs thereof (e.g., DNA or RNA generated using nucleotide analogs or using nucleic acid chemistry). As desired, the polynucleotides may be made synthetically, e.g., using art-recognized nucleic acid chemistry or enzymatically using, e.g., a polymerase, and, if desired, can be modified. Typical modifications include methylation, biotinylation, and other art-known modifications. In addition, a polynucleotide can be single-stranded or double-stranded and, where desired, linked to a detectable. moiety. In some aspects, a polynucleotide can include hybrid molecules, e.g., comprising DNA and RNA.

"G," "C," "A," "T" and "U" each generally stand for a nucleotide that contains guanine, cytosine, adenine, thymidine and uracil as a base, respectively. However, it will be understood that the term "ribonucleotide" or "nucleotide" can also refer to a modified nucleotide or a surrogate replacement moiety. The skilled person is well aware that guanine, cytosine, adenine, and uracil may be replaced by other moieties without substantially altering the base pairing properties of an oligonucleotide comprising a nucleotide bearing such replacement moiety. For example, without limitation, a nucleotide comprising inosine as its base may base pair with nucleotides containing adenine, cytosine, or uracil. Hence, nucleotides containing uracil, guanine, or adenine may be replaced in nucleotide sequences by a nucleotide containing, for example, inosine. In another example, adenine and cytosine anywhere in the oligonucleotide can be replaced with guanine and uracil, respectively to form G-U Wobble base pairing with the target mRNA. Sequences containing such replacement moieties are suitable for the compositions and methods described herein.

As used herein, and unless otherwise indicated, the term "complementary," when used to describe a first nucleotide sequence in relation to a second nucleotide sequence, refers to the ability of a polynucleotide comprising the first nucleotide sequence to hybridize and form a duplex structure under certain conditions with a polynucleotide comprising the second nucleotide sequence, as will be understood by the skilled person. Such conditions can, for example, be stringent conditions, where stringent conditions may include: 400 mM NaCl, 40 mM PIPES pH 6.4, 1 mM EDTA, 50° C. or 70° C. for 12-16 hours followed by washing. Other conditions, such as physiologically relevant conditions as may be encountered inside an organism, can apply. The skilled person will be able to determine the set of conditions most appropriate for a test of complementarity of two sequences in accordance with the ultimate application of the hybridized nucleotides.

Complementary sequences include base-pairing of a region of a polynucleotide comprising a first nucleotide sequence to a region of a polynucleotide comprising a second nucleotide sequence over the length or a portion of the length of one or both nucleotide sequences. Such sequences can be referred to as "complementary" with respect to each other herein. However, where a first sequence is referred to as "substantially complementary" with respect to a second sequence herein, the two sequences can be complementary, or they may include one or more, but generally not more than about 5, 4, 3, or 2 mismatched base pairs within regions that are base-paired. For two sequences with mismatched base pairs, the sequences will be considered "substantially complementary" as long as the two nucleotide sequences bind to each other via base-pairing.

"Complementary" sequences, as used herein, may also include, or be formed entirely from, non-Watson-Crick base pairs and/or base pairs formed from non-natural and modified nucleotides, in as far as the above embodiments with respect to their ability to hybridize are fulfilled. Such non-Watson-Crick base pairs includes, but are not limited to, G:U Wobble or Hoogstein base pairing.

The term percent "identity," in the context of two or more nucleic acid or polypeptide sequences, refer to two or more sequences or subsequences that have a specified percentage of nucleotides or amino acid residues that are the same, when compared and aligned for maximum correspondence, as measured using one of the sequence comparison algorithms described below (e.g., BLASTP and BLASTN or other algorithms available to persons of skill) or by visual inspection. Depending on the application, the percent "identity" can exist over a region of the sequence being compared, e.g., over a functional domain, or, alternatively, exist over the full length of the two sequences to be compared.

For sequence comparison, typically one sequence acts as a reference sequence to which test sequences are compared. When using a sequence comparison algorithm, test and reference sequences are input into a computer, subsequence coordinates are designated, if necessary, and sequence algorithm program parameters are designated. The sequence comparison algorithm then calculates the percent sequence identity for the test sequence(s) relative to the reference sequence, based on the designated program parameters.

Optimal alignment of sequences for comparison can be conducted, e.g., by the local homology algorithm of Smith & Waterman, Adv. Appl. Math. 2:482 (1981), by the homology alignment algorithm of Needleman & Wunsch, J. Mol. Biol. 48:443 (1970), by the search for similarity method of Pearson & Lipman, Proc. Nat'l. Acad. Sci. USA 85:2444 (1988), by computerized implementations of these algorithms (GAP, BESTFIT, FASTA, and TFASTA in the Wisconsin Genetics Software Package, Genetics Computer Group, 575 Science Dr., Madison, Wis.), or by visual inspection (see generally Ausubel et al., infra).

One example of an algorithm that is suitable for determining percent sequence identity and sequence similarity is the BLAST algorithm, which is described in Altschul et al., J. Mol. Biol. 215:403-410 (1990). Software for performing BLAST analyses is publicly available through the National Center for Biotechnology Information web-site.

Identical sequences include 100% identity of a polynucleotide comprising a first nucleotide sequence to a polynucleotide comprising a second nucleotide sequence over the entire length of one or both nucleotide sequences. Such sequences can be referred to as "fully identical" with respect to each other herein. However, in some aspects, where a first sequence is referred to as "substantially identical" with respect to a second sequence herein, the two sequences can be fully complementary, or they may have one or more, but generally not more than about 5, 4, 3, or 2 mismatched nucleotides upon alignment. In some aspects, where a first sequence is referred to as "substantially identical" with respect to a second sequence herein, the two sequences can be fully complementary, or they may be about 50, 60, 70, 80, 81, 82, 83, 84, 85, 86, 87, 88, 89, 90, 91, 92, 93, 94, 95, 96, 97, 98, or 99% identical to each other.

Where a first sequence is referred to as "distinct" with respect to the identity of a second sequence herein, the two sequences have at least one or more mismatched nucleotides upon alignment. In some aspects, distinct sequences can have 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more mismatched nucleotides upon alignment. In some aspects, distinct sequences can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 81, 82, 83, 84, 85, 86, 87, 88, 89, 90, 91, 92, 93, 94, 95, 96, 97, 98, 99, or less than 100% identical to each other. In some aspects, where a first sequence is referred to as "distinct" with respect to a second sequence herein, the two sequences can have substantially or fully identical sequences, but instead differ from one another based upon differing patterns of modification within the sequences. Such modifications are generally known in the art, e.g., methylation.

In some aspects, a polynucleotide can be present in a library of polynucleotides. In some aspects, a polynucleotide library can include a plurality of polynucleotides. In some aspects, each polynucleotide in the plurality of polynucleotides can be derived from a single sample. In some aspects, a single sample can include a single cell such as a B cell.

Conventional notation is used herein to describe nucleotide sequences: the left-hand end of a single-stranded nucleotide sequence is the 5'-end; the left-hand direction of a double-stranded nucleotide sequence is referred to as the 5'-direction. The direction of 5' to 3' addition of nucleotides to nascent RNA transcripts is referred to as the transcription direction. The DNA strand having the same sequence as an mRNA is referred to as the "coding strand;" sequences on the DNA strand having the same sequence as an mRNA transcribed from that DNA and which are located 5' to the 5'-end of the RNA transcript are referred to as "upstream sequences;" sequences on the DNA strand having the same sequence as the RNA and which are 3' to the 3' end of the coding RNA transcript are referred to as "downstream sequences."

The term "messenger RNA" or "mRNA" refers to an RNA that is without introns and that can be translated into a polypeptide.

The term "cDNA" refers to a DNA that is complementary or identical to an mRNA, in either single stranded or double stranded form.

The term "amplicon" refers to the amplified product of a nucleic acid amplification reaction, e.g., RT-PCR.

The term "hybridize" refers to a sequence specific non-covalent binding interaction with a complementary nucleic acid. Hybridization may occur to all or a portion of a nucleic acid sequence. Those skilled in the art will recognize that the stability of a nucleic acid duplex, or hybrids, can be determined by the Tm. Additional guidance regarding hybridization conditions may be found in: Current Protocols in Molecular Biology, John Wiley & Sons, N.Y., 1989, 6.3.1-6.3.6 and in: Sambrook et al., Molecular Cloning, a Laboratory Manual, Cold Spring Harbor Laboratory Press, 1989, Vol. 3.

As used herein, "region" refers to a contiguous portion of the nucleotide sequence of a polynucleotide. Examples of regions are described herein an include identification regions, sample identification regions, plate identification regions, adapter regions, and the like. In some aspects, a polynucleotide can include one or more regions. In some aspects, a polynucleotide can include less than 2, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more regions. In some aspects, regions can be coupled. In some aspects, regions can be operatively coupled. In some aspects, regions can be physically coupled.

As used herein, "variable region" refers to a variable nucleotide sequence that arises from a recombination event, for example, it can include a V, J, and/or D region of an immunoglobulin or T cell receptor sequence isolated from a T cell or B cell of interest, such as an activated T cell or an activated B cell.

As used herein "B cell variable immunoglobulin region" refers to a variable immunoglobulin nucleotide sequence isolated from a B cell. For example, a variable immunoglobulin sequence can include a V, J, and/or D region of an immunoglobulin sequence isolated from a B cell of interest such as a memory B cell, an activated B cell, or plasmablast.

As used herein "identification region" refers to a nucleotide sequence label (e.g., a unique barcode sequence) that can be coupled to at least one nucleotide sequence for, e.g., later identification of the at least one nucleotide sequence.

As used herein "immunoglobulin region" refers to a contiguous portion of nucleotide sequence from one or both chains (heavy and light) of an antibody.

As used herein "adapter region" refers to a linker that couples a first nucleotide sequence to a second nucleotide sequence. In some aspects, an adapter region can include a contiguous portion of nucleotide sequence that acts as a linker. For example, an adapter region can have the sequence GGG and couples a first sequence to a second sequence via binding between GGG and CCC.

In some aspects, a polynucleotide can include a cDNA region. In some aspects, a polynucleotide can include a sample identification-adapter region. In some aspects, a polynucleotide can include a sample identification region. In some aspects, a polynucleotide can include an adapter region. In some aspects, a polynucleotide can include a universal primer region. In some aspects, a polynucleotide can include an amplicon region. In some aspects, a polynucleotide can include a plate identification region. In some aspects, a polynucleotide can include a first plate identification region. In some aspects, a polynucleotide can include a second plate identification region. In some aspects, a polynucleotide can include a restriction site region. In some aspects, a polynucleotide can include a first restriction site region. In some aspects, a polynucleotide can include a second restriction site region. In some aspects, a polynucleotide can include a sequencing region. In some aspects, a polynucleotide can include a first sequencing region. In some aspects, a polynucleotide can include a second sequencing region.

In some aspects, a polynucleotide can include a plurality of any region described herein. For example, a polynucleotide can include a first sample identification region and a second sample identification region. In some aspects, the first sample identification region and the second sample identification region are identical or substantially identical. In some aspects, the first sample identification region and the second sample identification region are distinct. In some aspects, an identification region is coupled to a variable immunoglobulin region.

In some aspects the sequence of a region will be at least long enough to serve as a target sequence for a primer or a probe in a PCR reaction. In some aspects, a region can be 1 to greater than 5000 base pairs in length. For example, a region can be from 1-10,000 nucleotides in length, e.g., 2-30 nucleotides in length, including all sub-ranges therebetween. As non-limiting examples, a region can be from 1-30 nucleotides, 1-26 nucleotides, 1-23 nucleotides, 1-22 nucleotides, 1-21 nucleotides, 1-20 nucleotides, 1-19 nucleotides, 1-18 nucleotides, 1-17 nucleotides, 18-30 nucleotides, 18-26 nucleotides, 18-23 nucleotides, 18-22 nucleotides, 18-21 nucleotides, 18-20 nucleotides, 19-30 nucleotides, 19-26 nucleotides, 19-23 nucleotides, 19-22 nucleotides, 19-21 nucleotides, 19-20 nucleotides, 20-30 nucleotides, 20-26 nucleotides, 20-25 nucleotides, 20-24 nucleotides, 20-23 nucleotides, 20-22 nucleotides, 20-21 nucleotides, 21-30 nucleotides, 21-26 nucleotides, 21-25 nucleotides, 21-24 nucleotides, 21-23 nucleotides, or 21-22 nucleotides. In some aspects, a region can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, or more nucleotides in length. In some aspects, a region can be less than 50, 50-100, 100-200, 200-300, 300-400, 400-500, 500-600, 600-700, 700-800, 800-900, 900-1000, or greater than 1000 nucleotides in length. In some aspects, a region can be less than 1000, 1000-2000, 2000-3000, 3000-4000, 4000-5000, 5000-6000, 6000-7000, 7000-8000, 8000-9000, 9000-10000, or greater than 10000 nucleotides in length. In some aspects, a region can include at least two nucleotides, at least 3, at least 4, at least 5, at least 6, at least 7, at least 8, at least 9, at least 10, at least 15, at least 20 or more nucleotides of a polynucleotide disclosed herein.

The term "sample" can include RNA, DNA, a single cell or multiple cells or fragments of cells or an aliquot of body fluid, taken from a subject (e.g., a mammalian subject, an animal subject, a human subject, or a non-human animal subject). Samples can be selected by one of skill in the art using any means now known or later discovered including centrifugation, venipuncture, blood draw, excretion, swabbing, ejaculation, massage, biopsy, needle aspirate, lavage sample, scraping, surgical incision, laser capture microdissection, gradient separation, or intervention or other means known in the art. Samples can also be selected by one of skill in the art using one or more markers known to be associated with a sample of interest. Samples can also be selected using methods known in the art such as cell sorting and FACS. Further examples of sample selection methods are described in the Examples section below.

In some aspects a polynucleotide can be derived from or associated with a single sample. In some aspects a region can be derived from or associated with a single sample. In some aspects, a cDNA region can be derived from or associated with a single sample. In some aspects, an amplicon region can be derived from or associated with a single sample. A "single sample" includes a sample comprising polynucleotides that is taken from a single source. In some aspects, a single source includes a sample taken at a particular time point or at a particular location, e.g., in a subject or flask of cells or plate of cells. In some aspects, a first single sample is taken from a first subject at a first time point and a second single sample is taken from the first subject at a second time point that is distinct from the first time point. In some aspects, a first single sample is taken from a first subject at a first location and a second sample is taken from the first subject at a second location that is distinct from the first location. In some aspects, a first single sample is taken from a first subject at a time point and a second single sample is taken from a second subject at a time point. In some aspects, a first single sample is taken from a first subject at a location and a second sample is taken from a second subject at a location. In one embodiment, a sample comprises polynucleotides that include mRNA derived from one or more B cells. In another embodiment, a sample comprises polynucleotides including cDNA derived from one or more B cells. In another embodiment, a single sample comprises mRNA derived from one or more B cells sorted into a single well of a 96-well or 384-well plate. Samples are generally derived from a prokaryotic cell(s) (e.g., a bacterial cell(s)), a eukaryotic cell(s) (e.g., a mammalian and yeast cell(s)), or other sources of genetic material such as a virus or phage. The term "mammal" or "mammalian" as used herein includes both humans and non-humans and include but is not limited to humans, non-human primates, canines, felines, murines, bovines, equines, and porcines. In some aspects, the methods of the invention are applied to single samples in a plate with at least 96 wells, at least 384 wells, at least 1536 wells, or more wells. In further aspects, the methods of the invention are applied to single samples in at least one, two, three, four, five, six, seven, eight, ten, fifteen, twenty, thirty or more plates with at least 96 wells each.

In some aspects a 5' adaptor region sequence and/or a sample identification region are added to all cDNAs from a single sample, e.g., during RT and not just to Ig genes. In some aspects, 3' gene specific primers (GSPs) can be used to amplify any expressed gene in the single sample. In some aspects, genes are amplified that have a 5' variable region, e.g., T cell receptors and B cell receptors without needing multiple degenerate 5' primers to amplify the gene(s) of interest. GSPs can include primers specific for IgG, IgM, IgD, IgA, IgE, TCR chains, and other genes of interest.

In some aspects, multiple rounds of PCR can also be performed, e.g., using nested GSPs. For such nested GSPs, the GSP for the second round of PCR hybridizes to its target gene sequence at a position 5' along that sequence relative to the position hybridized to by the GSP used in the first round of PCR.

In some aspects, cDNA region or an amplicon region can include a DNA polynucleotide. In some aspects, cDNA region or an amplicon region can include a cDNA polynucleotide. In some aspects, cDNA region or an amplicon region can include an RNA polynucleotide hybridized to a DNA polynucleotide. In some aspects, cDNA region or an amplicon region can include an mRNA polynucleotide hybridized to a cDNA polynucleotide.

In some aspects, a universal primer region is not fully complementary to any human exon. In some aspects, a universal primer region is not fully complementary to any expressed human gene. In some aspects, a universal primer region has minimal secondary structure.

In some aspects, an amplicon region comprises an immunoglobulin heavy chain amplicon sequence. In some aspects, an amplicon region comprises an immunoglobulin light. chain amplicon sequence. In some aspects, an amplicon region comprises a T cell receptor alpha amplicon sequence. In some aspects, an amplicon region comprises a T cell receptor beta amplicon sequence.

In some aspects, a polynucleotide is present in a library of polynucleotides and can be differentiated from other polynucleotides present in the library based on a region of the polynucleotide.

In some aspects, the sequence of the sample identification region of each polynucleotide in a library derived from a first single sample is distinct from the sequence of the sample identification region of the other polynucleotides in the library derived from one or more samples distinct from the first single sample. In some aspects, the sequence of the sample identification region of each polynucleotide in a library derived from a first single sample differs by at least 1 nucleotide from the sequence of the sample identification region of the other polynucleotides in the library derived from one or more samples distinct from the first single sample. In some aspects, the sequence of the sample identification region of each polynucleotide in a library derived from a first single sample differs by at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more nucleotides from the sequence of the sample identification region of the other polynucleotides in the library derived from one or more samples distinct from the first single sample. In some aspects, the sequence of the sample identification region of each polynucleotide in a library derived from a first single sample can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 81, 82, 83, 84, 85, 86, 87, 88, 89, 90, 91, 92, 93, 94, 95, 96, 97, 98, 99, or less than 100% identical to the sequence of the sample identification region of the other polynucleotides in the library derived from one or more samples distinct from the first single sample. In some aspects, the sequence of the sample identification region of each polynucleotide in a library derived from a first single sample is less than 100% identical to the sequence of the sample identification region of the other polynucleotides in the library derived from one or more samples distinct from the first single sample. In some aspects, a sample-identification region acts as a digital barcode on all $1^{st}$ strand cDNA reverse transcribed from a single sample. In some aspects, the sample identification region is at least 1 nucleotide in length. In some aspects, a sample-identification region can comprise at least 3 nucleotides, and sample-identification regions can differ from each other by at least 1. nucleotide. In one embodiment, sample-identification regions are 3-15 nucleotides in length and differ from each other by at least 1 nucleotide. In some aspects, sample-identification regions can comprise at least 64 variants (using sample-identification regions 3 nucleotides in length with each sample-ID differing from each other by at least 1 nucleotide), or in some aspects larger numbers of variants. In some aspects, the sequence attached 3' to the sample-identification region can be an adapter region comprising at least 1 G. In a preferred embodiment, the sequence attached 3' to the sample-identification region can be an adapter region comprising at least 2 G's. In one embodiment, a sequence attached to the 5' end of a sample-identification region is a universal primer sequence that can be used during PCR amplification to avoid the need for the subsequent addition of a 5' universal primer sequence (by ligation or another method) or the use of multiple degenerate 5' primers to amplify genes with variable 5' regions. Examples of sample identification regions are shown in Tables 2 and 8.

In some aspects, the sequence of the first plate identification region of each polynucleotide in a library derived from a first set of single samples is distinct from the sequence of the first plate identification region of the other polynucleotides in the library derived from one or more single sample sets distinct from the first set of single samples. In some aspects, the sequence of the first plate identification region of each polynucleotide in a library derived from the first set of single samples differs by at least 1 nucleotide from the sequence of the first plate identification region of the other polynucleotides in the library derived from one or more single sample sets distinct from the first set of single samples. In some aspects, the sequence of the first plate identification region of each polynucleotide in a library derived from the first set of single samples differs by at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more nucleotides from the sequence of the first plate identification region of the other polynucleotides in the library derived from one or more single sample sets distinct from the first set of single samples. In some aspects, the sequence of the first plate identification region of each polynucleotide in a library derived from the first set of single samples can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 81, 82, 83, 84, 85, 86, 87, 88, 89, 90, 91, 92, 93, 94, 95, 96, 97, 98, 99, or less than 100% identical to sequence of the first plate identification region of the other polynucleotides in the library derived from one or more single sample sets distinct from the first set of single samples. In some aspects, the sequence of the first plate identification region of each polynucleotide in a library derived from the first set of single samples is less than 100% identical to sequence of the first plate identification region of the other polynucleotides in the library derived from one or more single sample sets distinct from the first set of single samples. Examples of first plate identification regions are shown in Tables 3 and 7.

In some aspects, the sequence of the second plate identification region of each polynucleotide in a library derived from a first set of single samples is distinct from the sequence of the second plate identification region of the other polynucleotides in the library derived from one or more single sample sets distinct from the first set of single samples. In some aspects, the sequence of the second plate identification region of each polynucleotide in a library derived from the first set of single samples differs by at least 1 nucleotide from the sequence of the second plate identification region of the other polynucleotides in the library derived from one or more single sample sets distinct from the first set of single samples. In some aspects, the sequence of the second plate identification region of each polynucleotide in a library derived from the first set of single samples differs by at least 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50 or more nucleotides from the sequence of the second plate identification region of the other polynucleotides in the library derived from one or more single sample sets distinct from the first set of single samples. In some aspects, the sequence of the second plate identification region is identical to the sequence of the first plate identification region on a polynucleotide. In some aspects, the sequence of the second plate identification region of each polynucleotide in a library derived from the first set of single samples can be about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 81, 82, 83, 84, 85, 86, 87, 88, 89, 90, 91, 92, 93, 94, 95, 96, 97, 98, 99, or less than 100% identical to sequence of the second plate identification region of the other polynucleotides in the library derived from one or more single sample sets distinct from the first set of single samples. In some aspects, the sequence of the second plate identification region of each polynucleotide in a library derived from the first set of single samples is less than 100% identical to sequence of the second plate identification region of the other polynucleotides in the library derived from one or more single sample sets distinct from the first set of single samples. Examples of second plate identification regions are shown in Tables 3 and 7.

In some aspects, a plate-identification region (e.g., a first plate identification region or a second plate identification region) can comprise at least 2 nucleotides, and plate-identification regions differ from each other by at least 1 nucleotide. In one embodiment, plate-identification regions are 2-10 nucleotides in length and differ from each other by at least 1 nucleotide. In some aspects, use of plate-identification regions is found in only some embodiments, as the use of a larger number of different sample-identification regions (one per single sample to be analyzed) can eliminate the need for plate-identification regions. In some aspects, plate-identification regions are used to reduce the number of unique oligonucleotides containing a sample-identification region that need to be synthesized.

In some aspects, a polynucleotide includes one or more adapter regions. In some aspects, an adapter region includes one or more G's. In some aspects, an adapter region includes 2, 3, 4, 5, 6, 7, 8, 9, 10 or more G's. In some aspects, adapter regions are attached to the 3' ends of cDNAs using the template switching property of MMLV H⁻ reverse transcriptases. Different methods to attach adaptor regions exist, including but not limited to, doing PCR with primers with 5' flanking adaptor region sequences, sticky and blunt end ligations, template-switching-mediated addition of nucleotides, or other methods to covalently attach nucleotides to the 5' end, to the 3' end, or to the 5' and 3' ends of the polynucleotides. These methods can employ properties of enzymes commonly used in molecular biology. PCR can use, e.g., thermophilic DNA polymerase. Sticky ends that are complementary or substantially complementary are created through either cutting dsDNA with restriction enzymes that leave overhanging ends or through 3' tailing activities of enzymes such as TdT (terminal transferase). Sticky and blunt ends can then be ligated with a complementary adaptor region using ligases such as T4 ligase. Template-switching region utilizes the 3' tailing activity of MMLV H⁻ reverse transcriptase to add one or more cytosines (C's) to the 3' end of cDNAs and its ability to switch template from mRNA to an adaptor region with complementary G's. In some aspects, a cDNA includes 1, 2, 3, 4, 5, 6, 7, 8, 9, 10 or more C's on its 3' end.

In some aspects, a polynucleotide includes one or more restriction site regions. Restriction site regions include one or more restriction sites. Restrictions sites can include: NheI, XhoI, BstBI, EcoRI, SacII, BbvCI, PspXI, AgeI, ApaI, KpnI, Acc65I, XmaI, BstEII, DraIII, PacI, FseI, AsiSI, and AscI. In some aspects, any rare 8-cutter enzyme restriction site can be used.

In some aspects, one or more regions of a polynucleotide described herein can be operatively coupled to one or more other regions of the polynucleotide. In some aspects, two or more distinct regions of a single polynucleotide can be operatively coupled. For example, a universal primer region can be operatively coupled to an adapter region. In some aspects two or more regions can be operatively coupled together that are substantially identical to each other in sequence or identical in description. For example, a first sample identification region can be operatively coupled to a second sample identification region. In some aspects, the sequences of the first sample identification region and the second sample identification region are identical or substantially identical. In some aspects, the sequences of the first sample identification region and the second sample identification region are different or distinct.

In some aspects, one or more regions of a polynucleotide described herein can be coupled to one or more other regions of the polynucleotide. In some aspects, two or more distinct regions of a single polynucleotide can be coupled. For example, a universal primer region can be coupled to an adapter region. In some aspects two or more regions can be coupled together that are substantially identical to each other in sequence or identical in description. For example, a first sample identification region can be coupled to a second sample identification region. In some aspects, the sequences of the first sample identification region and the second sample identification region are identical or substantially identical. In some aspects, the sequences of the first sample identification region and the second sample identification region are different or distinct.

In some aspects, a polynucleotide includes the sequence 5'-A-B-3', wherein A is a sample identification region, and wherein B is an adapter region. In some aspects, a polynucleotide includes the sequence 5'-A-B-C-3', wherein A is a universal primer region, wherein B is a sample identification region, and wherein C is an adapter region. In some aspects, a polynucleotide includes the sequence 5'-A-B-C-3', wherein A is a sample identification region, wherein B is an adapter region, and wherein C is an amplicon region derived from a single sample. In some aspects, a polynucleotide includes the sequence 5'-A-B-C-D-3', wherein A is a universal primer region, wherein B is a sample identification region, wherein C is an adapter region, and wherein D is an amplicon region derived from a single sample. In some aspects, a polynucleotide includes the sequence 5'-A-B-C-D-E-3', wherein A is a plate identification region, wherein B is a universal primer region, wherein C is a sample identification region, wherein D is an adapter region, and wherein E is an amplicon region derived from a single sample. In some aspects, a polynucleotide includes the sequence 5'-A-B-C-D-E-F-3', wherein A is a first restriction site region, wherein B is a universal primer region, wherein C is a sample identification region, wherein D is an adapter region, wherein E is an amplicon region derived from a single sample, and wherein F is a second restriction site region.

In some aspects, the regions of each of the above sequences can be rearranged in a different order, e.g., 5'-C-A-D-B-3' or 5'-E-A-C-B-D-F-3' or 5'-B-A-3'. In some aspects, one or more regions of the above sequences can be deleted, e.g., 5'-A-D-3' or 5'-B-C-3'. In some aspects, one or more additional regions can be added to the above sequences, e.g., 5'-A-$A_2$-B-3' or 5'-A-B-C-D-E-F-G-3'. In such examples the one or more additional regions can be any region disclosed herein or equivalents thereof. In some aspects, one or more regions of the sequences above can be modified, e.g., methylated.

In some aspects, a polynucleotide can include an adapter molecule. In some aspects, a polynucleotide adapter molecule can include a universal primer region, a sample identification region, and an adapter region, wherein the 3' end of the universal primer region is coupled to the 5' end of the sample identification region, and wherein the 3' end of the sample identification region is coupled to the 5' end of the adapter region. In some aspects, an adapter molecule includes a polynucleotide comprising at least 2 nucleotides that bind to C's added by a reverse transcriptase at the 3' end of a 1st strand cDNA. In some aspects, an adapter molecule includes a deoxyribose polynucleotide comprising 3-6 G's (DNA G's). In another embodiment, an adapter molecule includes a ribose polynucleotide consisting of 3-6 G's (RNA G's). In other embodiments, the adapter molecule can utilize nucleotide analogues, such locked nucleic acids (LNAs), e.g., LNA G's. In other embodiments, the nucleotide base may also be a universal or degenerate base such as 5-nitroindole and 3-nitropyrrole that can base-pair to C's as well as other nucleotides, in any combination.

In some aspects, a polynucleotide can include a primer or a probe. In some aspects, a primer can include a universal primer region and a plate identification region, and wherein the 3' end of the plate identification region is coupled to the 5' end of the universal primer region.

In some aspects, a composition can include a polynucleotide composition library. In some aspects, a polynucleotide composition library includes a plurality of polynucleotide compositions. In some aspects each composition is present in a separate container. In some aspects, a container can be a test tube. In some aspects, a container can be a well in a plate. In some aspects, a container can be a well in a 96-well plate. In some aspects, a container can be a well in a 384-well plate. In some aspects, each composition comprises a cDNA region derived from a single sample. In some aspects, each composition comprises a sample identification-adapter region comprising a sample identification region coupled to an adapter region. In some aspects the sequence of the sample identification region of each sample identification-adapter region in a library is distinct from the nucleotide sequence of the sample identification region of the other sample identification-adapter regions present in each separate container in the library. In some aspects the sample identification-adapter region is attached to the cDNA region. In some aspects the sample identification-adapter region is attached to the cDNA region by binding between their 3' regions. In some aspects the sample identification-adapter region is attached to the cDNA region by G:C binding. In some aspects, the cDNA region comprises an RNA polynucleotide hybridized to a DNA polynucleotide. In some aspects, the cDNA region comprises an mRNA polynucleotide hybridized to a cDNA polynucleotide.

In some aspects, the plurality of polynucleotide compositions in a polynucleotide library can comprise at least 2, at least 3, at least 10, at least 30, at least 100, at least 300, at least 1000, at least 3000, at least 10,000, at least 30,000, at least 100,000, at least 300,000, at least 1,000,000, at least 3,000,000, at least 10,000,000, at least 30,000,000, or more members. In other aspects, the plurality of polynucleotide compositions in a polynucleotide library can comprise at least 2, at least 3, at least 10, at least 30, at least 100, at least 300, at least 1000, at least 3000, at least 10,000, at least 30,000, or more genes of a cell sample's whole transcriptome. In other aspects, the plurality of polynucleotide compositions in a polynucleotide library comprises at least 1, at least 2, at least 3, at least 10, at least 30, at least 100, at least 300, at least 1000, at least 10,000, at least 100,000, at least 1,000,000, at least 10,000,000, at least 1,000,000,000 or more of the different antibody species present in the blood of an individual. These the antibody species can be expressed by plasmablasts, plasma cells, memory B cells, long-lived plasma cells, naïve B cells, other B lineage cells, or combinations thereof Vectors In some aspects, a composition can include a vector. Vectors can be used in the transformation of a host cell with a nucleic acid sequence. In some aspects, a vector can include one or more polynucleotides described herein. In one embodiment, a library of nucleic acid sequences encoding target polypeptides may be introduced into a population of cells, thereby allowing screening of a library. The term "vector" is used to refer to a carrier nucleic acid molecule into which a nucleic acid sequence can be inserted for introduction into a cell where it can be replicated. A nucleic acid sequence can be "exogenous" or "heterologous" which means that it is foreign to the cell into which the vector is being introduced or that the sequence is homologous to a sequence in the cell but in a position within the host cell nucleic acid in which the sequence is ordinarily not found. Vectors include plasmids, cosmids, and viruses (e.g., bacteriophage). One of skill in the art may construct a vector through standard recombinant techniques, which are described in Maniatis et al., 1988 and Ausubel et al., 1994, both of which references are incorporated herein by reference. In some aspects, a vector can be a vector with the constant regions of an antibody pre-engineered in. In this way, one of skill can clone just the VDJ regions of an antibody of interest and clone those regions into the pre-engineered vector.

The term "expression vector" refers to a vector containing a nucleic acid sequence coding for at least part of a gene product capable of being transcribed. In some cases, RNA molecules are then translated into a protein, polypeptide, or peptide. Expression vectors can contain a variety of "control sequences," which refer to nucleic acid sequences for the transcription and possibly translation of an operably linked coding sequence in a particular host organism. In addition to control sequences that govern transcription and translation, vectors and expression vectors may contain nucleic acid sequences that serve other functions as well.

In some aspects, a vector can include a promoter. In some aspects, a vector can include an enhancer. A "promoter" is a control sequence that is a region of a nucleic acid sequence at which initiation and rate of transcription are controlled. It may contain genetic elements at which regulatory proteins and molecules may bind such as RNA polymerase and other transcription factors. The phrases "operatively positioned," "operatively linked," "under control," and "under transcriptional control" mean that a promoter is in a correct functional location and/or orientation in relation to a nucleic acid sequence to control transcriptional initiation and/or expression of that sequence. A promoter may or may not be used in conjunction with an "enhancer," which refers to a cis-acting regulatory sequence involved in the transcriptional activation of a nucleic acid sequence.

A promoter may be one naturally associated with a gene or sequence, as may be obtained by isolating the 5' non-coding sequences located upstream of the coding segment and/or exon. Such a promoter can be referred to as "endogenous." Similarly, an enhancer may be one naturally associated with a nucleic acid sequence, located either downstream or upstream of that sequence. Alternatively, certain advantages will be gained by positioning the coding nucleic acid segment under the control of a recombinant or heterologous promoter, which refers to a promoter that is not normally associated with a nucleic acid sequence in its natural environment. A recombinant or heterologous enhancer refers also to an enhancer not normally associated with a nucleic acid sequence in its natural environment. Such promoters or enhancers may include promoters or enhancers of other genes, and promoters or enhancers isolated from any other prokaryotic cell, and promoters or enhancers not "naturally occurring," i.e., containing different elements of different transcriptional regulatory regions, and/or mutations that alter expression. In addition to producing nucleic acid sequences of promoters and enhancers synthetically, sequences may be produced using recombinant cloning and/or nucleic acid amplification technology, including PCR, in connection with the compositions disclosed herein (see U.S. Pat. Nos. 4,683,202, 5,928,906, each incorporated herein by reference).

In some aspects, a promoter and/or enhancer that effectively directs the expression of the DNA segment in the cell type chosen for expression. One example of such promoter that may be used is the *E. coli* arabinose or T7 promoter. Those of skill in the art of molecular biology generally are familiar with the use of promoters, enhancers, and cell type combinations for protein expression, for example, see Sambrook et al. (1989), incorporated herein by reference. The promoters employed may be constitutive, tissue-specific, inducible, and/or useful under the appropriate conditions to direct high level expression of the introduced DNA segment, such as is advantageous in the large-scale production of recombinant proteins and/or peptides. The promoter may be heterologous or endogenous.

In some aspects, vectors can include initiation signals and/or internal ribosome binding sites. A specific initiation signal also may be included for efficient translation of coding sequences. These signals include the ATG initiation codon or adjacent sequences. Exogenous translational control signals, including the ATG initiation codon, may need to be provided. One of ordinary skill in the art would readily be capable of determining this and providing the necessary signals. It is well known that the initiation codon must be "in-frame" with the reading frame of the desired coding sequence to ensure translation of the entire insert. The exogenous translational control signals and initiation codons can be either natural or synthetic. The efficiency of expression may be enhanced by the inclusion of appropriate transcription enhancer elements.

In some aspects, a vector can include sequences that increase or optimize the expression level of the DNA segment encoding the gene of interest. An example of such sequences includes addition of introns in the expressed mRNA (Brinster, R. L. et al. (1988) Introns increase transcriptional efficiency in transgenic mice. Proc. Natl. Acad. Sci. USA 85, 836-40; Choi, T. et al. (1991) A generic intron increases gene expression in transgenic mice. Mol. Cell. Biol. 11, 3070-4). Another example of a method for optimizing expression of the DNA segment is "codon optimization". Codon optimization involves insertion of silent mutations in the DNA segment to reduce the use of rare codons to optimize protein translation (Codon engineering for improved antibody expression in mammalian cells. Carton J M, Sauerwald T, Hawley-Nelson P, Morse B, Peffer N, Beck H, Lu J, Cotty A, Amegadzie B, Sweet R. Protein Expr Purif. 2007 October; 55(2):279-86. Epub 2007 Jun. 16.).

In some aspects, a vector can include multiple cloning sites. Vectors can include a multiple cloning site (MCS), which is a nucleic acid region that contains multiple restriction enzyme sites, any of which can be used in conjunction with standard recombinant technology to digest the vector (see Carbonelli et al., 1999, Levenson et al., 1998, and Cocea, 1997, incorporated herein by reference.) "Restriction enzyme digestion" refers to catalytic cleavage of a nucleic acid molecule with an enzyme that functions only at specific locations in a nucleic acid molecule. Many of these restriction enzymes are commercially available. Use of such enzymes is understood by those of skill in the art. Frequently, a vector is linearized or fragmented using a restriction enzyme that cuts within the MCS to enable exogenous sequences to be ligated to the vector. "Ligation" refers to the process of forming phosphodiester bonds between two nucleic acid fragments, which may or may not be contiguous with each other. Techniques involving restriction enzymes and ligation reactions are well known to those of skill in the art of recombinant technology.

In some aspects, a vector can include a termination signal. The vectors or constructs will generally comprise at least one termination signal. A "termination signal" or "terminator" is comprised of the DNA sequences involved in specific termination of an RNA transcript by an RNA polymerase. Thus, in certain embodiments, a termination signal that ends the production of an RNA transcript is contemplated. A terminator may be necessary in vivo to achieve desirable message levels.

Terminators contemplated for use include any known terminator of transcription described herein or known to one of ordinary skill in the art, including but not limited to, for example, rho dependent or rho independent terminators. In certain embodiments, the termination signal may be a lack of transcribable or translatable sequence, such as due to a sequence truncation.

In some aspects, a vector can include an origin of replication.

In order to propagate a vector in a host cell, it may contain one or more origins of replication sites (often termed "ori"), which is a specific nucleic acid sequence at which replication is initiated.

In some aspects, a vector can include one or more selectable and/or screenable markers. In certain embodiments, cells containing a nucleic acid construct may be identified in vitro or in vivo by including a marker in the expression vector. Such markers would confer an identifiable change to the cell permitting easy identification of cells containing the expression vector. Generally, a selectable marker is one that confers a property that allows for selection. A positive selectable marker is one in which the presence of the marker allows for its selection, while a negative selectable marker is one in which its presence prevents its selection. An example of a positive selectable marker is a drug resistance marker.

Usually the inclusion of a drug selection marker aids in the cloning and identification of transformants, for example, genes that confer resistance to neomycin, puromycin, hygromycin, DHFR, GPT, zeocin and histidinol are useful selectable markers. In addition to markers conferring a phenotype that allows for the discrimination of transformants based on the implementation of conditions, other types of markers including screenable markers such as GFP, whose basis is colorimetric analysis, are also contemplated. Alternatively, screenable enzymes such as chloramphenicol acetyltransferase (CAT) may be utilized. One of skill in the art would also know how to employ immunologic markers, possibly in conjunction with FACS analysis. The marker used is not believed to be important, so long as it is capable of being expressed simultaneously with the nucleic acid encoding a gene product. Further examples of selectable and screenable markers are well known to one of skill in the art.

In one aspect, the vector can express DNA segments encoding multiple polypeptides of interest. For example, DNA segments encoding both the immunoglobulin heavy chain and light chain can be encoded and expressed by a single vector. In one aspect, both DNA segments can be included on the same expressed RNA and internal ribosome binding site (IRES) sequences used to enable expression of the DNA segments as separate polypeptides (Pinkstaff J K, Chappell S A, Mauro V P, Edelman G M, Krushel L A., Internal initiation of translation of five dendritically localized neuronal mRNAs., Proc Natl Acad Sci USA. 2001 Feb. 27; 98(5):2770-5. Epub 2001 Feb. 20.). In another aspect, each DNA segment has its own promoter region resulting in expression of separate mRNAs (Andersen C R, Nielsen L S, Baer A, Tolstrup A B, Weilguny D. Efficient Expression from One CMV Enhancer Controlling Two Core Promoters. Mol Biotechnol. 2010 Nov. 27. [Epub ahead of print]).

Host Cells and Expression Systems

In some aspects, a composition can include a host cell. In some aspects, a host cell can include a polynucleotide or vector described herein. In some aspects, a host cell can include a eukaryotic cell (e.g., insect, yeast, or mammalian) or a prokaryotic cell (e.g., bacteria). In the context of expressing a heterologous nucleic acid sequence, "host cell" can refer to a prokaryotic cell, and it includes any transformable organism that is capable of replicating a vector and/or expressing a heterologous gene encoded by a vector. A host cell can, and has been, used as a recipient for vectors. A host cell may be "transfected" or "transformed," which refers to a process by which exogenous nucleic acid is transferred or introduced into the host cell. A transformed cell includes the primary subject cell and its progeny.

In particular embodiments, a host cell is a Gram negative bacterial cell. These bacteria are suited for use in that they possess a periplasmic space between the inner and outer membrane and, particularly, the aforementioned inner membrane between the periplasm and cytoplasm, which is also known as the cytoplasmic membrane. As such, any other cell with such a periplasmic space could be used. Examples of Gram negative bacteria include, but are not limited to, *E. coli, Pseudomonas aeruginosa, Vibrio cholera, Salmonella typhimurium, Shigella flexneri, Haemophilus influenza, Bordotella pertussi, Erwinia amylovora, Rhizobium* sp. The Gram negative bacterial cell may be still further defined as bacterial cell which has been transformed with the coding sequence of a fusion polypeptide comprising a candidate binding polypeptide capable of binding a selected ligand. The polypeptide is anchored to the outer face of the cytoplasmic membrane, facing the periplasmic space, and may comprise an antibody coding sequence or another sequence. One means for expression of the polypeptide is by attaching a leader sequence to the polypeptide capable of causing such directing.

Numerous prokaryotic cell lines and cultures are available for use as a host cell, and they can be obtained through the American Type Culture Collection (ATCC), which is an organization that serves as an archive for living cultures and genetic materials. An appropriate host can be determined by one of skill in the art based on the vector backbone and the desired result. A plasmid or cosmid, for example, can be introduced into a prokaryote host cell for replication of many vectors. Bacterial cells used as host cells for vector replication and/or expression include DH5-alpha, JM109, and KC8, as well as a number of commercially available bacterial hosts such as SURE™ Competent Cells and SOLOPACK™ Gold Cells (STRATAGENE™, La Jolla). In some aspects, other bacterial cells such as *E. coli* LE392 are contemplated for use as host cells.

Many host cells from various cell types and organisms are available and would be known to one of skill in the art. Similarly, a viral vector may be used in conjunction with a prokaryotic host cell, particularly one that is permissive for replication or expression of the vector. Some vectors may employ control sequences that allow it to be replicated and/or expressed in both prokaryotic and eukaryotic cells. One of skill in the art would further understand the conditions under which to incubate all of the above described host cells to maintain them and to permit replication of a vector. Also understood and known are techniques and conditions that would allow large-scale production of vectors, as well as production of the nucleic acids encoded by vectors and their cognate polypeptides, proteins, or peptides.

In some aspects, a host cell is mammalian. Examples include CHO cells, CHO-K1 cells, or CHO-S cells. Other mammalian host cells include NS0 cells and CHO cells that are dhfr-, e.g., CHO-dhfr-, DUKX-B11 CHO cells, and DG44 CHO cells.

Numerous expression systems exist can that comprise at least a part or all of the compositions disclosed herein. Expression systems can include eukaryotic expression systems and prokaryotic expression systems. Such systems could be used, for example, for the production of a polypeptide product identified as capable of binding a particular ligand. Prokaryote-based systems can be employed to produce nucleic acid sequences, or their cognate polypeptides, proteins and peptides. Many such systems are commercially and widely available. Other examples of expression systems comprise of vectors containing a strong prokaryotic promoter such as T7, Tac, Trc, BAD, lambda pL, Tetracycline or Lac promoters, the pET Expression System and an *E. coli* expression system.

Polypeptides

In some aspects, a composition can include a polypeptide. In some aspects, a polypeptide encoded by a polynucleotide described herein can be expressed, e.g., from a host cell. The terms "polypeptide" or "protein" include a macromolecule having the amino acid sequence of a native protein, that is, a protein produced by a naturally-occurring and non-recombinant cell; or it is produced by a genetically-engineered or recombinant cell, and comprise molecules having the amino acid sequence of the native protein, or molecules having deletions from, additions to, and/or substitutions of one or more amino acids of the native sequence. The term also includes amino acid polymers in which one or more amino acids are chemical analogs of a corresponding naturally-occurring amino acid and polymers. The terms "polypeptide" and "protein" encompass antigen binding proteins, antibodies, or sequences that have deletions from, additions to, and/or substitutions of one or more amino acids of antigen-binding protein. The term "polypeptide fragment"

refers to a polypeptide that has an amino-terminal deletion, a carboxyl-terminal deletion, and/or an internal deletion as compared with the full-length native protein. Such fragments can also contain modified amino acids as compared with the native protein. In certain embodiments, fragments are about five to 500 amino acids long. For example, fragments can be at least 5, 6, 8, 10, 14, 20, 50, 70, 100, 110, 150, 200, 250, 300, 350, 400, or 450 amino acids long. Useful polypeptide fragments include immunologically functional fragments of antibodies, including binding domains. In the case of a binding antibody, useful fragments include but are not limited to a CDR region, a variable domain of a heavy and/or light chain, a portion of an antibody chain or just its variable region including two CDRs, and the like.

The term "isolated protein" means that a subject protein (1) is free of at least some other proteins with which it would normally be found, (2) is essentially free of other proteins from the same source, e.g., from the same species, (3) is expressed by a cell from a different species, (4) has been separated from at least about 50 percent of polynucleotides, lipids, carbohydrates, or other materials with which it is associated in nature, (5) is operably associated (by covalent or noncovalent interaction) with a polypeptide with which it is not associated in nature, or (6) does not occur in nature. Typically, an "isolated protein" constitutes at least about 5%, at least about 10%, at least about 25%, or at least about 50% of a given sample. Genomic DNA, cDNA, mRNA or other RNA, nucleic acids of synthetic origin, or any combination thereof can encode such an isolated protein. Preferably, the isolated protein is substantially free from proteins or polypeptides or other contaminants that are found in its natural environment that would interfere with its therapeutic, diagnostic, prophylactic, research or other use.

In some aspects, a polypeptide can include an antigen binding protein (ABP). An "antigen binding protein" ("ABP") as used herein means any protein that binds a specified target antigen. "Antigen binding protein" includes but is not limited to antibodies and binding parts thereof, such as immunologically functional fragments. Peptibodies are another example of antigen binding proteins. The term "immunologically functional fragment" (or simply "fragment") of an antibody or immunoglobulin chain (heavy or light chain) antigen binding protein, as used herein, is a species of antigen binding protein comprising a portion (regardless of how that portion is obtained or synthesized) of an antibody that lacks at least some of the amino acids present in a full-length chain but which is still capable of specifically binding to an antigen. Such fragments are biologically active in that they bind to the target antigen and can compete with other antigen binding proteins, including intact antibodies, for binding to a given epitope. In some embodiments, the fragments are neutralizing fragments. These biologically active fragments can be produced by recombinant DNA techniques, or can be produced by enzymatic or chemical cleavage of antigen binding proteins, including intact antibodies. Immunologically functional immunoglobulin fragments include, but are not limited to, Fab, a diabody (heavy chain variable domain on the same polypeptide as a light chain variable domain, connected via a short peptide linker that is too short to permit pairing between the two domains on the same chain), Fab', F(ab')2, Fv, domain antibodies and single-chain antibodies, and can be derived from any mammalian source, including but not limited to human, mouse, rat, camelid or rabbit. It is further contemplated that a functional portion of the antigen binding proteins disclosed herein, for example, one or more CDRs, could be covalently bound to a second protein or to a small molecule to create a therapeutic agent directed to a particular target in the body, possessing bifunctional therapeutic properties, or having a prolonged serum half-life. As will be appreciated by one of skill in the art, an antigen binding protein can include nonprotein components. Additional details about antigen binding proteins and antibodies such as modifications, variants, methods of making, and methods of screening can be found in U.S. Pat. Pub. 20110027287, herein incorporated by reference in its entirety for all purposes.

In some aspects, a polypeptide can include an antibody. The term "antibody" refers to an intact immunoglobulin of any isotype, or a fragment thereof that can compete with the intact antibody for specific binding to the target antigen, and includes, for instance, chimeric, humanized, fully human, and bispecific antibodies. An "antibody" is a species of an antigen binding protein. An intact antibody will generally comprise at least two full-length heavy chains and two full-length light chains, but in some instances can include fewer chains such as antibodies naturally occurring in camelids which can comprise only heavy chains. Antibodies can be derived solely from a single source, or can be "chimeric," that is, different portions of the antibody can be derived from two different antibodies. The antigen binding proteins, antibodies, or binding fragments can be produced in hybridomas, by recombinant DNA techniques, or by enzymatic or chemical cleavage of intact antibodies. Unless otherwise indicated, the term "antibody" includes, in addition to antibodies comprising two full-length heavy chains and two full-length light chains, derivatives, variants, fragments, and muteins thereof. Furthermore, unless explicitly excluded, antibodies include monoclonal antibodies, bispecific antibodies, minibodies, domain antibodies, synthetic antibodies (sometimes referred to herein as "antibody mimetics"), chimeric antibodies, humanized antibodies, human antibodies, antibody fusions (sometimes referred to herein as "antibody conjugates"), and fragments thereof, respectively. In some embodiments, the term also encompasses peptibodies.

A therapeutically effective amount of an ABP can be administered to a subject in need thereof. ABPs can be formulated in pharmaceutical compositions. These compositions can comprise, in addition to one or more of the ABPs, a pharmaceutically acceptable excipient, carrier, buffer, stabilizer or other materials well known to those skilled in the art. Such materials should be non-toxic and should not interfere with the efficacy of the active ingredient. The precise nature of the carrier or other material can depend on the route of administration, e.g. oral, intravenous, cutaneous or subcutaneous, nasal, intramuscular, intraperitoneal routes.

Pharmaceutical compositions for oral administration can be in tablet, capsule, powder or liquid form. A tablet can include a solid carrier such as gelatin or an adjuvant. Liquid pharmaceutical compositions generally include a liquid carrier such as water, petroleum, animal or vegetable oils, mineral oil or synthetic oil. Physiological saline solution, dextrose or other saccharide solution or glycols such as ethylene glycol, propylene glycol or polyethylene glycol can be included.

For intravenous, cutaneous or subcutaneous injection, or injection at the site of affliction, the active ingredient will be in the form of a parenterally acceptable aqueous solution which is pyrogen-free and has suitable pH, isotonicity and stability. Those of relevant skill in the art are well able to prepare suitable solutions using, for example, isotonic vehicles such as Sodium Chloride Injection, Ringer's Injection, Lactated Ringer's Injection. Preservatives, stabilizers, buffers, antioxidants and/or other additives can be included, as required.

ABP administration is preferably in a "therapeutically effective amount" or "prophylactically effective amount" (as the case can be, although prophylaxis can be considered therapy), this being sufficient to show benefit to the individual. The actual amount administered, and rate and time-course of administration, will depend on the nature and severity of disease being treated. Prescription of treatment, e.g. decisions on dosage etc., is within the responsibility of general practitioners and other medical doctors, and typically takes account of the disorder to be treated, the condition of the individual patient, the site of delivery, the method of administration and other factors known to practitioners. Examples of the techniques and protocols mentioned above can be found in Remington's Pharmaceutical Sciences, 16th edition, Osol, A. (ed), 1980.

A composition can be administered alone or in combination with other treatments, either simultaneously or sequentially dependent upon the condition to be treated.

Immune Cells

A sample can include immune cells. The immune cells can include T cells and B cells. T-cells (T lymphocytes) include, for example, cells that express T cell receptors. B-cells include, for example, activated B cells, blasting B cells, plasma cells, plasmablasts, memory B cells, B1 cells, B2 cells, marginal-zone B cells, and follicular B cells. T cells include activated T cells, blasting T cells, Helper T cells (effector T cells or Th cells), cytotoxic T cells (CTLs), memory T cells, central memory T cells, effector memory T cells and regulatory T cells. A sample can include a single cell in some applications (e.g., a calibration test to define relevant T or B cells) or more generally at least 1,000, at least 10,000, at least 100,000, at least 250,000, at least 500,000, at least 750,000, or at least 1,000,000 cells.

B Cells

As used herein a "B cell" refers to any cell that has at least one rearranged immunoglobulin gene locus. A B cell can include at least one rearranged immunoglobulin heavy chain locus or at least one rearranged immunoglobulin light chain locus. A B cell can include at least one rearranged immunoglobulin heavy chain locus and at least one rearranged immunoglobulin light chain locus. B cells are lymphocytes that are part of the adaptive immune system. B cells can include any cells that express antibodies either in the membrane-bound form as the B-cell receptor (BCR) on the cell surface or as secreted antibodies. B cells can express immunoglobulins (antibodies, B cell receptor). Antibodies can include heterodimers formed from the heavy and light immunoglobulin chains. The heavy chain is formed from gene rearrangements of the variable, diversity, and junctional (VDJ) genes to form the variable region, which is joined to the constant region. The light chain is formed from gene rearrangements of the variable and junctional (VJ) genes to form the variable region, which is then joined to the constant region. Owing to a large possible number of junctional combinations, the variable regions of the antibody gene (which is also the BCR) have huge diversity, enabling B cells to recognize any foreign antigen and mount a response against it.

B-Cell Activation and Differentiation

B cells are activated and differentiate when they recognize an antigen in the context of an inflammatory immune response. They usually include 2 signals to become activated, one signal delivered through BCR (a membrane-bound form of the rearranged immunoglobulin), and another delivered through CD40 or another co-stimulatory molecule. This second signal can be provided through interaction with helper T cells, which express the ligand for CD40 (CD40L) on their surface. B cells then proliferate and may undergo somatic hypermutation, where random changes in the nucleotide sequences of the antibody genes are made, and B cells whose antibodies have a higher affinity B cells are selected. They may also undergo "class-switching", in which the constant region of the heavy chain encoding the IgM isotype is switched to the constant region encoding the IgG, IgA, or IgE isotype. Differentiating B cells may end up as memory B cells, which are usually of higher affinity and classed switched, though some memory B cells are still of the IgM isotype. Memory B cells can also become activated and differentiate into plasmablasts and ultimately, into plasma cells. Differentiating B cells may also first become plasmablasts, which then differentiate to become plasma cells.

Affinity Maturation and Clonal Families

A clonal family is generally defined by the use of related immunoglobulin heavy chain and/or light chain V(D)J sequences by 2 or more samples. Related immunoglobulin heavy chain V(D)J sequences can be identified by their shared usage of V(D)J gene segments encoded in the genome. Within a clonal family there are generally subfamilies that vary based on shared mutations within their V(D)J segments, that can arise during B cell gene recombination and somatic hypermutation.

Activated B cells migrate and form germinal centers within lymphoid or other tissues, where they undergo affinity maturation. B cells may also undergo affinity maturation outside of germinal centers. During affinity maturation, B cells undergo random mutations in their antibody genes, concentrated in the complementary determining regions (CDRs) of the genes, which encode the parts of the antibody that directly bind to and recognize the target antigen against which the B cell was activated. This creates sub-clones from the original proliferating B cell that express immunoglobulins that are slightly different from the original clone and from each other. Clones compete for antigen and the higher-affinity clones are selected, while the lower-affinity clones die by apoptosis. This process results in the "affinity maturation" of B cells and consequently in the generation of B cells expressing immunoglobulins that bind to the antigen with higher affinity. All the B cells that originate from the same 'parent' B cell form clonal families, and these clonal families include B cells that recognize the same or similar antigenic epitopes. In some aspects, we expect that clones present at higher frequencies represent clones that bind to antigen with higher affinity, because the highest-affinity clones are selected during affinity maturation. In some aspects, clones with different V(D)J segment usage exhibit different binding characteristics. In some aspects, clones with the same V(D)J segment usage but different mutations exhibit different binding characteristics.

Memory B Cells

Memory B cells are usually affinity-matured B cells, and may be class-switched. These are cells that can respond more rapidly to a subsequent antigenic challenge, significantly reducing the time included for affinity-matured antibody secretion against the antigen from ~14 days in a naive organism to ~7 days.

Plasmablasts and Plasma Cells

Plasma cells can be either long-lived or short-lived. Long-lived plasma cells may survive for the lifetime of the organism, whereas short-lived plasma cells can last for 3-4 days. Long-lived plasma cells reside either in areas of inflammation, in the mucosal areas (in the case of IgA-secreting plasma cells), in secondary lymphoid tissues (such as the spleen or lymph nodes), or in the bone marrow. To reach these divergent areas, plasmablasts fated to become long-lived plasma cells may first travel through the bloodstream before utilizing various chemokine gradients to traffic to the appropriate areas. Plasmablasts are cells that are affinity matured, are typically classed-switched, and usually secrete antibodies, though generally in lower quantities than the quantity of antibody produced by plasma cells. Plasma cells are dedicated antibody secretors.

Characteristics of TCR and BCR Genes

Since identifying recombinations are present in the DNA of each individual adaptive immune cell as well as their associated RNA transcripts, either RNA or DNA can be sequenced. A recombined sequence from a T-cell or B-cell can also be referred to as a clonotype. The DNA or RNA can correspond to sequences from T-cell receptor (TCR) genes or immunoglobulin (Ig) genes that encode antibodies. For example, the DNA and RNA can correspond to sequences encoding alpha, beta, gamma, or delta chains of a TCR. In a majority of T-cells, the TCR is a heterodimer consisting of an alpha-chain and beta-chain. The TCR-alpha chain is generated by VJ recombination, and the beta chain receptor is generated by V(D)J recombination. For the TCR-beta chain, in humans there are 48 V segments, 2 D segments, and 13 J segments. Several bases may be deleted and others added (called N and P nucleotides) at each of the two junctions. In a minority of T-cells, the TCRs consist of gamma and delta chains. The TCR gamma chain is generated by VJ recombination, and the TCR delta chain is generated by V(D)J recombination (Kenneth Murphy, Paul Travers, and Mark Walport, Janeway's Immunology 7th edition, Garland Science, 2007, which is herein incorporated by reference in its entirety).

The DNA and RNA analyzed in the methods can correspond to sequences encoding heavy chain immunoglobulins (IgH) with constant regions (alpha, delta, gamma, epsilon, or mu) or light chain immunoglobulins (IgK or IgL) with constant regions lambda or kappa. Each antibody can have two identical light chains and two identical heavy chains. Each chain is composed of a constant (C) and a variable region. For the heavy chain, the variable region is composed of a variable (V), diversity (D), and joining (J) segments. Several distinct sequences coding for each type of these segments are present in the genome. A specific VDJ recombination event occurs during the development of a B-cell, marking that cell to generate a specific heavy chain. Diversity in the light chain is generated in a similar fashion except that there is no D region so there is only VJ recombination. Somatic mutation often occurs close to the site of the recombination, causing the addition or deletion of several nucleotides, further increasing the diversity of heavy and light chains generated by B-cells. The possible diversity of the antibodies generated by a B-cell is then the product of the different heavy and light chains. The variable regions of the heavy and light chains contribute to form the antigen recognition (or binding) region or site. Added to this diversity is a process of somatic hypermutation which can occur after a specific response is mounted against some epitope. In this process mutations occur in those B-cells that are able to recognize the specific epitope leading to greater diversity in antibodies that may be able to bind the specific epitope more strongly. All these factors contribute to great diversity of antibodies generated by the B-cells. Many billions and maybe more than a trillion distinct antibodies may be generated. The basic premise for generating T-cell diversity is similar to that for generating antibodies by B-cells. An element of T-cell and B-cell activation is their binding to epitopes. The activation of a specific cell leads to the production of more of the same type of cells leading to a clonal expansion.

Complementarity determining regions (CDR), or hypervariable regions, are sequences in the variable domains of antigen receptors (e.g., T cell receptor and immunoglobulin) that can bind an antigen. The chain of each antigen receptor contains three CDRs (CDR1, CDR2, and CDR3). The two polypeptides making T cells (alpha and beta) and immunoglobulin (IgH and IgK or IgL) contribute to the formation of the three CDRs.

The part of CDR1 and CDR2 that is coded for by TCR-beta lies within one of 47 functional V segments. Most of the diversity of CDRs is found in CDR3, with the diversity being generated by somatic recombination events during the development of T lymphocytes.

A great diversity of BCR is present inter and intra-individuals. The BCR is composed of two genes IgH and IgK (or IgL) coding for antibody heavy and light chains. Three Complementarity Determining Region (CDR) sequences that bind antigens and MHC molecules have the most diversity in IgH and IgK (or IgL). The part of CDR1 and CDR2 coded for by IgH lies within one of 44 functional V segments. Most of the diversity in naive B cells emerges in the generation of CDR3 through somatic recombination events during the development of B lymphocytes. The recombination can generate a molecule with one of each of the V, D, and J segments. In humans, there are 44 V, 27 D, and 6 J segments; thus, there is a theoretical possibility of more than 7,000 combinations. In a small fraction of BCRs (about 5%) two D segments are found. Furthermore, several bases may be deleted and others added (called N and P nucleotides) at each of the two junctions generating a great degree of diversity. After B cell activation a process of affinity maturation through somatic hypermutation occurs. In this process progeny cells of the activated B cells accumulate distinct somatic mutations throughout the gene with higher mutation concentration in the CDR regions leading to generating antibodies with higher affinity to the antigens. In addition to somatic hypermutation activated B cells undergo the process of isotype switching. Antibodies with the same variable segments can have different forms (isotypes) depending on the constant segment. Whereas all naive B cells express IgM (or IgD), activated B cells mostly express IgG but also IgM, IgA and IgE. This expression switching from IgM (and/or IgD) to IgG, IgA, or IgE occurs through a recombination event causing one cell to specialize in producing a specific isotype. There is one segment for each IgM, IgD, and IgE, two segments for IgA, and four segments for IgG.

Methods

Application to Health Care and Biotechnology Uses

Use of the compositions and methods described herein to identify antibodies and TCRs and to group antibody and TCR sequences into clonal families has many useful and novel applications to health care and biotechnology research. Antibody clonal families can comprise affinity-matured non-identical clones and TCR clonal families can comprise identical clones. These applications include, but are not limited to: 1) the discovery and development of antibody or antibody-derived therapeutics; 2) the discovery and development of diagnostics; 3) the discovery and development of research tools useful in health and biotechnology research; and 4) the development and assessment of candidate vaccines and identification of antigens useful as vaccine components.

As the invention can be used with any type of B or T cell, the cell source and specific B or T cell subtype(s) are chosen based on the profile of the desired ultimate product. Examples of specific subclasses of B or T cells and their use are described in the subsection, "Isolation and enrichment of cells and cell subpopulations" in the General Materials and Methods section. In general, the cells can be from a particular human or animal subject having a particular clinical state or course of disease, or having received a particular treatment regimen, or having been exposed to a particular challenge, immunization, or set of conditions that induces an immune response.

Application to Discovery and Development of Therapeutics, Diagnostics, and Research Tools To develop an antibody or molecule derived from an antibody for use as a therapeutic, diagnostic, or research tool, the antibody and/or derivatives of the antibody's antigen-binding regions can first be identified or discovered as binding a/the desired antigen(s) or epitope(s) and/or having a desired functional consequence in an in vivo or in vitro system. These candidate antibodies are then further screened for other desired properties specific to the intended product. These target product properties will be different for different types of therapeutic, diagnostic, and research tool antibodies, and the invention provides a useful means of identifying candidates for further development toward any of these product paths.

Based on the desired profile of the properties of the ultimate product, the source of relevant B cells can be, but is not limited to, a patient with disease, such as an infectious disease, cancer, or an autoimmune condition; a patient receiving a treatment, such as cancer therapy or a vaccine; or an animal with disease or treated in a manner to induce an immune response, such as immunization or induction/establishment of a disease model.

In general, candidate antibodies, or candidate macromolecules derived from the antigen-binding regions, that are intended for development as therapeutics, diagnostics, or research tools are discovered via multiple technologies that fall into one of two general approaches: 1) isolation of antibodies of interest from B cells of a human's or an animal's immune response; and 2) isolation of antibodies derived from expression libraries of immunoglobulin molecules, or derivatives thereof, expressed heterologously and screened using one or more display technologies (reviewed in Hoogenboom H R, Trends Biotechnol., 1997, 15:62-70; Hammond P W, MAbs, 2010, 2:157-64; Nissim A, Chernajovsky Y, Handb Exp Pharmacol., 2008, (181):3-18; Steinitz M, Hum Antibodies, 2009; 18:1-10; Bradbury A R, Sidhu S, Dübel S, and McCafferty, Nat Biotechnol., 2011, 29:245-54; *Antibody Engineering* (Kontermann R E and Dübel S eds., Springer, $2^{nd}$ edition)).

For the former approach (#1), candidate antibodies are selected from particular clonal families identified from relevant donors as described in, e.g., the General Materials and Methods section. The invention can be applied as described to the appropriate B-cells (e.g. blasting B-cells) from the appropriate human donor or animal to discover or identify candidate antibodies. For example, for a cancer therapeutic antibody candidate, the appropriate human donor can be a patient who has successfully suppressed cancer progression via an immune response; or for a particular diagnostic antibody candidate, the appropriate donor can be a patient who has autoantibodies against the diagnostic marker or a mouse immunized against the marker; or for an antibody reagent tool candidate, the appropriate donor can be a mouse, a rabbit, a goat, a rat, a horse, a chicken, a dog, or other animal immunized with the target molecule and/or epitope that the antibody reagent is meant to recognize. Sequences and selection of antibodies for expression and testing can be performed as described in the General Materials and Methods section. Such applications of the technology can provide candidate antibodies often obtained via more laborious and time-consuming methods (e.g. hybridoma technology, virus-induced immortalization of B cells, etc).

For the latter approach (#2), a subset of, or the entire set of paired heavy and light chain sequences from a one or more human or animal antibody repertoires, obtained as in #1, are used to seed expression libraries containing identification regions to track sample origin and original cognate pairs from the sample when a library and/or a selected/enriched subset of a library is sequenced using a next generation sequencing platform. Variable regions and framework region information can be incorporated into one or more antibody display library formats to discover candidate antibodies. Variable regions of Ig genes can be cloned and incorporated into expression vectors using methods described in the subsection, "Cloning and expression of cloned light and heavy chain immunoglobulin pairs" in the General Materials and Methods section. For example, fragments and/or domains from cognate pair heavy and light chains obtained as in #1 can be used to seed Fab yeast (Weaver-Feldhaus J M, Lou J, Coleman J R, et al., FEBS Lett, 2004, 564:24-34) or phagemid (Kashyap A K, Steel J, Oner A F, et al., Proc Natl Acad Sci USA, 2008, 105:5986-91) libraries with identification region tracking of each chain to the proper, original B cell of origin regardless of combinatorial matching of different heavy and light chains into non-endogenous (non-cognate) pairings. The cognate pair heavy and light chains obtained as in #1 can also be used with other display platforms, beyond phagemid or yeast, and can be used with other antibody derivative expression constructs beyond Fab fragment expression constructs [*Antibody Engineering* (Kontermann, R E and Dübel S eds., Springer, $2^{nd}$ edition)]. In an alternate application of the identification regions, identification regions can be added to already existing display libraries to provide the benefits of identification region tracking and error correction of next generation sequencing data. Depending on the library type, format, and expression/display system, identification regions can be incorporated using PCR reactions or reverse transcriptase followed by PCR reactions (see, e.g., the subsection, "Sequencing of paired light and heavy chain immunoglobulin genes from single B-cells" in the General Materials and Methods section).

Candidate antibodies, whether from B cell repertoires (see, e.g., General Materials and Methods section) or display expression library "repertoires" (Kashyap A K, Steel J, Oner A F, et al., Proc Natl Acad Sci USA, 2008, 105:5986-91; Weaver-Feldhaus J M, Lou J, Coleman J R, et al., FEBS Lett, 2004, 564:24-34; Ravn U, Gueneau F, Baerlocher L, et al., Nucleic Acids Res, 2010, 38:e193; *Antibody Engineering* (Kontermann, R E and Dübel S eds., Springer, $2^{nd}$ edition), are identified by expressing and testing the antibody or antibody-derivative molecules, or libraries of molecules, in assays for binding against desired antigen/target(s) and/or epitope(s) or in assays for testing of functional consequence in an in vivo or in vitro (including ex vivo samples/preparations) setting. Published reports have described the use of identification regions to track the donor source of antibody sequences obtained from a B-cell repertoire for use in an expression library (e.g. Kashyap A K, Steel J, Oner A F, et al., Proc Natl Acad Sci USA, 2008, 105:5986-91). The identification region technology described herein, uniquely provides useful improvements upon such identification region usage. The invention: 1) provides a means to track, not only each donor, but each donor's B cells for cognate pairing of heavy and light chains; 2) provides a means to index back to the original B cell sample for retrieval of more sample for cloning and/or testing; 3) provides a means of tracking heavy and light chain origin despite non-cognate combinatorial pairings within the expression library; 4) provides a means of tracking heavy and light chain origin across rounds of selection-enrichment (e.g. when monitoring sequence evolution during pool selection in vitro, such as in Ravn U, Gueneau F, Baerlocher L, et al., Nucleic Acids Res, 2010, 38:e193).

Identification of the most frequently represented heavy or light chain sequences in a B cell immune response repertoire, and combining heavy and light chain pairs based on rank order frequency of the individual chains, has been shown to be a viable way to identify some candidate antibodies, despite the fact that the cognate pair information is not retained in the next generation sequence analyses when performed in this manner (Reddy S T, Ge X, Miklos A E, et al., Nat Biotechnol, 2010, 28:965-9). The invention also allows for this type of frequency analysis methodology, but can further provide a means to use next generation sequencing to assess the frequency of actual antibodies in the repertoire, not simply isolated, independent heavy or light chains.

Furthermore, the invention provides at least three improvements of significant utility beyond frequency analysis: 1) because the cognate pairing of heavy and light chains can be tracked, the discovery of actual antibodies from the immune response and the actual antibody clonal families produced by the B cells in the immune response can be identified (a clone involves a specific, cognate pair of heavy and light chains that co-evolved from the same cell progenitors and information about natural pairings within the affinity maturation process would improve upon approaches described in the literature to analyze immune responses using next generation sequencing [e.g. Wu X, Yang Z Y, Li Y, Hogerkorp C M, et al., Science, 2010, 329:856-61]); 2) identification regions provide the means to minimize, or even eliminate, the effect on sequence analyses of sequencing errors common to next generation sequencing platforms (see, e.g., subsection, "Other sequencing data analysis options" in the General Materials and Methods section); and 3) identification regions provide the ability to link and track ≥2 sequences co-expressed at the single cell level.

For those candidate antibodies that have been identified as having desirable binding properties to an antigen, target, or epitope, or that have a desired functional effect, more antibodies from the respective clonal family can be cloned and expressed (see, e.g., General Materials and Methods section) to test for the presence of similar, but potentially more optimal, antibodies or antibodies that are the same in binding or functional properties but contain other difference of import to the final product profile.

For cases in which candidates are identified from display expression libraries, identification regions can provide a means to identify antibodies of potentially similar sequence to candidates by identifying sequences that were not selected in screening enrichment but which contain identification regions of the identified candidates and thus are derived from the same original heavy and/or light chains that seeded the library. Antibodies that are lost in rounds of in vitro selection, but are similar to selected, candidate antibodies can be recovered or "rescued" for further analysis as potential candidates. Such rescue can obviate the effect of bias in expression or assays systems that may miss useful and functional antibodies (Ravn U, Gueneau F, Baerlocher L, et al., Nucleic Acids Res, 2010, 38:e193).

Once candidates with desired binding and/or functional properties are identified, they can then be advanced to relevant assays and other assessments based on the desired, downstream, product profile. For therapeutic antibodies intended for use in passive immunization, candidates are advanced to assays and preclinical testing models to determine the best candidates for clinical testing in humans or for use in animal health, including, but not limited, assessments of properties such as stability and aggregation, formulation and dosing ease, protein expression and manufacturing, species selectivity, pharmacology, pharmacokinetics, safety and toxicology, absorption, metabolism and target-antibody turnover, as well as immunogenicity [See, e.g., Lynch C M, Hart B W, and Grewal I S, MAbs, 2009, 1: 2-11; Chapman K, Pullen N, Coney L, et al., mAbs, 2009, 1, 505-516; S. Dübel, *Handbook of Therapeutic Antibodies: Technologies, Emerging Developments and Approved Therapeutics* (John Wiley & Sons, 2010); Therapeutic *Monoclonal Antibodies: From Bench to Clinic*, (Z. An ed., John Wiley & Sons, 2009) *Antibody Engineering* (Kontermann R E and Dübel S eds., Springer, $2^{nd}$ edition)]. Thus many candidates are selected because the majority will be insufficient for therapeutic testing in humans with respect to at least one of the many properties that need to be assessed prior to human testing (i.e. attrition). Clonal families can be mined, e.g., as described above, for candidates similar to ones already characterized, but possibly harboring differences regarding one or more of the properties that are assessed in preclinical work. Specific antibody engineering strategies may need to be employed to optimize for certain properties [*Antibody Engineering* (Kontermann R E and Dübel eds., Springer, $2^{nd}$ edition)].

For diagnostics, the invention can be used to identify antibodies, TCRs, and clonal families produced by infection or vaccination for use in the detection of infectious agents (Selvarajah S, Chatterji U, Kuhn R, et al., 2012, 6:29-37; Berry J D, Vet J, 2005, 170:193-211), as well as for any non-infectious disease, pathological condition, or medical treatment or therapy. Such antibodies, TCRs, and/or clonal families can provide useful diagnostic probes for biomarkers or provide immune system information about the disease state of, or effect of treatment on, a human or animal. As such, specific antibodies or TCRs, or specific clonal families of either immune receptor class can provide utility for diagnostic tools and personalized medicine. In another application to diagnostics, known disease or treatment response biomarkers can be used as immunogens to immunize mice or other animals from which B cells are harvested to identify antibodies (see, e.g., General Materials and Methods section) against the biomarker which could subsequently be used in diagnostic tests, such as ELISAs or other immunoassays (Selvarajah S, Chatterji U, Kuhn R, et al., 2012, 6:29-37). Once identified as having potential diagnostic utility, candidate antibodies, TCRs, and/or clonal families can be advanced to assays, models, and possibly trials relevant to the desired profile of the diagnostic product [Berry J D, Vet J, 2005, 170:193-211; *Diagnostic and Therapeutic Antibodies* in Methods in Molecular Medicine, Vol. 40 (George A J T and Urch C E eds., Humana Press); *Antibody Engineering* (Kontermann R E and Dübel S eds., Springer, $2^{nd}$ edition); Colwill K, Renewable Protein Binder Working Group, and Gräslund S, Nat Methods, 2011, 8:551-8; Pershad K, Pavlovic J D, Gräslund S, et al., Protein Eng Des Sel, 2010, 23:279-88.]. Specific antibody engineering strategies may need to be employed to optimize for certain properties [*Antibody Engineering* (Kontermann R E and Dübel eds., Springer, $2^{nd}$ edition)].

For research tool antibodies, candidates identified, e.g., as described above, can be advanced to test how they perform in the research application for which the research tool antibody is intended (e.g. immunoprecipitation; immunoblotting; immunostaining and histology; immunoaffinity purification; capture-, and sandwich-, and detection immunoassays; for example as described in *Antibodies: A Laboratory Manual*, E Harlow and D Lane (Cold Spring Harbor Laboratory Press, 1988). Validation criteria will be based on the final intended research use (Colwill K, Renewable Protein Binder Working Group, and Gräslund S, Nat Methods, 2011, 8:551-8; Pershad K, Pavlovic J D, Gräslund S, et al., Protein Eng Des Sel, 2010, 23:279-88). Specific antibody engineering strategies may need to be employed to optimize for certain properties [*Antibody Engineering* (Kontermann R E and Dübel eds., Springer, $2^{nd}$ edition)].

Application to Vaccine Discovery and Development

The invention can be used to identify antibodies, TCRs, and clonal families of each of these immune receptor classes to a vaccine challenge in a human or animal. Specific antibodies can be used as probes to identify the vaccine component(s) recognized by the antibody and the clonal family to which the antibody that was used as a probe belongs. This information about antibody and clonal families can be used to make assessments about the proportions or strength of the immune response targeting particular antigens and/or epitopes of the vaccine. The assessment of antibody immune responses to different vaccine components can be complemented with information collected about the concomitant TCR repertoire response to the vaccine, (see, e.g., subsections, "For other cell types" and "PCR of other immunoglobulin heavy chains and T-cell receptor (TCR) chains" in the General Materials and Methods section). This information can be subsequently used to understand which components of the vaccine, or which variants of a vaccine, or what adjuvants produce effective or more optimal responses from an immune system of a human or animal (Haynes B F, Gilbert P B, McElrath M J, et al., N Engl J Med, 2012, 366:1275-86). The approach can also be used to compare individuals or populations in their response to a vaccine.

Similar analyses can be performed to identify and assess the antibodies, TCRs, and the clonal families produced in response to an actual pathogen and which may correlate with clinical outcomes of interest, such as protective responses to infection (for example, identification of antibodies from survivors of a severe influenza pandemic, Yu X, Tsibane T, McGraw P A, et al., Nature, 2008, 455:532-6; or identification of specific antibodies from HIV-infected individuals with broadly HIV-neutralizing sera, Wu X, Yang Z Y, Li Y, Hogerkorp C M, et al., Science, 2010, 329:856-61 and Walker L M, Phogat S K, Chan-Hui P Y, et al., Science, 2009, 326:285-9). Identification of such correlates of protection can be compared to the response produced by the vaccine and/or specific vaccine components as described above and the two datasets can be compared to assess the ability of the vaccine to produce immune responses that correlate to desired outcomes seen in cases of actual infection.

Thus, the invention provides a useful means of obtaining a surrogate readout of disease protection and vaccine response, via antibody and/or TCR repertoire sequence analysis, before a human or animal is challenged with actual infection. Once a clonal family has been identified as binding a particular antigen or epitope, the identification of antigens or epitopes targeted by other immune response repertoires is possible without doing assays in cases where the same or similar clonal families are found across repertoires. Thus, in those cases where enough information about a clonal family and it antigen/epitope binding is known (see, e.g., subsection, "Screening of expressed human antibodies" in the General Materials and Methods section), sequence analysis alone of newly analyzed repertoires can provide a readout of the antigens of that repertoire for the known clonal families that it contains. This application can provide a useful means to monitor responses across one, a few, or many subjects in vaccine clinical trials and to monitor immunity and infectious disease relationships for one, a few, or many people on a population level.

Furthermore, antibody, TCR, and clonal families that correlate with protection from a pathogen can be used to identify the specific antigens and sets of antigens (including both known and novel antigens) that mediate protective and/or effective immune responses against the pathogen. Identification of the antigens targeted in effective immune responses can be used to guide the selection of antigens to be included in vaccines that are expected to produce protective antibody- and TCR-mediated responses in immunized humans or animals.

Antibodies, TCR, and clonal families that do not bind known antigens in assays become candidates for identifying potentially novel antigens and/or epitopes of the pathogen against which the antibodies and/or TCRs provide protection. Antibodies known to not bind already known antigens can be used as probes in combination with immunoseparation and mass spectroscopy to identify the previously unidentified antigen or epitope (Zhu Y Z, Cai C S, Zhang W, et al., PLoS One, 2010, 5:e13915; and see, e.g., subsections, "Immunoprecipitation of staph antigens with antibodies derived from staph-infected patients" and "Mass spectrometry identification of peptides" in the General Materials and Methods section). Such novel antigens or epitopes can be used as vaccine components that are expected to produce or contribute to the production of protective antibody- and TCR-mediated responses in immunized humans or animals.

In addition to facilitating development of vaccines for microbial pathogens, the antibody, TCR and clonal families can also be used to develop tumor vaccines. Humans or animals that mount an immune response against a cancer or pre-cancerous cells can yield antibodies, TCR, and clonal families that can be used to identify individual and combinations of antigens that can be incorporated into preventative or therapeutic vaccines for cancer.

Methods for Producing One or More Polynucleotides of Interest

In some aspects, a method includes obtaining a cDNA library comprising a plurality of cDNAs associated with a plurality of samples obtained from one or more subjects, wherein each cDNA is associated with a single sample in the plurality of samples, and wherein each cDNA associated with each sample is present in a separate container; adding an adapter molecule to the cDNA associated with each sample, wherein the adapter molecule comprises a sample identification region and an adapter region, wherein the sample identification region is coupled to the adapter region, and wherein the sequence of the sample identification region of each adapter molecule is distinct from the sequence of the sample identification region of the other adapter molecules added to each cDNA in the library; and allowing the adapter region to attach to each cDNA in the library to produce the one or more polynucleotides of interest.

In some aspects, obtaining the cDNA library comprises obtaining the plurality of samples and processing the samples to prepare the cDNA library. In some aspects, obtaining the cDNA library comprises receiving the cDNA library directly or indirectly from a third party that has processed the plurality of samples to prepare the cDNA library.

In some aspects, the adapter molecule further comprises a universal primer region, wherein the 3' end of the universal primer region is coupled to the 5' end of the sample identification region. In some aspects, each cDNA region comprises an mRNA polynucleotide hybridized to a cDNA polynucleotide.

In some aspects, each sample comprises a cell. In some aspects, the cell is a B cell. In some aspects, the B cell is a plasmablast, memory B cell, or a plasma cell. In some aspects, each sample comprises a plurality of cells.

In some aspects, each adapter region is attached to each cDNA via binding, e.g., G:C binding.

In some aspects, the adapter molecule is single-stranded, and further comprising incorporating the adapter molecule into each cDNA by allowing an enzyme to make the adapter molecule double-stranded. In some aspects, the adapter molecule is incorporated into each cDNA to produce the polynucleotide of interest by an MMLV If reverse transcriptase.

In some aspects, methods can include amplification steps such as PCR and other amplification reactions generally known in the art.

Methods for Linking and Barcoding Polynucleotides of Interest

In some aspects, the method includes the linking of two polynucleotide sequences of interest, e.g., an antibody light chain (LC) and heavy chain (HC) from a single sample, and providing one or more barcode or sequence identification sequences. In this aspect, there is provided a physical linkage between the polynucleotide sequences of interest as well as one or more barcodes to provide an identifier to allow polynucleotide sequences derived from a particular source or sample to be determined, e.g., single cell, sample well, single sample, etc. Single samples can comprise one or more B-lineage cells or other cell types. Examples of methods to link two polynucleotide sequences of interest are known in the art, for example, WO 99/16904, WO 93/03151, and U.S. Pat. No. 7,749,697, which are hereby incorporated by reference. Among other advantages associated with the use of barcodes on linked polynucleotide sequences include facilitation of high-throughput sequencing and mapping of a sequence back to an original sample so that it can be re-sequenced and PCR cloned to express the polynucleotide sequences, e.g., HC and LC immunoglobulin polynucleotides. Some of the high-throughput sequencing technologies exhibit sequencing error rates of 1-10+%, and the use of barcodes enables repeat sequencing of templates to facilitate bioinformatic error correction. This is particularly important for distinguishing sequencing errors from gene variations, such as those in immunoglobulin polynucleotides: Specifically, it can be difficult to ascertain if closely related sequences are in fact distinct sequences or if they instead represent artifacts produced by sequencing errors. Barcodes, by enabling analysis of repeat sequencing of individual templates thereby enable sequencing error correction, thus providing determination of whether sequences are distinct vs. artifacts from sequencing error(s). In one embodiment, the polynucleotide sequences are immunoglobulin HC and LC sequences that have diverged due to somatic hypermutation, and differ by only 1 nucleotide.

Figure 15:
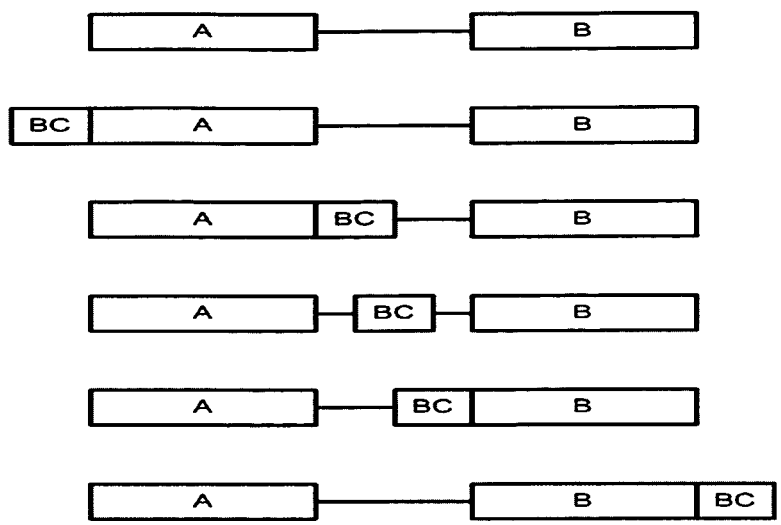
FIG. 15. Potential locations of barcode sequences to identify a linked pair of polynucleotide sequences. The schematic illustrates the physical linkage of two nucleic acid segments, A and B (e.g., two cDNAs). A barcode (BC) is appended to any one of the ends, or both ends, or anywhere in the sequence linking A and B. In one embodiment, A and B represent immunoglobulin heavy and light chain sequences.

In this aspect, physically linked and barcoded structures as shown in FIG. 15 are generally obtained. FIG. 15 illustrates the physical linkage of two nucleic acid segments, A and B (e.g., two cDNAs). A barcode (BC) is appended to any one of ends or in the linker connecting A and B. This physical linkage of A and B, as well as, addition of the barcode is accomplished through any of a number of means, including by ligation, recombination, amplification, or overlap-extension, or a combination of these methods, as described in greater detail below. Optionally, additional barcodes can be added to the structure shown in FIG. 15, to provide compound barcoding to enable sequencing of a large number of linked polynucleotides using a lesser number of barcodes. Also, it will be appreciated that depending on the particular strategy used to link the two nucleic acid segments, any relative orientation of the segments can be obtained, with respect to sense and antisense orientations, i.e., the segments, such as cDNAs, can be joined head to tail, head to head, or tail to tail.

Barcodes can be added to the polynucleotide sequences before, during or after physical linkage using methods known in the art. These methods include, but are not limited to, for example, ligation methods, such as blunt end ligation of barcode adaptors, and by the annealing and ligation of compatible ends, such as those generated by homopolymeric tailing, restriction enzyme digestion of a linker, or 3' tailing of cDNA by reverse transcriptase. Barcodes can also be added in amplification reactions using suitable primers carrying barcode sequences. Barcodes can also be added in a reverse transcription reaction using suitable primers containing the barcode sequence. Barcodes can also be added by incorporation into oligonucleotides used to link the genes of interest together, through overlap-extension tails or other methods, such that they are located between the two genes of interest. Accordingly, using these methods, barcodes can be incorporated onto the ends of physically linked polynucleotide sequences or into the linker sequences joining the two polynucleotide sequences of interest.

Figure 16:
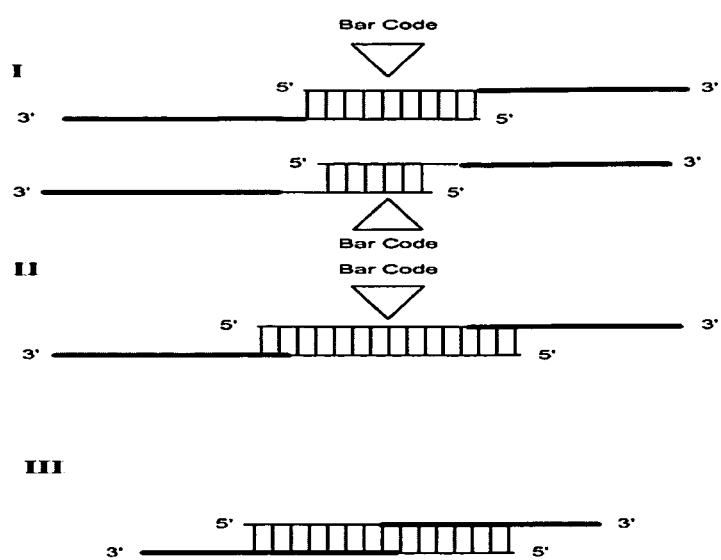
FIG. 16. Different types of overlap-extension tails. The bold line corresponds to a gene specific sequence and the thin line corresponds to the overlapping tail. As indicated, the overlap can be entirely due to the overlap of the primer sequence or else due to partial or total overlap with a gene specific sequence. As indicated, the overlap can also contain a barcode sequence. Structures I, II, and III indicate potential locations of the overlaps.

In one embodiment, the linkage is accomplished through the use of overlap-extension (see FIG. 16). In general, overlap extension tails are complementary sequences that are added to polynucleotide sequences of interest to be joined. Annealing of overlap-extension tails appended to the polynucleotide molecules of interest allow them to be linked (see FIGS. 17, 18, 19, and 20). As described below, overlap-extension tails can be added through a number of well known methods including, but not limited to, polynucleotide synthesis reactions, such as nucleic acid amplification and reverse transcription, ligation, and recombination. Because of the variety of methods available to effect linkage, it will be recognized that different relative orientations of the polynucleotide segments can be obtained, with respect to sense and antisense orientations, i.e., the segments, e.g., antibody heavy and light chains, can be joined head to tail, head to head, or tail to tail.

In one embodiment, overlap-extension tails enable the linkage of polynucleotide sequences generated during a polynucleotide synthesis reaction. For example, overlap extension tails can be introduced during the course of polynucleotide synthesis reactions, such as amplification or reverse transcription, by using primers carrying an overlap-extension tail. Alternatively, ligation reactions can be used. As shown in FIGS. 17, 18, 19, and 20, after annealing of complementary overlap extension tails, the DNA is filled-in in a 5' to 3' direction during the extension phase of a polynucleotide synthesis reaction, such as PCR, to generate a double stranded polynucleotide with the two polynucleotides of interest physically joined.

In some embodiments, an overlap-extension RT-PCR method allows the sequences to be linked simultaneously as the reaction proceeds in a single tube, thus eliminating the need for intermediate purification. In some embodiments, an overlap extension tail comprises a barcode sequence.

Figure 17:
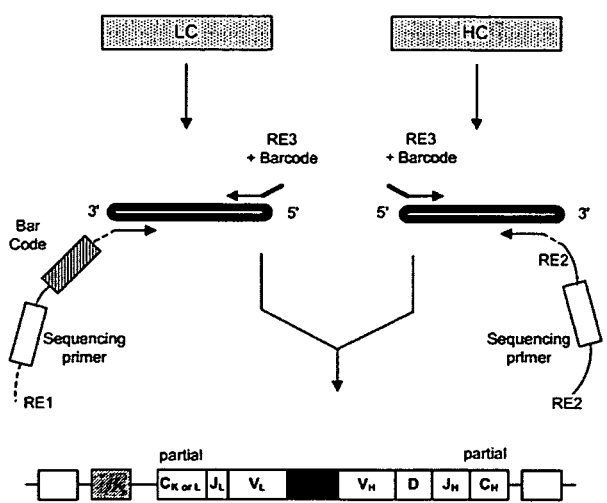
FIG. 17. Schematic overview of external barcode addition to a linked pair of antibody light and heavy chains. Shown are the products of a reverse transcription reaction. The LC gene specific PCR primer contains a bar code, sequencing primer site, and restriction site (RE1) to allow these elements to be added to the 3' end of the resulting PCR product. Primers specific for LC and HC with overlap-extensions and encoding a restriction site (RE3) are indicated. A reverse primer specific for HC containing a sequencing primer site and a restriction site (RE2) is also indicated. Amplification results in a nucleic acid with the linked structure shown with a bar code at one end.

FIG. 17 illustrates generally one example of the use of overlap-extension tails to join polynucleotide sequences encoding antibody light and heavy chains and to provide at least one barcode. Other methods useful for linking two polynucleotide sequences of interest are discussed below. In this example, after polynucleotide synthesis, e.g., reverse transcription, has occurred, the use of a LC gene specific PCR primer containing a barcode, optional sequencing primer site, and optional restriction site (RE1) allows these elements to be added to the end of the resulting PCR product. Primers specific for LC (in one embodiment the $V_L$ region) and HC (in one embodiment the $V_H$ region) with extension overlaps and encoding an optional restriction site (RE3) are indicated. In one embodiment, the LC comprises the rearranged VJ with or without a short segment of the constant region, and the HC comprises the rearranged V(D)J with or without a short segment of constant region of the heavy chain. In one embodiment, the overlap-extension primers also contain a barcode sequence. A reverse primer specific for HC containing an optional RE2 is also used. As amplification with these primers proceeds, a nucleic acid with the linked structure shown is generated with a barcode at one end. Products from reactions conducted in single samples can be easily integrated into the other work flows disclosed herein. For example, an optional second barcode can be added and used in conjunction with the first barcode to further enable multiplexing to identify large numbers of sequences using a relative minimum number of barcodes. For sequencing, a single barcode may be sufficient.

Variations of the general scheme shown in FIG. 17, examples of which are illustrated herein, will be apparent. For example, the barcode can be placed at the other end of the final product, or at both ends, or between the polynucleotides. Furthermore, a barcode can be included as part of the extension overlap region (e.g., on either side of RE3 or the barcode can be split by the RE3 sequence).

Figure 18:
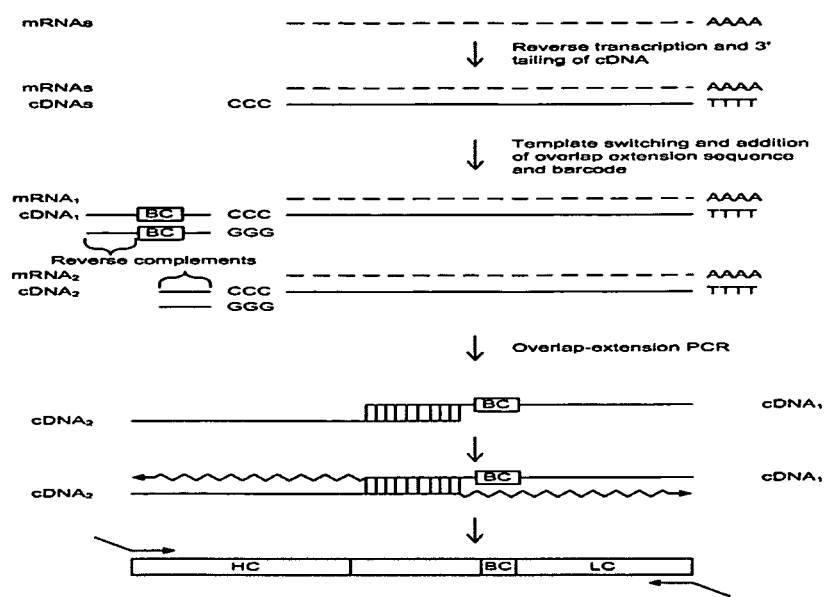
FIG. 18. Schematic overview of internal barcode addition to a linked pair of antibody light and heavy chains. Shown is a method of using adaptors containing extension overlap and barcode sequences to join cDNAs resulting from reverse transcription of mRNAs using oligo (dT) primers. The method shown takes advantage of the 3' tailing and template switching activities of reverse transcriptase to add overlap-extension sequences to the cDNAs to be joined. In this example, one of the adaptors adds both a barcode and overlap-extension sequence to one of the cDNAs to be joined, while only the overlap-extension sequence is added to the other cDNA to be joined. After amplification, a linked structure carrying one barcode sequence in between the linked cDNAs is generated.
Figure 19:
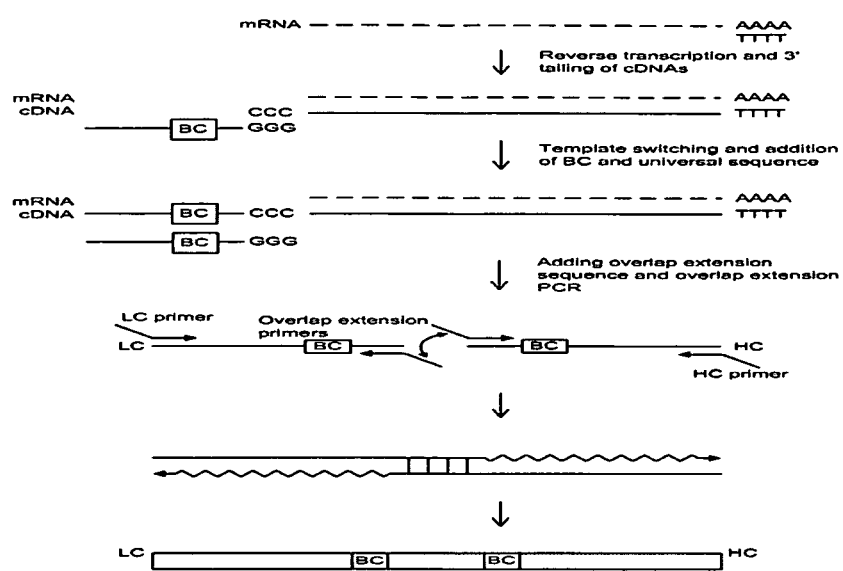
FIG. 19. Schematic overview of addition of two internal barcodes to a linked pair of antibody light and heavy chains using universal sequence overlap-extension primers. Shown is a method of using adaptors containing both a universal sequence and a barcode to join cDNAs resulting from reverse transcription of mRNAs using oligo (dT) primers. In this example, PCR primers to the universal sequence add an overlap-extension sequence to each of the cDNAs to be joined. After the amplification scheme shown, a linked structure carrying two barcodes in between the linked cDNAs is generated.
Figure 20:
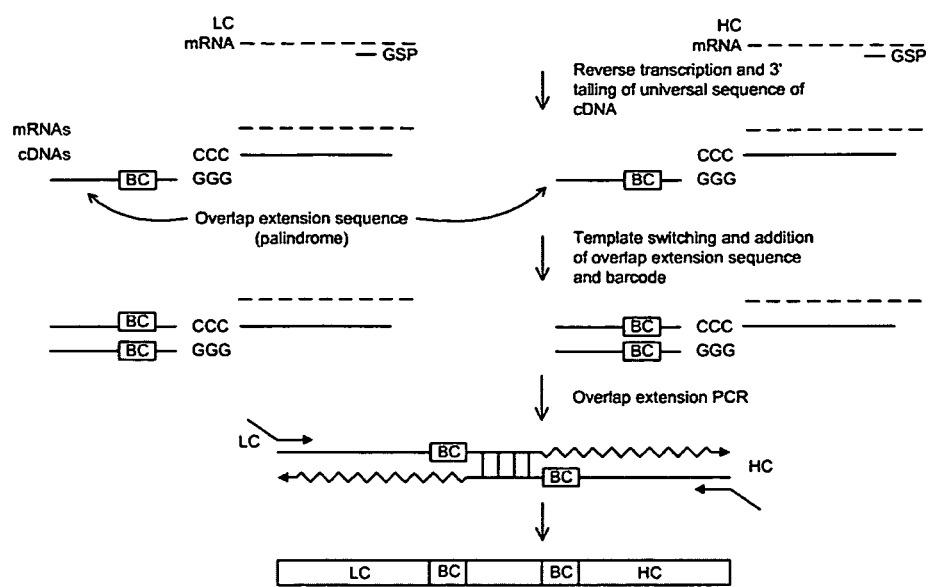
FIG. 20. Schematic overview of addition of two internal barcodes to a linked pair of antibody light and heavy chains using overlap-extension adaptors. Shown is a method of using adaptors containing both a barcode and overlap-extension sequence to join cDNAs resulting from reverse transcription of mRNAs using gene specific primers (GSP). In this example, the overlap extension sequences on the adaptors added to each of the cDNAs allow for joining of the cDNAs by annealing. After the amplification scheme shown, a linked structure carrying two barcodes in between the linked cDNAs is generated FIG. 21. Use of barcoded GSPs during reverse transcription in combination with template-switch added adaptors. RT was performed with total PBMC RNA and univ_seq_2 template-switching oligo and IgKC_v3 GSP (lanes 1-2) and IgLC_v5 GSP (lanes 3-4) with an additional 5' flanking sequence, of which the first part is the Fixed_PCR3 sequence, and the last 8 bp is a barcode. Aliquots of the RT reaction were used in subsequent PCR reactions, with either a 5' $V_K$ (lane 1) or $V_L$ (lane 3) primer or the Univ_seq_2 (lanes 2 and 4) as the 5' primer, and Fixed_PCR3 as the 3' primer. The PCR products in lanes 2 and 4 ran as a smear, showing that the barcoded GSPs are non-specific in the RT reaction, and are not suitable for use with template-switch added adaptors. From top to bottom: SEQ ID NOs: 796319 and 796622-796626.

LC (including $V_L$ sequences) and HC (including $V_H$ sequences) sequences can be derived through a variety of means. For example, they can be generated through reverse transcription of mRNA with either oligo dT or gene specific primers. In one embodiment, a reverse transcription and subsequent amplification reactions are performed simultaneously, i.e., an RT-PCR reaction, to arrive at the final product. When reverse transcription is used, the extension overlap region, as well as other elements, such as restriction sites, sequencing primer sites, or universal sequences, can be added via the annealing of an adaptor comprising one or more G residues to the one, two, three, or more C residues generated by the 3' tailing of cDNA generated in the reverse transcription reaction as shown, for example, in FIGS. 18, 19, and 20. Template switching by the reverse transcriptase allows an extension overlap region (and other sequence elements) to be added to the cDNA. For example, as shown in FIG. 18, when taking advantage of the 3' tailing and template switching activities of reverse transcriptase, a first adaptor can be used to add an extension overlap sequence and a barcode to a first polynucleotide of interest, while a second adaptor with a sequence complementary to the overlap-extension of the first adaptor can be added to a second cDNA of interest. The complementary extension overlap sequences anneal during a subsequent nucleic acid synthesis reaction, such as PCR, to join the two polynucleotides of interest. Extension from the point of overlap results in a double stranded DNA molecule in which the two polynucleotides of interest are linked with a barcode between them. Variations that allow the generation of two internally located barcodes between two linked polynucleotide sequences are shown in FIGS. 19 and 20.

Other methods for joining or linking the polynucleotide sequences of interest include by ligation. In this embodiment, the primer mix used for the amplification is designed such that the amplified target sequences can be cleaved with appropriate restriction enzymes, and covalent linkage by DNA ligation can be performed. Following amplification with such a primer mix, the restriction enzymes needed to form compatible ends of the target sequences, are added to the mixture. Target sequences are then ligated together with a ligase. No purification of the PCR products is needed prior to either the restriction enzyme digest or ligation steps, although purification may be performed.

In another embodiment, the polynucleotide sequences of interest can be linked by recombination. In this approach, the amplified polynucleotide sequences of interest can be joined using identical recombination sites. Linkage is performed by adding the appropriate recombinase to facilitate recombination. Suitable recombinase systems include Flp recombinase with a variety of FRT sites, Cre recombinase with a variety of lox sites, integrase ΦC31 which carries out recombination between the attP site and the attB site, the β-recombinase-six system as well as the Gin-gix system. Linkage by recombination has been exemplified for two nucleotide sequences ($V_H$ linked with $V_L$) (Chapal, N. et al. 1997 BioTechniques 23, 518-524), hereby incorporated by reference.

Accordingly, in one aspect, the method comprises amplifying by PCR or RT-PCR amplification, nucleotide sequences of interest using a template derived from an isolated single cell or a population of isogenic cells and (1) effecting linkage of the amplified nucleotide sequences of interest and (2) adding one more barcodes to the linked polynucleotide sequences. The method comprises an optional step of performing an additional amplification of the linked products to, for example, add additional barcodes, restriction sites, sequencing primer sites, and the like.

In another aspect, a method of producing a library of barcoded linked pairs comprising antibody heavy and light chains from single cells from a donor is provided. This aspect comprises providing a lymphocyte-containing cell fraction from a donor, which is optionally enriched for a particular lymphocyte population from said cell fraction. Further, a population of isolated single cells is obtained by distributing cells from the lymphocyte-containing cell fraction, or the enriched cell fraction, individually among a plurality of vessels, containers, or wells. Multiplex molecular amplification (e.g., multiplex RT-PCR amplification) of the variable region encoding sequences contained in the population of isolated single cells is performed and linkage of pairs of heavy and light chains and barcode addition is affected, wherein an individual pair is derived from a single cell. Further, in different embodiments, the method can comprise two optional steps: in the first step, the individual isolated single cell in the population of single cells can be expanded to a population of isogenic cells prior to performing multiplex RT-PCR amplification, thereby providing a plurality of vessels, containers, or wells with a population of isogenic cells (one population of isogenic cells in one vessel, container, or well). Another optional step encompasses performing an additional amplification of the linked light and heavy chain encoding sequences. This additional amplification step can be used to simply increase the amount of the linked nucleic acid, or to add a first or second barcode sequence or other sequence elements to the linked nucleic acid.

In some aspects, the multiplex RT-PCR amplification can be performed either as a two-step process, where reverse transcription (RT) is performed separate from the multiplex PCR amplification (or alternative multiplex molecular amplification), or as a single-step process, where the RT and multiplex PCR amplification steps are performed with the same primers in one tube.

The reverse transcription (RT) is performed with an enzyme containing reverse transcriptase activity resulting in the generation of cDNA from total RNA, mRNA or target specific RNA from an isolated single cell. Primers which can be utilized for the reverse transcription include oligo-dT primers, random hexamers, random decamers, other random primers, or primers that are specific for the nucleotide sequences of interest. In some embodiments, such primers can contain elements such as barcodes, universal priming sites, restriction sites, sequencing primer sites, and the like.

The two-step multiplex RT-PCR amplification procedure allows for the cDNA generated in the RT step to be distributed to more than one vessel allowing for the storage of a template fraction before proceeding with the amplification, if desired. Additionally, the distribution of cDNA to more than one tube, allows for the performance of more than one multiplex PCR amplification of nucleic acid derived from the same template. This two-step approach can for example be used to amplify and link heavy chain variable region and kappa light chain variable region encoding sequences in one tube and heavy chain variable region and lambda light chain variable region encoding sequences in a different tube utilizing the same template. A single cell usually only expresses one of the light chains. However, it will often be easier to perform the reactions simultaneously instead of awaiting the result of one of the reactions before performing the other. Further, the amplification of both kappa and lambda serves as an internal negative control, since it would be expected that only kappa or lambda would amplify from a single cell.

In the single-step multiplex RT-PCR procedure, reverse transcription and multiplex PCR amplification is carried out in the same vessel, container, or well. All the components necessary to perform both the reverse transcription and the multiplex PCR in a single step are initially added into the vessels, containers, or wells and the reaction is performed. Generally, there is no need to add additional components once the reaction has been started. The advantage of single-step multiplex RT-PCR amplification is that it reduces the number of steps necessary to generate the barcode linked nucleotide sequences of the present invention even further. This is particularly useful when performing multiplex RT-PCR on an array of single cells, where the same reaction is carried out in a plurality of vessels. Generally, the composition needed for the single-step multiplex RT-PCR comprises a nucleic acid template, an enzyme with reverse transcriptase activity, an enzyme with DNA polymerase activity, deoxynucleoside triphosphate mix (dNTP mix comprising dATP, dCTP, dGTP and dTTP) and a multiplex primer mix. The nucleic acid template is preferably total RNA or mRNA derived from an isolated single cell either in a purified form, as a lysate of the cell, or as contained in the intact cell.

In one aspect, the methods generate libraries of linked and barcoded polynucleotides of interest. In some aspects, the plurality of polynucleotide compositions in a polynucleotide library can comprise at least 2, at least 3, at least 10, at least 30, at least 100, at least 300, at least 1000, at least 3000, at least 10,000, at least 30,000, at least 100,000, at least 300,000, at least 1,000,000, at least 3,000,000, at least 10,000,000, at least 30,000,000, or more members. In other aspects, the plurality of polynucleotide compositions in a polynucleotide library can comprise at least 2, at least 3, at least 10, at least 30, at least 100, at least 300, at least 1000, at least 3000, at least 10,000, at least 30,000, or more genes of a cell sample's whole transcriptome. In other aspects, the plurality of polynucleotide compositions in a polynucleotide library comprises at least 1, at least 2, at least 3, at least 10, at least 30, at least 100, at least 300, at least 1000, at least 10,000, at least 100,000, at least 1,000,000, at least 10,000,000, at least 1,000,000,000 or more of the different antibody species present in the blood of an individual. These the antibody species can be expressed by plasmablasts, plasma cells, memory B cells, long-lived plasma cells, naïve B cells, other B lineage cells, or combinations thereof.

The linked and barcoded polynucleotide compositions generated by the methods disclosed above can advantageously be subjected to high throughout, multiplexed sequencing, preferably, using NextGen sequencing platforms as described herein.

The linked and barcoded polynucleotide compositions generated by the methods disclosed above can also used for cloning, producing polypeptides of interest, and screening as disclosed herein.

Methods of Producing One or More Polynucleotides of Interest for Sequencing

In some aspects, the method includes obtaining a polynucleotide library comprising a plurality of polynucleotides, wherein each polynucleotide comprises a universal primer region, a sample identification region, an adapter region, and an amplicon region derived from a single sample, wherein the sequence of the universal primer region is substantially identical on each polynucleotide in the plurality of polynucleotides, and wherein the sequence of the sample identification region of each polynucleotide derived from a first single sample is distinct from the sequence of the sample identification region of the other polynucleotides in the library derived from one or more samples distinct from the first single sample; and amplifying the polynucleotide library with a set of primers to produce the one or more polynucleotides of interest for sequencing, wherein the one or more polynucleotides of interest for sequencing comprises a first sequencing region, a first plate identification region, a universal primer region, a sample identification region, an adapter region, an amplicon region derived from a single sample, and a second sequencing region.

In some aspects, a method further includes sequencing the one or more polynucleotides of interest. In some aspects, the sequencing is 454 sequencing.

In some aspects, sequencing includes longer sequencing reads such that the forward and reverse sequencing reads overlap enough to enable reconstruction of the entire, approximately 600 base pair (bp) sequence of, e.g., antibody light chains (LCs) (where exact sequence length can depend on the length of the 5' untranslated region (UTR)), and approximately 700 bp sequence of the heavy chains (HCs). Therefore, in some aspects, any sequencing technology that can yield sequencing reads of at least 350-400 bp and thereby achieve the overlap included for sequence assembly can be used, and sequencing technologies that enable 600-700+ bp reads would allow one to sequence using just a forward primer (sequencing from the 5' end).

Any technique for sequencing nucleic acid known to those skilled in the art can be used. DNA sequencing techniques include classic dideoxy sequencing reactions (Sanger method) using labeled terminators or primers and gel separation in slab or capillary electrophoresis. In a preferred embodiment, next generation (NextGen) sequencing platforms are advantageously used in the practice of the invention. NextGen sequencing refers to any of a number of post-classic Sanger type sequencing methods which are capable of high throughput, multiplex sequencing of large numbers of samples simultaneously. Current NextGen sequencing platforms, such as those described in greater detail below, are capable of generating reads from multiple distinct nucleic acids in the same sequencing run. Throughput is varied, with 100 million bases to 600 giga bases per run, and throughput is rapidly increasing due to improvements in technology. The principle of operation of different NextGen sequencing platforms is also varied and can include: sequencing by synthesis using reversibly terminated labeled nucleotides, pyrosequencing, 454 sequencing, allele specific hybridization to a library of labeled oligonucleotide probes, sequencing by synthesis using allele specific hybridization to a library of labeled clones that is followed by ligation, real time monitoring of the incorporation of labeled nucleotides during a polymerization step, polony sequencing, single molecule real time sequencing, and SOLiD sequencing. Sequencing has been demonstrated by sequential or single extension reactions using polymerases or ligases as well as by single or sequential differential hybridizations with libraries of probes. These reactions have been performed on many clonal sequences in parallel including demonstrations in current commercial applications of over 100 million sequences in parallel. These sequencing approaches can thus be used to study the repertoire of T-cell receptor (TCR) and/or B-cell receptor (BCR) and other sequences of interest.

The sequencing techniques can generate at least 1000 reads per run, at least 10,000 reads per run, at least 100,000 reads per run, at least 500,000 reads per run, or at least 1,000,000 reads per run.

The sequencing techniques can generate about 30 bp, about 40 bp, about 50 bp, about 60 bp, about 70 bp, about 80 bp, about 90 bp, about 100 bp, about 110, about 120 bp per read, about 150 bp, about 200 bp, about 250 bp, about 300 bp, about 350 bp, about 400 bp, about 450 bp, about 500 bp, about 550 bp, about 600 bp, about 650 bp, or about 700 bp or more by per read.

The sequencing techniques can generate at least 30, 40, 50, 60, 70, 80, 90, 100, 110, 120, 150, 200, 250, 300, 350, 400, 450, 500, 550, 600, 650, 700 or more nucleotides per read.

A sequencing technique that can be used, for example, Helicos True Single Molecule Sequencing (tSMS) (Harris T. D. et al. (2008) Science 320:106-109). In the tSMS technique, a DNA sample is cleaved into strands of approximately 100 to 200 nucleotides, and a polyA sequence is added to the 3' end of each DNA strand. Each strand is labeled by the addition of a fluorescently labeled adenosine nucleotide. The DNA strands are then hybridized to a flow cell, which contains millions of oligo-T capture sites that are immobilized to the flow cell surface. The templates can be at a density of about 100 million templates/cm$^2$. The flow cell is then loaded into an instrument, e.g., HeliScope™ sequencer, and a laser illuminates the surface of the flow cell, revealing the position of each template. A CCD camera can map the position of the templates on the flow cell surface. The template fluorescent label is then cleaved and washed away. The sequencing reaction begins by introducing a DNA polymerase and a fluorescently labeled nucleotide. The oligo-T nucleic acid serves as a primer. The polymerase incorporates the labeled nucleotides to the primer in a template directed manner. The polymerase and unincorporated nucleotides are removed. The templates that have directed incorporation of the fluorescently labeled nucleotide are detected by imaging the flow cell surface. After imaging, a cleavage step removes the fluorescent label, and the process is repeated with other fluorescently labeled nucleotides until the desired read length is achieved. Sequence information is collected with each nucleotide addition step.

Another example of a DNA sequencing technique that can be used is 454 sequencing (Roche) (Margulies, M et al. 2005, Nature, 437, 376-380). 454 sequencing involves two steps. In the first step, DNA is sheared into fragments of approximately 300-800 base pairs, and the fragments are blunt ended. Oligonucleotide adaptors are then ligated to the ends of the fragments. The adaptors serve as primers for amplification and sequencing of the fragments. The fragments can be attached to DNA capture beads, e.g., streptavidin-coated beads using, e.g., Adaptor B, which contains 5'-biotin tag. The fragments attached to the beads are PCR amplified within droplets of an oil-water emulsion. The result is multiple copies of clonally amplified DNA fragments on each bead. In the second step, the beads are captured in wells (pico-liter sized). Pyrosequencing is performed on each DNA fragment in parallel. Addition of one or more nucleotides generates a light signal that is recorded by a CCD camera in a sequencing instrument. The signal strength is proportional to the number of nucleotides incorporated.

Pyrosequencing makes use of pyrophosphate (PPi) which is released upon nucleotide addition. PPi is converted to ATP by ATP sulfurylase in the presence of adenosine 5' phosphosulfate. Luciferase uses ATP to convert luciferin to oxyluciferin, and this reaction generates light that is detected and analyzed.

Another example of a DNA sequencing technique that can be used is SOLiD technology (Applied Biosystems). In SOLiD sequencing, genomic DNA is sheared into fragments, and adaptors are attached to the 5' and 3' ends of the fragments to generate a fragment library. Alternatively, internal adaptors can be introduced by ligating adaptors to the 5' and 3' ends of the fragments, circularizing the fragments, digesting the circularized fragment to generate an internal adaptor, and attaching adaptors to the 5' and 3' ends of the resulting fragments to generate a mate-paired library. Next, clonal bead populations are prepared in microreactors containing beads, primers, template, and PCR components. Following PCR, the templates are denatured and beads are enriched to separate the beads with extended templates. Templates on the selected beads are subjected to a 3' modification that permits bonding to a glass slide.

The sequence can be determined by sequential hybridization and ligation of partially random oligonucleotides with a central determined base (or pair of bases) that is identified by a specific fluorophore. After a color is recorded, the ligated oligonucleotide is cleaved and removed and the process is then repeated.

Another example of a sequencing technology that can be used is SOLEXA sequencing (Illumina). SOLEXA sequencing is based on the amplification of DNA on a solid surface using fold-back PCR and anchored primers. Genomic DNA is fragmented, and adapters are added to the 5' and 3' ends of the fragments. DNA fragments that are attached to the surface of flow cell channels are extended and bridge amplified. The fragments become double stranded, and the double stranded molecules are denatured. Multiple cycles of the solid-phase amplification followed by denaturation can create several million clusters of approximately 1,000 copies of single-stranded DNA molecules of the same template in each channel of the flow cell. Primers, DNA polymerase and four fluorophore-labeled, reversibly terminating nucleotides are used to perform sequential sequencing. After nucleotide incorporation, a laser is used to excite the fluorophores, and an image is captured and the identity of the first base is recorded. The 3' terminators and fluorophores from each incorporated base are removed and the incorporation, detection and identification steps are repeated.

Another example of a sequencing technology that can be used includes the single molecule, real-time (SMRT™) technology of Pacific Biosciences. In SMRT, each of the four DNA bases is attached to one of four different fluorescent dyes. These dyes are phospholinked. A single DNA polymerase is immobilized with a single molecule of template single stranded DNA at the bottom of a zero-mode waveguide (ZMW). A ZMW is a confinement structure which enables observation of incorporation of a single nucleotide by DNA polymerase against the background of fluorescent nucleotides that rapidly diffuse in an out of the ZMW (in microseconds). It takes several milliseconds to incorporate a nucleotide into a growing strand. During this time, the fluorescent label is excited and produces a fluorescent signal, and the fluorescent tag is cleaved off. Detection of the corresponding fluorescence of the dye indicates which base was incorporated. The process is repeated.

Another example of a sequencing technique that can be used is nanopore sequencing (Soni G V and Meller A. (2007) Clin Chem 53: 1996-2001). A nanopore is a small hole, of the order of 1 nanometer in diameter. Immersion of a nanopore in a conducting fluid and application of a potential across it results in a slight electrical current due to conduction of ions through the nanopore. The amount of current which flows is sensitive to the size of the nanopore. As a DNA molecule passes through a nanopore, each nucleotide on the DNA molecule obstructs the nanopore to a different degree. Thus, the change in the current passing through the nanopore as the DNA molecule passes through the nanopore represents a reading of the DNA sequence.

Another example of a sequencing technique that can be used involves using a chemical-sensitive field effect transistor (chemFET) array to sequence DNA (for example, as described in US Patent Application Publication No. 20090026082). In one example of the technique, DNA molecules can be placed into reaction chambers, and the template molecules can be hybridized to a sequencing primer bound to a polymerase. Incorporation of one or more triphosphates into a new nucleic acid strand at the 3' end of the sequencing primer can be detected by a change in current by a chemFET. An array can have multiple chemFET sensors. In another example, single nucleic acids can be attached to beads, and the nucleic acids can be amplified on the bead, and the individual beads can be transferred to individual reaction chambers on a chemFET array, with each chamber having a chemFET sensor, and the nucleic acids can be sequenced.

Another example of a sequencing technique that can be used involves using an electron microscope (Moudrianakis E. N. and Beer M. Proc Natl Acad Sci USA. 1965 March; 53:564-71). In one example of the technique, individual DNA molecules are labeled using metallic labels that are distinguishable using an electron microscope. These molecules are then stretched on a flat surface and imaged using an electron microscope to measure sequences.

In some aspects, obtaining the polynucleotide library comprises preparing the polynucleotide library in a laboratory. In some aspects, obtaining the polynucleotide library comprises receiving the polynucleotide library directly or indirectly from a third party that has prepared the polynucleotide library.

Methods for Analyzing Sequencing Data

In some aspects, the method includes obtaining a dataset associated with a plurality of polynucleotides, wherein the dataset comprises sequencing data for the plurality of polynucleotides, wherein each polynucleotide in the plurality of polynucleotides comprises a sample identification region, and wherein each sample identification region on each polynucleotide is unique to a single sample, wherein the sequence of the sample identification region of each polynucleotide derived from a first single sample is distinct from the sequence of the sample identification region of the other polynucleotides in the plurality of polynucleotides derived from one or more samples distinct from the first single sample; and analyzing the dataset to match together polynucleotides with identical sample identification regions, wherein a match indicates that the polynucleotides originated from the same sample.

In some aspects each polynucleotide in the plurality of polynucleotides further comprises a first plate identification region, wherein each combination of each first plate identification region and sample identification region on each polynucleotide is unique to a single sample, wherein the sequence of the first plate identification region of each polynucleotide derived from a first set of single samples is distinct from the sequence of the first plate identification region of the other polynucleotides in the plurality of polynucleotides derived from one or more single sample sets distinct from the first set of single samples, and further comprising analyzing the dataset to match together polynucleotides with identical first plate identification regions and identical sample identification regions, wherein a match between both regions indicates that the polynucleotides originated from the same sample.

In some aspects, both polynucleotides include a variable region. In some aspects, one polynucleotide includes a variable region. In some aspects, neither polynucleotide includes a variable region.

In some aspects, obtaining the dataset comprises obtaining the plurality of polynucleotides and sequencing the plurality of polynucleotides to experimentally determine the dataset. In some aspects, obtaining the dataset comprises receiving the dataset directly or indirectly from a third party that has sequenced the plurality of polynucleotides to experimentally determine the dataset. In some aspects, the dataset is stored on an electronic storage medium. In some aspects, the dataset is transferred over the Internet.

In some aspects, the method is implemented on a computer, e.g., it is a computer-implemented method.

In some aspects, the single sample is a single cell. In some aspects, the single sample comprises a single cell. In some aspects, the single sample comprises a single B cell. In some aspects, the single sample comprises a plurality of B cells. In some aspects, the single sample comprises a single B cell and one or more other cells.

In some aspects, data generated from sequencing (e.g., 454 sequencing) can be analyzed by 454 GS FLX data analysis software, and sequences with poor-quality scores can be filtered out. Good-quality sequences can then be subdivided according to their sample identification region (and in some embodiments the combination of their sample identification region and plate identification region) by using a script in Python before sequences are assembled using bioinformatics approaches, for example, by using Newbler. Because reverse reads can have only a second plate identification region in some aspects, it is possible that sequence assembly could occur between forward and reverse reads of sequences from different cells. For circumventing this potential problem, the heavy- and light-chain V(D)J usage of both forward and reverse reads can first be identified using HighV-QUEST. Sequences can then be further grouped according to their V(D)J usage before being assembled. In some aspects, sequence assembly can be intolerant of nucleotide mismatches, thereby preventing assembly of forward and reverse reads from different cells that share the same V(D)J usage. In some aspects, sequences can then be clustered together based on their V(D)J usage by using a computer program.

In some aspects, bioinformatics methods may be used to identify groups of sequences forming clonal families and subfamilies, and thereby immunoglobulin sequences of interest. Such bioinformatics methods involve measurements of sequence similarity. Such bioinformatics methods may be used to identify sequences of interest derived from an individual human, derived from one or more humans, derived from one or more humans with a condition, or derived from one or more humans with different conditions.

In some aspects, related immunoglobulin heavy and/or light chain sequences can be identified through computational phylogenetic analysis of the homology between the immunoglobulin heavy chain and/or light chain V(D)J sequences. In some aspects, standard classification methods (i.e. clustering) of the sequences representing the individual or combinations of the V, D, and/or J gene segments and/or other sequences derived from the immunoglobulin heavy chain and/or light chain can be used to identify clonal families or subfamilies (for example, by using ClustalX).

As used herein "clonal family" refers to a plurality of immunoglobulin sequences each having V, D, and/or J regions, wherein each sequence is a mutated version of the same germline immunoglobulin sequence having a V, D, and/or J region or the germline immunoglobulin sequence having the V, D, and/or J region. In some aspects, the plurality is a plurality of heavy chain sequences. In some aspects, the plurality is a plurality of light chain sequences. In some aspects, the plurality is a plurality of paired heavy and light chain sequences. In some aspects, each sequence has V, D, and J regions. In some aspects, each sequence has V and D regions. In some aspects, each sequence has D and J regions. In some aspects, each sequence has V and J regions. In some aspects, each sequence has a V region. In some aspects, each sequence has a D region. In some aspects, each sequence has a J region. In some aspects, the one or more mutations are located within the V, D, and/or J regions. In some aspects, the one or more mutations are located between the V, D, and/or J regions.

In some aspects, a set of antibodies whose heavy chains all use the same V and J gene segments are a clonal family. In some aspects, a set of antibodies whose heavy chains all use the same V and J gene segments and whose sum of the length of P/N nucleotides and D nucleotides are of the same length are a clonal family. In some aspects, a set of antibodies whose heavy chains all use the same V, D and J gene segments are a clonal family. In some aspects, a set of antibodies whose heavy chains all use the same V, D and J gene segments, and whose P/N nucleotides between the V and D gene segments are the same length, and whose P/N nucleotides between the D and J gene segments are the same length, are a clonal family. In some aspects, a set of antibodies whose heavy chains all use the same V and J gene segments and whose light chains all use the same V and J gene segments are a clonal family. In some aspects, a set of antibodies whose heavy chains all use the same V and J gene segments and whose sum of the length of P/N nucleotides and D nucleotides are of the same length, and whose light chains all use the same V and J gene segments and whose P/N nucleotides are of the same length, are a clonal family. In some aspects, a set of antibodies whose heavy chains all use the same V, D and J gene segments and whose light chains all use the same V and J gene segments are a clonal family. In some aspects, a set of antibodies whose heavy chains all use the same V, D and J gene segments, and whose P/N nucleotides between the V and D gene segments are the same length, and whose P/N nucleotides between the D and J gene segments are the same length, and whose light chains all use the same V and J gene segments, and whose P/N nucleotides between the V and J gene segments are the same length, are a clonal family.

Methods for Constructing Clonal Families

The V, D and J usage for a T cell receptor (TCR) or an immunoglobulin variable gene query sequence can be determined by identifying the germline V, D (if applicable) and J gene segments most likely to have given rise to the sequence. D segments are present in some TCR and immunoglobulin sequences (e.g. TCRβ, TCRδ and antibody heavy chain sequences) but not others (e.g TCRα, TCRγ and antibody light chain sequences). The following description includes D segments but the same approaches can be applied to variable region sequences that lack D segments. In all cases the determination of V(D)J usage uses a reference database of germline V, D and J gene segment sequences such as IMGT/GENE-DB (Giudicelli V, Chaume D, Lefranc M P. IMGT/GENE-DB: a comprehensive database for human and mouse immunoglobulin and T cell receptor genes. Nucleic Acids Res. 2005 Jan. 1; 33(Database issue): D256-61.).

In one approach to determination of V(D)J usage, the query sequence is compared serially to each V, D and J germline gene segment separately and the most similar gene segment of each type (V, D or J) is selected as the most likely to have given rise to the query sequence. V-QUEST and High V-QUEST are examples of this approach (Giudicelli V, Chaume D, Lefranc M P. IMGT/V-QUEST, an integrated software program for immunoglobulin and T cell receptor V-J and V-D-J rearrangement analysis. Nucleic Acids Res. 2004 Jul. 1; 32(Web Server issue):W435-40; Brochet X, Lefranc M P, Giudicelli V. IMGT/V-QUEST: the highly customized and integrated system for IG and TR standardized V-J and V-D-J sequence analysis. Nucleic Acids Res. 2008 Jul. 1; 36(Web Server issue):W503-8.). V-QUEST first generates pairwise alignments for the query sequence and each V gene segment sequence. Then it generates pairwise alignments for the query sequence region downstream of the deduced 3' end of the V segment and each J gene segment sequence. If a D segment is present, V-QUEST then generates pairwise alignments for the query sequence region found between the regions matching V and J segments and each D gene segment sequence. V-QUEST can also infer the boundaries of the V-D, V-J and/or D-J junction regions.

In another approach to determination of V(D)J usage, the combination of germline V, D and J segments most likely to have given rise to the query sequence is identified in a single step rather than in three separate steps for V, D and J respectively. This approach has the advantage that the identification of one type of segment (V, D or J) can take into account information about the potential matches to the other two types of segments. For example, the best matching D segment might depend upon which V segment match is being considered. SoDA is an example of this approach (Volpe J M, Cowell L G, Kepler T B. SoDA: implementation of a 3D alignment algorithm for inference of antigen receptor recombinations. Bioinformatics. 2006 Feb. 15; 22(4): 438-44.). SoDA first selects candidate V, D and J segments. It generates pairwise local alignments for the query sequence and each V gene segment sequence and then keeps only the V segments with alignments meeting a score threshold. It repeats these steps for the J segments and D segments. Then an optimal alignment is generated for each possible combination of candidate V, D and J segments. The alignments are generated using the same general dynamic programming approach widely used in sequence alignment (Needleman, S. B. and Wunsch, C.D. (1970) A general method applicable to the search for similarities in the amino acid sequence of two proteins. J. Mol. Biol., 48, 443-453.), but allowing for the insertion of additional nucleotides at the V-D, V-J and/or D-J junctions. Such insertion commonly takes place during the biological process of V(D)J recombination. In sequence alignment by dynamic programming there are typically penalty scores associated with insertions, deletions and mismatches. However, in this approach to determining V(D)J usage, no penalties are applied for the insertion of nucleotides at the junctions between segments. TheV(D)J combination yielding the highest-scoring alignment is selected to indicate the V(D)J usage for the query sequence. This approach can also identify the boundaries of junction sequence regions.

From the clonal families and subfamilies, a variety of approaches can be used to select specific clones for expression of their encoded paired heavy and light chain immunoglobulin genes and characterization of their binding properties. In some aspects, the highest frequency clones from clonal families and/or clonal subfamilies as well as other representative clones from clonal families and subfamilies are expressed and screened for their binding properties. Clones may also be randomly selected, from all clones, from all or select clonal families, and/or from all or select clonal subfamilies for expression and characterization of their binding characteristics. Clones may also be selected based on possessing larger numbers of variations in the variable region of the antibody. A phylogenetic tree may be constructed, and clones may be selected based on features of the phylogenetic tree, for example by descending the tree always choosing the branch with the largest number of leaf nodes underneath.

In some aspects, a method further includes selecting one or more polynucleotides for cloning.

Methods for Identifying a Second Polynucleotide of Interest Based on Selection of a First Polynucleotide of Interest In some aspects, the method includes obtaining a dataset associated with a plurality of polynucleotides, wherein the dataset comprises sequencing data for the plurality of polynucleotides, wherein each polynucleotide in the plurality of polynucleotides comprises a sample identification region, and wherein each sample identification region on each polynucleotide is unique to a single sample thereby associating each polynucleotide in the plurality of polynucleotides with a distinct single sample, wherein the sequence of the sample identification region of each polynucleotide derived from a first single sample is distinct from the sequence of the sample identification region of the other polynucleotides in the plurality of polynucleotides derived from one or more samples distinct from the first single sample; and selecting a first polynucleotide of interest associated with a first single sample from the dataset and identifying a second polynucleotide of interest in the first single sample based on the sample identification region of the first polynucleotide of interest.

In some aspects, each polynucleotide in the plurality of polynucleotides further comprises a first plate identification region, wherein each combination of each first plate identification region and sample identification region on each polynucleotide is unique to a single sample, wherein the sequence of the first plate identification region of each polynucleotide derived from a first set of single samples is distinct from the sequence of the first plate identification region of the other polynucleotides in the plurality of polynucleotides derived from one or more single sample sets distinct from the first set of single samples, and further comprising identifying a second polynucleotide of interest in the first single sample based on the sample identification region and first plate identification region of the first polynucleotide of interest.

In some aspects, both polynucleotides include a variable region. In some aspects, one polynucleotide includes a variable region. In some aspects, neither polynucleotide includes a variable region.

In some aspects, the method is implemented on a computer, e.g., it is a computer-implemented method.

In some aspects, the first single sample comprises a B cell. In some aspects, the first single sample comprises a single B cell and one or more other cells. In some aspects, the first single sample comprises a plurality of B cells. In some aspects, the first single sample comprises a B cell, wherein the first polynucleotide of interest comprises an antibody heavy chain nucleotide sequence, and wherein the second polynucleotide of interest comprises an antibody light chain nucleotide sequence. In some aspects, the first single sample comprises a B cell, wherein the first polynucleotide of interest comprises an antibody light chain nucleotide sequence, and wherein the second polynucleotide of interest comprises an antibody heavy chain nucleotide sequence.

In some aspects, obtaining the dataset comprises obtaining the plurality of polynucleotides and sequencing the plurality of polynucleotides to experimentally determine the dataset. In some aspects, obtaining the dataset comprises receiving the dataset directly or indirectly from a third party that has sequenced the plurality of polynucleotides to experimentally determine the dataset. In some aspects, the dataset is stored on an electronic storage medium.

Methods of Producing One or More Polynucleotides of Interest for Cloning

In some aspects, the method includes obtaining a polynucleotide library comprising a plurality of polynucleotides, wherein each polynucleotide comprises a universal primer region, a sample identification region, an adapter region, and an amplicon region derived from a single sample, wherein the sequence of the universal primer region is substantially identical on each polynucleotide in the plurality of polynucleotides, and wherein the sequence of the sample identification region of each polynucleotide derived from a first single sample is distinct from the sequence of the sample identification region of the other polynucleotides in the library derived from one or more samples distinct from the first single sample; and amplifying the polynucleotide library with a set of primers to produce the one or more polynucleotides of interest for cloning, wherein the one or more polynucleotides of interest for cloning comprises a first restriction site region, a universal primer region, a sample identification region, an adapter region, an amplicon region derived from a single sample, and a second restriction site region.

In some aspects, obtaining the polynucleotide library comprises preparing the polynucleotide library in a laboratory. In some aspects, obtaining the polynucleotide library comprises receiving the polynucleotide library directly or indirectly from a third party that has prepared the polynucleotide library.

In some aspects, a methods further include cloning one or more polynucleotides, e.g., into a vector disclosed herein.

Methods of Producing a Molecule of Interest

In some aspects, the method includes obtaining a host cell comprising a polynucleotide of interest; and culturing the host cell under conditions sufficient to produce the molecule of interest.

In some aspects, obtaining the host cell comprises preparing the host cell comprising the polynucleotide in a laboratory. In some aspects, obtaining the host cell comprises receiving the host cell comprising the polynucleotide directly or indirectly from a third party that has prepared the host cell.

In some aspects, the molecule of interest is a polypeptide. In some aspects, the molecule of interest is an antibody. In some aspects, the molecule of interest is a human monoclonal antibody.

In some aspects, the method further includes collecting the molecule of interest.

In some aspects, it is desirable to "refold" certain polypeptides, e.g., polypeptides comprising one or more ABP components or the ABP itself. In certain embodiments, such polypeptides are produced using expression systems discussed herein. In certain embodiments, polypeptides are "refolded" and/or oxidized to form desired tertiary structure and/or to generate disulfide linkages. In certain embodiments, such structure and/or linkages are related to certain biological activity of a polypeptide. In certain embodiments, refolding is accomplished using any of a number of procedures known in the art. Exemplary methods include, but are not limited to, exposing the solubilized polypeptide agent to a pH typically above 7 in the presence of a chaotropic agent. An exemplary chaotropic agent is guanidine. In certain embodiments, the refolding/oxidation solution also contains a reducing agent and the oxidized form of that reducing agent. In certain embodiments, the reducing agent and its oxidized form are present in a ratio that will generate a particular redox potential that allows disulfide shuffling to occur. In certain embodiments, such shuffling allows the formation of cysteine bridges. Exemplary redox couples include, but are not limited to, cysteine/cystamine, glutathione/dithiobisGSH, cupric chloride, dithiothreitol DTT/dithiane DTT, and 2-mercaptoethanol (bME)/dithio-bME. In certain embodiments, a co-solvent is used to increase the efficiency of refolding. Exemplary cosolvents include, but are not limited to, glycerol, polyethylene glycol of various molecular weights, and arginine.

In certain embodiments, one substantially purifies a polypeptide, e.g., a polypeptide comprising one or more ABP components or the ABP itself. Certain protein purification techniques are known to those of skill in the art. In certain embodiments, protein purification involves crude fractionation of polypeptide fractionations from non-polypeptide fractions. In certain embodiments, polypeptides are purified using chromatographic and/or electrophoretic techniques. Exemplary purification methods include, but are not limited to, precipitation with ammonium sulphate; precipitation with PEG; immunoprecipitation; heat denaturation followed by centrifugation; chromatography, including, but not limited to, affinity chromatography (e.g., Protein-A-Sepharose), ion exchange chromatography, exclusion chromatography, and reverse phase chromatography; gel filtration; hydroxyapatite chromatography; isoelectric focusing; polyacrylamide gel electrophoresis; and combinations of such and other techniques. In certain embodiments, a polypeptide is purified by fast protein liquid chromatography or by high pressure liquid chromotography (HPLC). In certain embodiments, purification steps can be changed or certain steps can be omitted and still result in a suitable method for the preparation of a substantially purified polypeptide.

In certain embodiments, one quantitates the degree of purification of a polypeptide preparation. Certain methods for quantifying the degree of purification are known to those of skill in the art. Certain exemplary methods include, but are not limited to, determining the specific binding activity of the preparation and assessing the amount of a polypeptide within a preparation by SDS/PAGE analysis. Certain exemplary methods for assessing the amount of purification of a polypeptide preparation comprise calculating the binding activity of a preparation and comparing it to the binding activity of an initial extract. In certain embodiments, the results of such a calculation are expressed as "fold purification." The units used to represent the amount of binding activity depend upon the particular assay performed.

In certain embodiments, a polypeptide comprising one or more ABP components or the ABP itself is partially purified. In certain embodiments, partial purification can be accomplished by using fewer purification steps or by utilizing different forms of the same general purification scheme. For example, in certain embodiments, cation-exchange column chromatography performed utilizing an HPLC apparatus will generally result in a greater "fold purification" than the same technique utilizing a low-pressure chromatography system. In certain embodiments, methods resulting in a lower degree of purification can have advantages in total recovery of polypeptide, or in maintaining binding activity of a polypeptide.

In certain instances, the electrophoretic migration of a polypeptide can vary, sometimes significantly, with different conditions of SDS/PAGE. See, e.g., Capaldi et al, Biochem. Biophys. Res. Comm., 76: 425 (1977). It will be appreciated that under different electrophoresis conditions, the apparent molecular weights of purified or partially purified polypeptide can be different.

Methods of Screening

In some aspects, a molecule of interest is screened for activity. In some aspects, the molecule of interest is an ABP. In some aspects, the molecule of interest is an antibody.

In some aspects, methods of screening the libraries disclosed herein are used to identify ABPs capable of binding to a desired target. Any in vitro or in vivo screening method that allows for selection of an ABP from a library, based upon the ABP binding to a target molecule, is contemplated.

In one embodiment, a library may be screened using an art recognized in vitro cell-free phenotype-genotype linked display. Such methods are well known in the art and are described, for example, in U.S. Pat. Nos. 7,195,880; 6,951, 725; 7,078,197; 7,022,479; 6,518,018; 7,125,669; 6,846,655; 6,281,344; 6,207,446; 6,214,553; 6,258,558; 6,261,804; 6,429,300; 6,489,116; 6,436,665; 6,537,749; 6,602,685; 6,623,926; 6,416,950; 6,660,473; 6,312,927; 5,922,545; and 6,348,315. These methods involve transcription of protein in vitro from a nucleic acid in such a way that the protein is physically associated or bound to the nucleic acid from which it originated. By selecting for an expressed protein with a target molecule, the nucleic acid that codes for the protein may also be selected.

To improve the expression of scFv proteins, the above referenced in vitro screening assays may include the addition or removal of certain reagents. In one embodiment, protein disulphide isomerase enzymes may be added to the in vitro expression system to improve the production of functional scFv molecules. In another embodiment, a mild oxidizing agent (for example, GSSG (oxidized glutathione)/GSH (reduced glutathione), for example 100 mM GSSG/10 mM GSH) may be added to in vitro translation reaction mixture of the scFv proteins to allow intra-chain disulphide bond formation in the VH and VL regions of the scFv molecule. In another embodiment, reducing agents (for example, dithiothreitol (DTT)) may be removed from the in vitro translation reaction mixture of the scFv.

In another embodiment, one or more labeled amino acids, or derivatives thereof, may be added to the in vitro translation system such that the labeled amino acid(s) becomes incorporated into the resultant antibody. Any art recognized labeled amino acid is contemplated, for example, a radio-labelled amino acid, for example, $^{35}$S-labelled methionine or cysteine.

In one embodiment, the in vitro screening assays may include that after in vitro selection of an antibody or plurality of antibodies the mRNA that is physically associated with the antibody or plurality of antibodies may be reverse transcribed to generate cDNA encoding said antibody or plurality of antibodies. Any suitable method for reverse transcription is contemplated, for example, enzyme mediated, for example, Moloney murine leukemia virus reverse transcriptase.

The screening methods may include amplification of the nucleic acid that encodes antibodies that bind specifically to a desired target. In one embodiment, mRNA that is physically associated with an antibody or plurality of antibodies may be amplified to produce more mRNA. Any art recognized method of RNA replication is contemplated, for example, using an RNA replicase enzyme. In another embodiment, mRNA that is physically associated with an antibody or plurality of antibodies is first reverse transcribed into cDNA before being amplified by PCR. In one embodiment, PCR amplification is accomplished using a high fidelity, proof-reading polymerase, for example, the KOD1 thermostable DNA polymerase from Thermococcus kodakaraensis or Platinum Taq DNA Polymerase High Fidelity (Invitrogen, Carlsbad, Calif.). In another embodiment, PCR amplification may be performed under conditions that result in the introduction of mutations into amplified DNA, i.e., error-prone PCR.

Screening methods may also include that the stringency of the target-binding screening assay be increased to select for antibodies with improved affinity for target. Any art recognized methods of increasing the stringency of an antibody-target interaction assay are contemplated. In one embodiment, one or more of the assay conditions may be varied (for example, the salt concentration of the assay buffer) to reduce the affinity of the antibody molecules for the desired target. In another embodiment, the length of time permitted for the antibodies to bind to the desired target may be reduced. In another embodiment, a competitive binding step may be added to the antibody-target interaction assay. For example, the antibodies may first be allowed to bind to a desired immobilized target. A specific concentration of non-immobilized target may then be added, which serves to compete for binding with the immobilized target such that antibodies with the lowest affinity for antigen are eluted from the immobilized target, resulting in enrichment for antibodies with improved antigen binding affinity. In an embodiment, the stringency of the assay conditions may further be increased by increasing the concentration of non-immobilized target that is added to the assay.

Screening methods may also include multiple rounds of selection to enrich for one or more antibodies with improved target binding. In one embodiment, at each round of selection further amino acid mutations may be introduced into the antibodies using art recognized methods. In another embodiment, at each round of selection the stringency of binding to the desired target may be increased to select for antibodies with increased affinity for a desired target.

Screening methods may include purification of RNA-antibody fusion proteins from the components of an in vitro translation system. This may be accomplished using any art recognized method of separation. In one embodiment, the RNA-antibody fusion proteins may be separated by chromatography using a polydeoxythimidine (polydT) resin. In another embodiment, the RNA-antibody fusion proteins may be separated by chromatography using an antibody specific for an epitope present in the antibody component of the RNA-antibody fusion protein. In an embodiment, the epitope may be an amino acid sequence tag, for example, FLAG or HA tags, incorporated into the amino acid sequence of the antibody component of the RNA-antibody fusion protein, for example, at the N-terminal, C-terminal or in the inter variable region linker.

Selection of antibodies from a library may include the use of immobilized target molecules. In one embodiment, the target molecule may be directly linked to a solid substrate for example, agarose beads. In another embodiment, the target molecule may first be modified, for example, biotinylated and the modified target molecule may be bound via the modification to a solid support, for example, streptavidin-M280, neutravidin-M280, SA-M270, NA-M270, SA-MyOne, NA-MyOne, SA-agarose, and NA-agarose.

In some aspects, fluorescently-labeled antigens are used to single cell sort only plasmablasts or other B lineage cells with reactivity against specific, labeled antigens. In other aspects, fluorescently-labeled antigens are used to enrich for plasmablasts or other B lineage cells with reactivity against specific, labeled antigens, before single cell sorting occurs. In some aspects, fluorogenic or chromogenic molecules may be used to identify and sort B lineage cells. In some aspects, desired plasmablasts or other B lineage cells may be isolated by magnetic-activated cell sorting (MACS) or even by panning. Products resulting are generally monoclonal antibodies, against a variety of targets, including but not restricted to: cancer antigens, cytokines, chemokines, growth factors, secreted proteins, cell surface and other antigens to deplete cell types of specific interest, microbes, bacteria, mycobacteria, parasites, and viruses. Other screening methods are described in the Examples section below.

Computer Implementation

In some aspects, one or more methods described herein can be implemented on a computer. In one embodiment, a computer comprises at least one processor coupled to a chipset. Also coupled to the chipset are a memory, a storage device, a keyboard, a graphics adapter, a pointing device, and a network adapter. A display is coupled to the graphics adapter. In one embodiment, the functionality of the chipset is provided by a memory controller hub and an I/O controller hub. In another embodiment, the memory is coupled directly to the processor instead of the chipset.

The storage device is any device capable of holding data, like a hard drive, compact disk read-only memory (CD-ROM), DVD, or a solid-state memory device. The memory holds instructions and data used by the processor. The pointing device may be a mouse, track ball, or other type of pointing device, and is used in combination with the keyboard to input data into the computer system. The graphics adapter displays images and other information on the display. The network adapter couples the computer system to a local or wide area network.

As is known in the art, a computer can have different and/or other components than those described previously. In addition, the computer can lack certain components. Moreover, the storage device can be local and/or remote from the computer (such as embodied within a storage area network (SAN)).

As is known in the art, the computer is adapted to execute computer program modules for providing functionality described herein. As used herein, the term "module" refers to computer program logic utilized to provide the specified functionality. Thus, a module can be implemented in hardware, firmware, and/or software. In one embodiment, program modules are stored on the storage device, loaded into the memory, and executed by the processor.

Embodiments of the entities described herein can include other and/or different modules than the ones described here. In addition, the functionality attributed to the modules can be performed by other or different modules in other embodiments. Moreover, this description occasionally omits the term "module" for purposes of clarity and convenience.

Kits

A kit can include a polynucleotide, a polynucleotide library, a vector, and/or a host cell disclosed herein and instructions for use. The kits may comprise, in a suitable container, a polynucleotide, a polynucleotide library, a vector, and/or a host cell disclosed herein, one or more controls, and various buffers, reagents, enzymes and other standard ingredients well known in the art.

The container can include at least one well on a plate comprising one or more wells. The container can include at least one vial, test tube, flask, bottle, syringe, or other container means, into which a polynucleotide, a polynucleotide library, a vector, and/or a host cell may be placed, and in some instances, suitably aliquoted. Where an additional component is provided, the kit can contain additional containers into which this component may be placed. The kits can also include a means for containing the polynucleotide, a polynucleotide library, a vector, and/or a host cell and any other reagent containers in close confinement for commercial sale. Such containers may include injection or blow-molded plastic containers into which the desired vials are retained. Containers can include labeling with instructions for use and/or warnings.

EXAMPLES

The examples are offered for illustrative purposes only, and are not intended to limit the scope of any embodiment of the present invention in any way. Efforts have been made to ensure accuracy with respect to numbers used (e.g., amounts, temperatures, etc.), but some experimental error and deviation should, of course, be allowed for.

Various methods can employ, unless otherwise indicated, conventional methods of protein chemistry, biochemistry, recombinant DNA techniques and pharmacology, within the skill of the art. Such techniques are explained fully in the literature. See, e.g., T. E. Creighton, *Proteins: Structures and Molecular Properties* (W.H. Freeman and Company, 1993); A. L. Lehninger, *Biochemistry* (Worth Publishers, Inc., current addition); Sambrook, et al., *Molecular Cloning: A Laboratory Manual* (2nd Edition, 1989); *Methods In Enzymology* (S. Colowick and N. Kaplan eds., Academic Press, Inc.); *Remington's Pharmaceutical Sciences,* 18th Edition (Easton, Pa.: Mack Publishing Company, 1990); Carey and Sundberg *Advanced Organic Chemistry* $3^{rd}$ Ed. (Plenum Press) Vols A and B (1992); *Current Protocols in Molecular Biology* (2002—; Wiley; Online ISBN: 9780471142720; DOI: 10.1002/04711142727); *Current Protocols in Immunology* (2001—; Wiley; Online ISBN: 9780471142737; DOI: 10.1002/0471142735).

General Materials and Methods

Blood Collection and Isolation of PBMCs

All human samples were collected after informed consent and under Investigational Review Board (IRB)-approved human subject protocols. Blood was collected in heparin tubes (Beckton Dickinson and Company, catalog #BD366664) or in CPT tubes (Beckton Dickinson and Company, catalog BD362761) tubes. For processing of the heparin tubes, one milliliter of blood was transferred into a microfuge tube and spun down at 12,000 rpm for 3 minutes, plasma was collected and frozen at –80° C. (for later testing for antibody reactivities), the remainder of the blood was layered over Ficoll and centrifuged in a Beckman Coulter Allegra X-15R benchtop centrifuge with a SX4750 Swinging Bucket Rotor at 800 g for heparin tubes for 20 min at room temperature, with minimal acceleration and without use of the brake, and the peripheral blood mononuclear cell (PBMC) layer was collected. Alternatively, CPT tubes were directly centrifuged at 1,500g for 20 min at room temperature, with minimal acceleration and without use of the brake, and the PMBC layer was collected. The collected PBMCs were then washed twice with PBS before use.

PBMCs may also be frozen for future use and isolation of B-cells, memory B-cells, plasmablasts, plasma cells, or other B-cell populations. One method for freezing PBMCs involves resuspending the PBMCs in 90% fetal bovine serum (FBS) and 10% dimethyl sulfoxide (DMSO) in cryovials, and then slowly freezing the cells contained in the vials overnight at –80° C. in a Mr. Frosty (Sigma C1562-1EA). The vials of frozen cells were then transferred for long-term storage in liquid nitrogen, and can be thawed at a later date for the isolation of individual B-cells and for the high-throughput sequencing of paired immunoglobulin genes. Thawed cells were incubated in a media containing an excess of DNase I, usually 25 ug/ml (Sigma D4513) till the end of the 1st sort to prevent cell clumping.

Isolation and Enrichment of Cells and Cell Subpopulations

Plasmablasts.

For some samples, PBMCs were first enriched for plasmablasts by using a modified Plasma Cells Isolation Kit II (Miltenyi 130-093-628). This is an optional step. This yielded fewer total cells for subsequent sorting, resulting in shorter sort times. This was used primarily when multiple samples needed to be single-cell sorted on the same day. It is also possible to use different kits to enrich for different B-cell populations (see below). For every $5 \times 10^7$ PBMCs, cells were suspended in 200 μL of ice-cold MACS buffer (PBS with 0.5% FBS). 50 uL of non-plasma cell biotin-antibody cocktail was added, and cells were incubated in the fridge (4° C.) for 10 minutes. 100 μL of MACS buffer, 100 μL of non-plasma cell microbead cocktail, and 50 μL of CD56 microbeads were added and incubated in the fridge for an additional 10 minutes. Cells were then washed with 7 mL of MACS buffer, centrifuged at 300g for 5 minutes at 4° C., resuspended in 500 μL of MACS buffer, and run on an equilibrated LS column in a magnetic field. The column was washed with 4×3 mL of MACS buffer and enriched cells were in the negative fraction.

Memory B-Cells.

CD19+ microbeads (Miltenyi 130-050-301) and CD27+ microbeads (130-051-601) may be used to enrich for memory B-cells before cell sorting, to shorten sort times. Other enrichment methods, such as Memory B-cell isolation kit (Miltenyi 130-093-546), may also be used, provided that they enrich for $CD19^+CD27^+$ cells. For every $5\times10^7$ PBMCs, 300 μL of ice-cold MACS buffer is used for resuspension. 0.100 μL of CD19. microbeads and 100 μL of CD27 microbeads are then added, and the sample is incubated at 4° C. for 15 minutes. Cells are then washed with 7 mL of MACS buffer, centrifuged at 300g for 5 minutes at 4° C., and resuspended in 500 μL of MACS buffer. Cells are then run through an equilibrated LS column in a magnetic field, and washed with 2×3 mL of MACS buffer. The LS column is then removed from the magnetic field, and the cells are washed out with 5 mL of MACS buffer to elute the enriched cells.

Total B-Cells.

CD19+ microbeads (Miltenyi 130-050-301) may be used to enrich for total B-cells before cell sorting, e.g., to shorten sort times. Other enrichment methods may also be used, provided that they enrich for $CD19^+$ cells. For every $5\times10^7$ PBMCs, resuspend cells in 400 μL of ice-cold MACS buffer. Add 100 μL of CD19+ microbeads and incubate in the fridge (4° C.) for 15 minutes. Cells are then washed with 7 mL of MACS buffer, centrifuged at 300g for 5 minutes at 4° C., and resuspended in 500 μL of MACS buffer. Cells are then run through an equilibrated LS column in a magnetic field and washed with 2×3 mL of MACS buffer. The LS column is then removed from the magnetic field, and the cells are eluted with 5 mL of MACS buffer, yielding the enriched cells.

Other Cell Types.

Although not necessary, MACS enrichment of the desired cell population can shorten sort times. Other cell populations, including plasma cells, other B-cell populations and non-B-cell populations may also be enriched using MACS or other systems using the appropriate reagents. For example, total T-cells may be enriched using CD3+ microbeads, and effector T-cells and helper T-cells isolated using CD8+ and CD4+ microbeads, respectively. CD45RO microbeads may be used to isolate memory T-cells and, in conjunction with CD8+ or CD4+ beads, used to isolate memory effector or memory helper T-cells, respectively.

Single-Cell Sorting

MACS enrichment is not required for sorting, but MACS enrichment for plasmablasts may be performed to shorten sort times. If PBMCs have undergone MACS enrichment, an aliquot of unenriched PBMCs (~1 million cells) is also analyzed in tandem, allowing the baseline plasmablast percentage in the sample to be determined. For sorting plasmablasts, cells were stained with manufacturer-recommended volumes of CD3-V450 (BD 560365), IgA-FITC (AbD Serotec STAR142F), IgM-FITC (AbD Serotec STAR146F) or IgM-PE (AbD Serotec STAR146PE), CD20-PerCP-Cy5.5 (BD 340955), CD38-PE-Cy7 (BD 335808), CD19-APC (BD 340437) and CD27-APC-H7 (BD 560222) in 50 μL of FACS buffer (PBS or HBSS with 2% FBS) on ice for 20 minutes in the dark. Some cells may also be stained with IgG-PE (BD 555787), CD138-PE (eBioscience 12-1389-42), or HLA-DR-PE (BD 555812) together with IgM-FITC instead. For simultaneous sorting of plasmablasts, memory and naive B-cells, the following staining scheme was used: IgD-FITC (Biolegend 348205), IgG-PE (BD 555787), CD20-PerCP-Cy5.5, CD38-PECy7, IgM-APC (BD 551062), CD27-APC-H7, IgA-biotin (AbD Serotec 205008) followed by Strepavidin-eFluor710 (eBioscience 49-4317-82) and CD19-BV421 (Biolegend 302233). Memory B-cells have also been sorted either as $CD19^+CD27^+IgG^+$ or $CD19^+CD20^+IgG^+$, naive B-cells have been sorted as $CD19^+IgD^+IgM^+$. $IgA^+$ plasmablasts have also been sorted, and are defined as $CD19^+CD20^-CD27^+CD38^{++}IgA^+IgM^-$. Other cell surface markers may also be used, as long as the B-cell or other cell population is phenotypically identifiable using cell surface markers, the population can be single-cell sorted. See below. Cells were then washed once with 2 mL of FACS buffer and resuspended at an appropriate volume for FACS. Cells were first sorted on a BD Aria II into a 5 mL round bottom tube. Typically, purities of >80% were achieved from the first sort. Single cells were sorted into the first 11 columns of a 96-well PCR plate containing 6.65 μL of a hypotonic buffer (10 mM Tris-HCl pH 7.6) containing 2 mM dNTPs (NEB N0447L), 5 μM oligo(dT)$_{20}$VN, and 1 unit of Ribolock (Fermentas E00384), an RNase inhibitor. As a negative control, the last column was left devoid of cells. For $IgG^+$ plasmablasts, the gating (selection of cells) strategy was $CD19^+CD20^-CD27^+CD38^{++}IgA^-IgM^-$. Sorted plates were sealed with aluminum plate sealers (Axygen PCR-AS-600) and immediately frozen on dry ice and stored at −80° C.

Single-Cell Sorting Gating Strategies

B-Cells.

For B-cells, the gating approach comprises sorting for one or more of the following markers: IgM, IgG, IgA, IgD, CD19, or CD20. For total $IgG^+$ B-cells, the gating approach comprises sorting for $IgG^+$. For total $IgA^+$ B-cells, the gating approach comprises sorting for $IgA^+$. For total $IgM^+$ B-cells, the gating approach comprises sorting for $IgM^+$.

Activated B Cells.

Activated B cells include B cells that have been stimulated through binding of their membrane antigen receptor to its cognate antigen and/or have received T cell help from T cells recognizing epitopes derived from the same macromolecular antigen. Activated B cells can be identified by a variety of properties including increased cell size (e.g. "blasting B cells"; see below), expression of cell surface marker or markers, expression of intracellular marker or markers, expression of transcription factor or factors, exiting the gap 0 (G0) phase of the cell cycle, progressing through the cell cycle, production of cytokines or other factors, and/or the down regulation of certain cell surface marker or markers, intracellular marker or markers, transcription factor or other factor. One method of identifying an activated B cell is to combine detection of a B cell marker such as CD19 or immunoglobulin with a marker of activation such as increased cell size or volume, the cell surface activation marker CD69, or progression through the cell cycle based on cell-permeable acridine orange DNA stain or another cell cycle analysis.

Blasting B Cells.

"Blasting B cells" are B cells that are activated and increased in size relative to resting B cells. Blasting B cells include the plasmablast population as well as other populations of activated B cells, and blasting B cells are physically larger in size than resting B cells. Blasting B cells can be single-cell sorted using several different approaches, including gating (selection) of B cells based on their physically being larger based on cell diameter, cell volume, electrical impedance, FSC, the integral (area) of a FSC pulse (FSC-A), FSC height (FSC-H), forward scatter pulse width (FCS-W), side scatter (SSC), side scatter pulse area (SSC-A), side scatter height (SSC-H), side scatter width (SSC-W), autofluorescence and/or other measures of cell size.

In flow cytometry, forward scatter (FSC) is measured using a light beam in line with the stream of cells and provides information regarding the proportional size and diameter of each cell. Using FSC one can select B cells with FSC greater than the median FSC of resting B cell, for example an FSC-A or FSC-H 5% greater than resting B cells, 10% greater than resting B cells, 15% greater than resting B cells, 20% greater than resting B cells, 30% greater than resting B cells, 40% greater than resting B cells, 50% greater than resting B cells, 60% greater than resting B cells. By analyzing calibration beads of specific sizes, one can use FSC to determine the relative size of B cells relative to the calibration beads. By doing so, one can specifically gate on and thereby select B cells that possess diameters of about 8 um, >8 um, >9 um, >10 urn, >11 um, >12 um, >13 um, >14 um, >15 um, >16 um, >17 um, >18 um, >19 um, or >20 um.

Another measurement of cell size is cell volume. The "gold standard" for cell volume uses the Coulter principle which is based on an electronic measurement (Tzur et al, PLoS ONE, 6(1): e16053. doi:10.1371/joumal.pone.0016053, 2011). Although the method of sorting by droplet charging and deflection was first used in a device that measured cell volume by impedance, the currently available flow cytometers make only optical measurements. FSC measurements, specifically the FSC-A (FSC integral area) are commonly used to assess cell size, although FSC measurements can be influenced by the refractive index differences between particles and fluid (Tzur et al, PLoS ONE, 6(1): e16053. doi:10.1371/journal.pone.0016053, 2011). Some have shown that volume estimation can be improved by combining optical parameters, including FSC-W, SSC and 450/50-A auto fluorescence (Tzur et al, PLoS ONE, 6(1): e16053. doi:10.1371/journal.pone.0016053, 2011).

For example, selection of activated. B cells based on increased size can be achieved through identifying B cells using a marker such as CD19 and assessing size through FSC or FSC-A. Other B cell markers and/or parameters for assessment of size are described herein.

Plasmablasts.

For isolation of plasmablasts, the gating approach comprises sorting for $CD19^+CD38^{++}$ B-cells. For isolation of $IgG^+$ plasmablasts, the gating approach comprises sorting for $CD19^+CD38^{++}IgA^-IgM^-$ B-cells. For isolation of IgA+ plasmablasts, the gating approach comprises sorting for $CD19^+CD38^{++}IgA^+$ B-cells. For isolation of IgM+ plasmablasts, the gating approach comprises sorting for $CD19^+CD38^{++}IgM^+$ B-cells. In addition, other gating strategies can be used to isolate a sufficient number of plasmablasts to carry out the methods described herein. Plasmablasts were also isolated using the following marker expression patterns $CD19^{low/+}$, $CD20^{low/-}$, $CD27^+$ and $CD38^{++}$. Although use of all these markers generally results in the purest plasmablast population from single cell sorting, not all of the above markers need to be used. For example, plasmablasts may also be isolated using the following gating strategies: forward scatter high ($FSC^{hi}$) for larger cells, $FSC^{hi}CD19^{lo}$ cells, $FSC^{hi}$ and $CD27^+$, $CD38^{++}$, or $CD20^-$ cells. Combination of any of these markers or other markers found to be able to distinguish plasmablasts from other B-cells will generally increase the purity of sorted plasmablasts, however any one of the above markers alone (including $FSC^{hi}$) can distinguish plasmablasts from other B-cells, albeit with a lower purity.

For Memory B-Cells.

For $IgG^+$ memory B-cells, the gating approach comprises sorting for $CD19^+CD27^+IgG^+$ or $CD19^+CD20^+IgG^+$. For $IgA^+$ memory B-cells, the gating strategy comprises $CD19^+CD27^+IgA^+$ or $CD19^+CD20^+IgA^+$. For $IgM^+$ memory B-cells, the gating strategy comprises $CD19^+CD27^+IgM^+$ or $CD19^+CD20^+IgM^+$.

For Other Cell Types.

As long as the B-cell, T-cell, or other cell population is phenotypically identifiable using cell markers, it can be single-cell sorted. For example, T-cells can be identified as $CD3^+$ or $TCR^+$, naïve T-cells identified as $CD3^+CD45RA^+$, memory T-cells identified as $CD3^+CD45RO^+$. Effector and helper T-cells can be identified as $CD3^+CD8^+$ and $CD3^+CD4^+$, respectively. Cell populations can be further subdivided by using combinations of markers, such as $CD3^+CD4^+CD45RO^+$ for memory helper T-cells.

Sequencing of Paired Light and Heavy Chain Immunoglobulin Genes from Single B-Cells Reverse Transcription with Adaptor Molecules Single-cell sorted plates were thawed on ice and briefly centrifuged before use. Plates were incubated in the thermal cycler at 55° C. for 3 minutes, 42° C. for 2 minutes, and indefinitely at 4° C. Plates were briefly centrifuged again and carefully opened to avoid the formation of aerosols. 1 µL of a 10 µM solution of the appropriate adapter molecule (each adapter molecule generally has a sample identification region (sample-ID)) was added to each well, with all negative control wells (containing RNA preservative buffer alone, or non-B-cells) receiving identical adapter molecules. 2.35 µL of a mix containing 0.75 µL $H_2O$, 1 µL of 10×M-MuLV RT buffer (NEB B0253S), 0.6 µL of 50 mM $MgCl_2$, 0.25 µL of Ribolock (40 U/µL), and 0.125 µL of Superscript III (200 U/µL) (Invitrogen 18080-085) was added and mixed by pipetting. Plates were briefly centrifuged and incubated at 42° C. for 120 minutes to 8 hours using a thermal plate shaker and then kept at −20° C. After the reaction, RT products from all wells were pooled in a microfuge tube. Pooled RT products were then extracted with phenol-chloroform-isopropyl alcohol with ~0.1% 8-hydroxychloroquine (Sigma 77617), and then extracted with chloroform extraction in gel-lock phase tubes (5 PRIME 2302820). RT products were then concentrated and desalted by 5-minute spins at 14 000g with Amicon Ultra-0.5 30 kDa (Millipore UFC503096) or Ultra-0.5 100 kDa (Millipore UFC510096), followed by a 5 min spin at 14 000g with TE (10 mM Tris-HCl pH 7.6 with 1 mM EDTA) and a final 5-minute spin at 14 000g with EB (Qiagen 19086). RT products were eluted by inverting the Amicon Ultra column in a new centrifuge tube and centrifuging at 1000g for 2 minutes. At this point, RT products were kept at −20° C. or −80° C.

Touchdown PCR

For 454 sequencing runs 1 and 2, the Touchdown PCR method was used as follows. For some samples in PCR runs 3 and 4, the PCR method was changed, leading to increased numbers of paired heavy and light chains. This change is detailed under the sub-section "Non-touchdown PCR" below.

For both the 1$^{st}$ PCR and the nested 2$^{nd}$ PCR, Phusion Hot Start II DNA polymerase (NEB F-549L) was used in the provided GC buffer. For IgG, primers and adapter molecules are shown in Table 1. Sample-ID sequences are shown in Table 2. Plate-ID sequences are shown in Table 3. See also FIGS. 3 and 9. Reaction conditions included a final MgCl$_2$ concentration of 1.8 mM, 200 µM dNTPs, 0.2 µM for all primers, 0.2 U of Phusion polymerase, varying amounts of DMSO as an additive and 2 µL of template in a final volume of 25 For the 1$^{st}$ PCR, lambda and kappa light chains and the gamma heavy chain were amplified in different wells, and DMSO is used at a final concentration of 8%, 5% and 10%, respectively. Forward primers used in the 1$^{st}$ PCR were the FW long primer1 and the FW short primer1. Because the FW long primer1 added a plate identification region (plate-ID) to the 5' end of amplicon regions (amplicons), FW long primer1 containing different plate-IDs was added to different samples. Gene-specific reverse primers were used to amplify the kappa, lambda, and gamma chains were kappa GSP1, lambda GSP1, and gamma GSP1, respectively. Cycling conditions for the 1$^{st}$ PCR included an initial denaturation step at 98° C. for 30", followed by 2 cycles of 98° C. for 10", 72° C. for 25"; 7 touchdown cycles of 98° C. for 10", 71.5° C. to 68.5° C. for 15" and 72° C. for 20" with a drop of 0.5° C. for each subsequent annealing step; 30 cycles of 98° C. for 10", 68° C. for 15" and 72° C. for 20", followed by a final extension at 72° C. for 5' and hold at 4° C. indefinitely. Products from 1$^{st}$ PCR were diluted 100× in TE and 2 µL used for the nested 2$^{nd}$ PCR. For the 2$^{nd}$ PCR, 5% DMSO was used as an additive in all samples. Forward primer is the FW primer2 and reverse primers were the RV primer2 and the GSP long primer2. Kappa GSP long primer2, lambda GSP long primer2 and gamma long primer2 were used to amplify their respective amplicons. Because the GSP long primer2 also added the plate-ID to the 3' end of the amplicons, a different GSP long primer2 with plate-specific plate-IDs was added to each pooled-plate sample. Cycling conditions for the nested 2$^{nd}$ PCR included an initial denaturation step of 98° C. for 30", 30-40 cycles of 98° C. for 10", 67° C. for 15", and 72° C. for 20", followed by a final extension of 72° C. for 5' and hold at 4° C. indefinitely.

Non-Touchdown PCR

For the non-touchdown PCR, conditions were identical to the touchdown PCR unless otherwise stated. The 1st PCR cycling parameters were an initial denaturation of 95° C. for 5', 15-25 cycles of 98° C. 30", 62° C. 30", 72° C. 30", a final extension of 72° C. 5' and hold at 4° C. indefinitely. 1st PCR was a multiplex PCR, where all 3 gene-specific reverse primers, the kappa, lambda, and gamma constant regions reverse primers were used in conjunction at 0.2, 0.2 and 0.24 µM, respectively. All other primers used were the same as in touchdown PCR. The gene-specific primers can be those used in touchdown PCR and also any one of those designated as suitable for 1st PCR (Table 6). DMSO was used at a final concentration of 5%; 0.1 mg/ml of BSA (NEB B9001S), and ET-SSB (NEB M2401S) may also be added at 1:100 for the PCR reaction. During the 1st PCR, 4-60 ul of cDNA template was used in a total 80 or 90 ul reaction volume. Each PCR1 reaction was split into eight or nine 10 ul reactions, each occurring in a different well. 1st PCR was pooled again after the PCR and diluted 100× in TE0.1, and 2 ul used for 2nd PCR. 2nd PCR is a separate reaction for each gene-specific primer (not multiplex), and the reaction mix was identical to the touchdown 2nd PCR except for the following: any of the gene-specific constant region primers designated as working for the 2nd PCR may be used (Table 6), primers were used at either 0.2 µM or 0.4 µM throughout, or the gene-specific primers were used at 0.2 µM and the rest used at 0.4 µM. 0.1 mg/ml BSA was added to the reaction and ET-SSB may also be used at 1:100. The 2nd semi-nested PCR cycling parameters were an initial denaturation of 95° C. for 5', 20-35 cycles of 98° C. 30", 67° C. 30", 72° C. 30", a final extension of 72° C. 5' and hold at 4° C. indefinitely. The total number of PCR cycles for 1st and 2nd PCR combined was typically between 50-60 cycles for the non-touchdown PCR. As different pooled-wells undergoing the PCR cycling tend to use different number of cycles to obtain a reasonable amount of DNA product (typically between 2 ng/ul), 4 different PCR cycles were carried out for each 2nd PCR, e.g. 23, 26, 30 and 33 cycles, 5 ul run on a 2% agarose gel and compared. Based on qualitative judgment of the amount of PCR product, only PCR product from one of the 2nd PCR cycle numbers was used for each pooled-well 2nd PCR in preparing for the 454 sequencing run.

For PCR of other immunoglobulin heavy chains in humans, immunoglobulin heavy and light chains in mice and TCR chains in humans and mice, PCR conditions are identical to the non-touchdown PCR section above except that 1st PCR is non-multiplex, with each cDNA being individually amplified. The following 3' primers in Tables 10 and 11 are used in PCR1 and 2.

Preparing for 454 XLR70 Sequencing Run

For the 1$^{st}$ and 2$^{nd}$ 454 runs, sequencing primers (Titanium Primers A and B, respectively) for a 454 Titanium sequencing run were added onto the amplicons during the 1$^{st}$ and nested 2$^{nd}$ PCRs. 5 µL of each amplicon were run on an agarose gel with a mass DNA ladder (Fermentas SM0383), an image was taken, and band intensities were analyzed and quantified with AlphaFC Imager software (Cell Biosciences). 5 ng of each of the kappa, lambda, and gamma amplicons were separately pooled, run on a 0.8% agarose gel, and visualized with GelGreen (Biotium 41005). Bands of the appropriate sizes (~600 bp for kappa and lambda, and ~750 bp for gamma) were cut and purified with MinElute Gel Extraction kit (Qiagen 28606), according to manufacturer's instructions with slight modifications. Briefly, agarose gel was melted in QG buffer without heating, and the additional QG wash step is done. PE wash buffer was allowed to sit for 5 minutes before spinning. An additional PE wash step was also performed. Samples were eluted with 25 uL of EB buffer. Samples were also cleaned once with SPRI beads using a ratio of 1:0.65 for DNA volume: bead volume for 454 2$^{nd}$ run. DNA concentration was determined with Picogreen DNA assay kit (Invitrogen P11496), and samples were pooled such that DNA concentration of gamma:kappa:lambda is 2:1:1. Pooled samples were at a concentration of >0.5 ng/µL and were shipped to a 454 DNA sequencing facility for 454 sequencing.

For the 3$^{rd}$ and subsequent 454 sequencing runs, the protocol was changed. The amplicons were still separately pooled to normalize DNA quantities from each PCR reaction, but first underwent an SPRI bead cleanup to remove small DNA fragments according to manufacturer's instructions. The amplicons were run on a 3% agarose gel, and the appropriate bands cut and purified with MinElute Gel Extraction kit as before. Thereafter, the amplicons underwent another 2 rounds of SPRI bead cleanup to remove even more small DNA fragments, and quantitated with Picogreen, quality checked with Nanodrop to ensure the OD260/280 ratio was >1.8 and 10 run on a gel to ensure there were no small DNA fragments. Lambda and kappa amplicons were pooled in a 1:1 ratio, gamma was used as-is. DNA was then diluted to 1×10⁹ copies per 454's instructions, and sent to sequencing facility (Roche) for emPCR at 1cpb and sequenced; gamma heavy chain in one region and the pooled light chains in the other region of the picotiter plate.

Preparing for 454 XL+ Sequencing Run

Currently the 454 XL+ sequencing run does not support the Lib-A sequencing kit that was used for the XLR70 run. XL+ currently only supports the Lib-L kit, which is unidirectional sequencing. To adapt our protocol to do XL+ sequencing, the protocol for XLR70 run is followed, but after the gel cleanup step, each amplicon (kappa, lambda and gamma) underwent 2 separate PCRs, each 5 cycles long to add on the Lib-L A and B adaptors. PCR conditions are as follows: Phusion polymerase is used, with 5×GC buffer and a final concentration of 5% DMSO. Primers are used at 0.2 uM. 0.1 mg/ml BSA is added to the reaction. The PCR cycling parameters are an initial denaturation of 95° C. for 5', 20-35 cycles of 98° C. 30", 67° C. 30", 72° C. 30", a final extension of 72° C. 5' and hold at 4° C. indefinitely. Two PCRs are done for each amplicon: 5LIB-LA and 3LIB-LB in one PCR, and 5LIB-LB and 3LIB-LA in the other PCR. The adaptors are added such that each amplicon becomes either 5'-LibA-amplicon-LibB-3' or 5'-LibB-amplicon-LibA-3'. These amplicons have either the LibA "A" or "B" adaptors on the 5' end (and the corresponding "B" or "A" adaptor on the 3' end), which allows for bidirectional sequencing. Amplicons with the new Lib A adaptors then undergo 3 rounds of SPRI bead cleanup before following the protocol for XLR70 runs to quantitate and quality check the DNA before diluting it to 1×10⁹ copies and sending to a 454 sequencing facility (Roche) for emPCR at 1cpb and sequencing.

Preparing for PacBio Sequencing Run

For PacBio sequencing run, touchdown PCR was employed as above. DNA pooling and cleanup was done as the section above on "preparing for 454 XLR70 run." To obtain sufficient DNA (500 ng) for sequencing requirements, a minimum of 1 ug of DNA was pooled for gel and SPRI cleanup. Picogreen quantitation and 1×10⁹ dilutions were not done as it was not required for PacBio sequencing. If insufficient DNA was obtained from the 2nd PCR, the 2nd PCR and pooling steps were repeated until sufficient DNA was obtained. A minimum of 500 ng of cleaned-up DNA was sent to PacBio sequencing facility for sequencing.

Other Sequencing Approaches

The methods disclosed herein are not dependent on 454 or PacBio sequencing. Lambda and kappa light chains are ~600 bp and gamma heavy chain ~700 bp. Thus, what is generally desired is the ability to have longer sequencing reads such that the forward and reverse sequencing reads overlap enough to enable reconstruction of the entire, approximately 600 bp sequence of the light chains (LCs) (exact sequence length depends on the length of the 5' untranslated region (UTR)), and approximately 700 bp sequence of the heavy chains (HCs). Therefore, any sequencing technology that can yield sequencing reads of at least about 350-400 bp and thereby achieve the overlap used for sequence assembly can be utilized, and sequencing technologies that enable app. 600-700+ bp reads would allow one to sequence using just the forward (Fw) primer (sequencing from the 5' end).

Sequences

The sequence data for the above runs was received from the relevant facility and processed as described below.

Sequence Nomenclature

Each sequence in the sequence listing which corresponds to a sequencing read, sequence assembly or amino acid translation from a sequence has an identifier. Each such identifier has 9 fields separated by a period, ".". The fields are numbered from 1 to 9 and give the following information:

1. Read ID. A Read ID assigned by the software associated with the sequencing technology used to determine the read, or "NA" if the sequence is not a raw read.
2. Plate Number. A plate number that the sequence is associated with. See Table 12 (plate to sample mapping table) for corresponding biological sample information.
3. Sample ID. Sample ID indicating the well that the sequence is associated with. Sample ID numbers are between 1 and 89 inclusive. See Table 2 for correspondence between Sample ID and Well Name.
4. Well Name. Well name containing the well that the sequence is associated with. The well name corresponds to the usual 96 well plate name, e.g. D07. The well name and the Sample ID are equivalent ways of specifying a particular well on a plate.
5. Contig ID. The contig ID distinguishes different sequences associated with a well from a given assembly and chain type.
6. Platform. The platform field indicates the sequencing technology that the sequence is derived from. The possible values for platform are 454, Sanger, and PacBio.
7. Chain Type. The chain type field indicates whether the sequence is associated with a set of heavy chain antibody sequences, light chain antibody sequences, or a set containing both heavy and light chain antibody sequences. Possible values are "heavy", "light" or "CMB".
8. Run ID. An identifier for a set of reads on a particular platform.
9. Sequence Type. The type of the sequence. Possible values are "raw" for raw sequencing technology reads, "nb", "urt", "multim50", "zerom50" or "pb" for assembled reads (see Assembly of Sequences section), or "nb-aa", "urt-aa", "multim50-aa", "zerom50-aa" or "sanger-aa" for amino acid sequences derived from the various nt assembly consensus sequences.

Preparation of Sequences for Analysis

Data generated from the 454 sequencing were analyzed by 454 GS FLX data analysis software, and filter-passed high quality sequences were returned. Due to the stringency of the default amplicon filter used by 454 GS FLX data analysis software, filter stringency may need to be relaxed to obtain sufficient long reads. One way is to follow the suggestions in 454 technical bulletin APP No. 001-2010. Changing <vfScanAllFlows> from "TiOnly" to "False" of the amplicon filter can lead to a large increase in filter-passed sequences of good quality. Another option is to change the <vfTrimBackScaleFactor> to a lower number. For 454 run 1, standard shotgun processing was used and for run 2, <vfScanAllFlows> was changed to "False", and standard amplicon pipeline processing was used for runs 3 and 4.

Data generated from Pacific Biosciences sequencing was received from Pacific Biosciences as Circular Consensus Sequence reads with associated quality scores.

Assignment of Sequences to Wells cDNA from samples was sequenced with either 454 or Pacific Biosciences sequencing technology. The reads are those in the Sequence Listing whose Sequence Type is "raw". The sequencing reads were analyzed and either assigned to a source plate and well or discarded.

Plate and well assignments for reads were made by comparing the observed read sequence to the possible plate identification region, universal primer region, and sample identification region sequences using regular expressions. The comparison was done in three stages using the regular expressions listed in Tables 13, 14 and 15.

In stage 1, analysis of possible plate identification regions, a read was checked against all of the regular expressions listed in column "Plate Identification Region Regular Expression" in Table 13, requiring a match to begin with the first nucleotide of the sequence. If no match was found the read was discarded and plate/well assignment continued with the next available read to process, if any. If a match was found, the sequence was assigned the corresponding ID from the "Plate ID" column as its plate ID. The nucleotides of the read matching to the plate regular expression were recorded for use during later stages of matching and during assembly.

In stage 2, analysis of the universal primer region, a read was checked against the "universal primer regular expression" "CACGACCGGTGCTCGATT+AG" (SEQ ID NO: 796597), requiring a read match to begin with the first nucleotide following the last read nucleotide matching to the Plate Regular Expression. If the read did not match the universal primer regular expression, the read was discarded and plate/well assignment continued with the next available read to process, if any. Otherwise the nucleotides of the read matching to the universal primer regular expression were recorded for use during the last stage of matching and during assembly.

In stage 3, analysis of possible sample identification regions, a read was checked against all of the regular expressions listed in column "Sample Identification Region Regular Expression" in Table 14, requiring a match to begin with the first nucleotide following the last read nucleotide matching to the universal primer regular expression. If no match was found the read was discarded and plate/well assignment continued with the next available read to process, if any. If a match was found and the sample ID column contained only a single identifier, the sample ID of the read was assigned to be the ID found in the sample ID column. If the sample ID column contained more than a single identifier, those identifiers were considered "candidate sample IDs". The read was then checked sequentially against all of the regular expressions listed in column "Sample Identification Region Regular Expression" of Table 15 where at least one of the corresponding sample IDs in the "Sample ID" column of Table 15 matched with a candidate sample ID. If the read matched the regular expression, and the match began with the first nucleotide after the last read nucleotide matching to the universal primer regular expression, the right-most identifier from the candidate sample IDs was assigned as the read's sample ID. Otherwise, the right-most identifier was removed from the list of candidate sample IDs and the process repeated with the smaller list of candidate sample IDs until either a match was found, or, if no matching regular expression was found in the list of regular expressions in Table 15 then the last candidate sample ID (that is, the left-most in the original list of candidate sample IDs) was assigned as the sample ID for the read.

Reads that were discarded during the plate ID and sample ID assignment process were not included in the sequence listing.

Assembly of Sequences

All sequence reads assigned to a sample ID associated with a well were assembled to produce consensus sequences. These consensus sequences correspond to the heavy and light chain mRNA sequences expressed in the sorted cells.

Sequences were assembled with Newbler 2.5 (Runs 1 and 2), and Newbler version 2.6 and/or Mira version 3.4.0 for other sequences.

Sequences in the listing with a Platform field of "454", a Chain Type field of "mixed", a Run ID of "1" or "2" and a Sequence Type of "nb" are contigs resulting from an assembly using newbler. To assemble these sequences, sff output files from 454 sequencing, which contain both sequences and quality scores for each nucleotide, were read into Python using the Biopython package and sequences subdivided according to their compound barcodes (sample-ID+plate-ID) as described above and output into separate sff files. These files were then reparsed by sfffile (provided by GS FLX data analysis software) into sff files with file headers understood by Newbler, a sequence assembler provided in the GS FLX data analysis software suite, using the "-force", "-cdna" and "-urt" options. Newbler then assembled forward reads with shared compound barcodes. Because reverse reads have only a 3' plate-ID, it is possible that sequence assembly could occur between forward and reverse reads of sequences from different cells. For circumventing this potential problem, the heavy- and light-chain V(D)J usage of both assembled forward and unassembled reverse reads can be first identified using HighV-QUEST (http://imgt.cines.fr/HighV-QUEST/index.action). Sequences can then further grouped according to their V(D)J usage before being assembled again with Newbler using one assembled forward read and the reverse reads that share the same V(D)J usage. This can be repeated for all assembled forward reads. Sequence assembly can also be done to be intolerant of nucleotide mismatches, thereby preventing assembly of forward and reverse reads from different cells that share the same V(D)J usage. This way, inappropriate sequence assembly of reverse reads between highly similar sequences from different cells can be largely avoided.

Sequences in the listing with a Platform field of "454", a Chain Type field of "heavy" or "light", a Run ID of "3" or "4" and a Sequence Type of "nb" are contigs resulting from assemblies of 454 reads, executing Newbler with this command line: runAssembly -cdna -o output seqs.fastaq where seqs.fastq contained a single well's trimmed reads in FastQ format.

Any wells for Run ID 3 or Run ID 4 reads which Newbler did not create exactly one heavy chain contig or exactly one light chain contig were reanalyzed by assembling with mira. Sequences in the listing with a Platform field of "454", a Chain Type field of "heavy" or "light", a Run ID of "3" or "4" and a Sequence Type of "multim50" or "zerom50" are contigs resulting from these assemblies, executing mira with this command line: mira --project=seqs --job=denovo,est, accurate,454 454_SETTINGS -ED:ace=yes -AL:egp=no -CL:pvlc=-yes --fastq -notraceinfo A file named seqs_in.454.fastq contained a single well's trimmed reads in FastQ format.

For wells from Run ID 3 or Run ID 4 reads where neither Newbler nor mira created contigs using the above assembly commands, a different Newbler command was executed. Sequences in the listing with a Platform field of "454", a Chain Type field of "heavy" or "light", a Run ID of "3" or "4" and a Sequence Type of "urt" are contigs resulting from these assemblies, where Newbler was executed with this command line: runAssembly -cdna -ud -urt -o output seqs. fastaq where seqs.fastq contained a single well's trimmed reads in FastQ format.

Sequences in the listing with a Platform field of "PacBio", a Chain Type of "heavy" and a Sequence Type of "pb" are contigs resulting from assemblies of reads from the PacBio platform, executing mira with the command line: mira --project=seqs --job=denovo,est,accurate,454 454_SETTINGS -ED:ace=yes -AL:egp=no -CL:pvlc=yes --fastq -notraceinfo A file named seqs_in.454.fastq contained a single well's trimmed reads in FastQ format.

Amino Acid Sequences

Sequences in the listing with a Platform Field of "454" and a Sequence Type of "nb-aa", "urt-aa", "multim50-aa" or "zerom50-aa" are amino acid sequences determined by translating the nucleotide sequences of assemblies of 454 reads as described under "Assembly of Sequences".

Sequences in the listing with a Platform Field of "PacBio" and a Sequence Type of "pb-aa" are amino acid sequences determined by translating the nucleotide sequences of assemblies of Pacifc Biosciences reads as described under "Assembly of Sequences".

Sequences in the listing with a Sequence Type of "sanger-aa" are amino acid sequences determined by directly translating reads determined by Sanger sequencing.

Other Sequencing Data Analysis Options

The workflow of data analysis described above can be used to accurately determine the heavy- and light-chain sequences of each cell. However, this information is not absolutely necessary for our "selection screening" approach (see "screening of expressed human antibodies"). For the selection screen to work, we first cluster paired antibody sequences into clonal families, on the basis of their heavy chain V(D)J usage and light chain VJ usage. Therefore, we do not require the full sequence of the immunoglobulin heavy and light chains, and can use sufficient sequence information to determine V(D)J usage. Therefore, we can tolerate sequencing errors and can use lower-quality reads generated by 454 or any other sequencing technology. Sequence assembly of the forward read is not generally an issue because all sequences can be first grouped according to their compound barcode before being assembled. Because each compound barcode comes from one sample/cell, there is only one 'correct' sequence for each immunoglobulin chain with the same compound barcode. Sequencing errors in different strands can then be averaged out because it is unlikely that all sequencing errors occur at the same bases, meaning that taking the consensus base sequence will give the most accurate sequence. In cases of ambiguity, bases with high Phred quality scores will generally be chosen instead. Because 454 trims sequence reads from the 3' end until only higher quality reads remain, this can result in very short reads. With our method, we can tolerate lower-quality reads and thereby use much longer reads generated by 454 (400-500 bp). With these longer reads, we can identify V(D)J usage without requiring assembly of the forward read with the reverse read, thereby making the 3' plate-ID non-essential in some aspects. Furthermore, the latest generation of 454 sequencing can sequence up to a mean of 746 bp and a mode of 800 bp. Thus, sequencing from just the forward reads can be sufficient to cover the entire heavy- and light-chain immunoglobulin amplicons, also making the 3' plate-ID non-essential, in some aspects, because assembling forward with reverse reads is no longer required.

Selection and Cloning of Antibodies

After assembly, heavy and light chain sequences were analyzed to select antibodies for characterization. Antibodies were selected based on predicted V(D)J germline usage and inspection of evolutionary trees derived from the antibody sequences. The selected antibodies were cloned, expressed, and characterized in different assays.

V(D)J Assignment

Heavy and light chain sequences from Runs 1 and 2 were analyzed with V-QUEST (Brochet, X. et al., *Nucl. Acids Res.* 36, W503-508 (2008)), software that compares an antibody chain sequence to a database of known alleles of germline sequences and predicts the germline alleles used in the antibody, how the germline sequences were recombined, and mutations in the antibody relative to the germline. Table 18 shows results of a V-QUEST V(D)J assignment for the antibodies which were chosen for further characterization; the same data were obtained for all other sequence assemblies from Run 1 and Run 2 as well. Some sequences from Run 3 and Run 4 assemblies were analyzed with SoDA (Volpe, Cowell and Kepler, *Bioinformatics* (2006) 22 (4): 438-444), software similar to V-QUEST.

If the patient's genome has been sequenced, the genome sequence data can be used as the germline sequences for the VDJ assignment analysis, further improving the ability to reliably identify somatic hypermutations in the patient's antibody sequences.

Evolutionary Trees and Clonal Families

The nucleotide sequences corresponding to the mature peptides of heavy chains from Runs 1 and 2 were separated into sets that corresponded to the patient from which they were derived. From these individual sets the software clustalx2 (Larkin M A, Blackshields G, Brown N P, Chenna R, McGettigan P A, McWilliam H, Valentin F, Wallace I M, Wilm A, Lopez R, Thompson J D, Gibson T J, Higgins D G. (2007) *Bioinformatics*, 23, 2947-2948) was used to generate an alignment and tree using default settings for all parameters.

Evolutionary trees of sequences from a patient can also be constructed from the set of sequences from individual clonal families The putative progenitor antibody heavy and light chain sequences for the family can be inferred and added to the set of sequences if they are not already in the set. An evolutionary tree for the set can be constructed using, for example, Maximum Parsimony, Maximum Likelihood, or any suitable algorithm, and the tree can be rooted at the sequence of the progenitor antibody. The tree can be constructed on the basis of the heavy chains alone, or the light chains alone, or preferably by constructing the tree based on the individual heavy and light chains simultaneously, so that the tree represents the co-evolution of the heavy and light chains.

Antibody Selection

For each patient, the table of V-QUEST results was reviewed in conjunction with the trees built from Run 1 or Run 2 sequences (viewed in TreeViewX: http://darwin.zoology.gla.a.c.uk/~rpage/treeviewx). Representative sequences were selected to cover the different families of VDJ present based on the V-QUEST data, inspecting the corresponding sequences on the tree to choose sequences that appeared to be representative of the clade. Typically one sequence was selected from each clade. Some of the selected sequences came from families with many members, but some were also selected from families with few members or one member. The selected sequences are described in Table 18. For each antibody in Table 18, the column "Antibody" is the same as the text following the "-" in the Contig ID field of the name associated with the sequence in the Sequence Listing.

Cloning and Expression of Cloned Light and Heavy Chain Immunoglobulin Pairs

Vectors

One system is a Neomycin and dihydrofolate reductase (DHFR) selectable vector system modified from Invitrogen vectors pcDNA3.3 and pOptivec. An alternative system is the Lonza GS system, in which the amplifiable, selectable marker is glutamine synthetase (GS) (see below). Sequences encoding the immunoglobulin kappa light chain, lambda light chain, and gamma heavy chain are inserted into vectors. Kozak consensus and leader sequences are already present in the clones, and thus do not need to be engineered into the vectors. The constant regions are synthesized to contain 5'-flanking restriction sites and one or more other internal restriction sites. For facilitating the cloning of varied immunoglobulin heavy and light chains, inserts are engineered with multiple restriction sites that increase the possibility that the clone itself will not contain the restriction site and therefore not be cut internally. The inserts have two different 8-cutter restriction sites at the 5' end of the insert region and at two different restriction sites engineered into constant regions. The 5' restriction sites are FseI and PacI for both light chains, and AscI and AsiSI for the gamma heavy chain. Restriction sites engineered into the constant region themselves are NheI and XhoI for both light chains, and EcoRI and SacII for the gamma heavy chain. See Table 16 for the sequence of the constant region inserts containing the restriction sites. Heavy or light chain clones from the $1^{st}$ PCR reaction are then subjected to a $2^{nd}$ round of PCR with cloning primers, which have 5' flanking restriction sites that are incorporated into the clones. Appropriate restriction enzymes are used for cutting the expression vectors and the clones, which now have complementary ends and are ligated together using T4 DNA ligase. Both the Invitrogen and Lonza GS vector systems contain an amplifiable selection marker. This marker is DHFR in the Invitrogen system and GS in the Lonza GS system. Under selection pressure from the appropriate selector (methotrexate for DHFR and L-methionine sulfoximine for the glucose synthetase (GS)), genes linked to the selection marker are amplified together with it. With more copies of the immunoglobulin genes, there is greater secretion of antibodies. This is useful when large amounts of antibody need to be purified for subsequent in vivo screening for neutralizing antibodies.

Cloning and Expression

Assuming that the highest-affinity plasmablasts are selected for during germinal center maturation, we expect that the highest-affinity clonal family also has the highest number of clones. Furthermore, the highest-affinity clone within each clonal family will also be the most frequent clone within that family. On the basis of these assumptions, we choose to express the highest-frequency clone from the 5 largest clonal families from each patient sample in some aspects. Clones are amplified from the $1^{st}$ PCR cDNA, where all samples from the same plate, each containing a single cell, have been pooled together. The forward primer contains the sample-ID and therefore amplifies only DNA barcoded with that particular sample-ID. This is highly specific because sample-IDs contain nucleotide differences between one another. Some sample-IDs can have identical cloning forward primers and clones amplified by these primers must subsequently be distinguished from each other by bacterial colony selection too. Both forward and reverse primers contain flanking restriction sites (first and second restriction site regions) that allow the clone to integrate (with coding frame aligned) into a vector that already contains a kappa, lambda, or gamma constant region. See Tables 4 and 5 for cloning primer sequences. Light chains are cloned into modified pcDNA3.3, and heavy chains into modified pOptivec, or both chains are cloned into the Lonza GS dual-expression vector. Mammalian cells are either doubly transfected with separate expression vectors encoding the immunoglobulin heavy and light chain genes, or singly transfected with a dual-expression vector containing both the heavy and light chain genes. Supernatants containing the secreted antibodies are then collected and screened for the desired properties.

In some instances, variable regions of Ig genes may be cloned by DNA synthesis, and incorporating the synthesized DNA into the vector containing the appropriate constant region using restriction enzymes and standard molecular biology. During synthesis, the exact nucleotide sequence need not be followed as long as long as the amino acid sequence is unchanged, unless mutagenesis is desired. This allows for codon optimization that may result in higher expression levels. This also allows for adding in restriction sites for the purpose of cloning. Non-translated sequences such as 5' UTR and barcode sequences need not be synthesized and leader sequences can also be swapped for other signal peptide sequences known for higher expression levels. These result in an Ig nucleotide sequence that can be very different from the high-throughput reads but give identical amino acid sequenced when expressed.

In some instances, the sample-ID barcode adaptor added on during reverse transcription may already incorporate a restriction enzyme site. This results in an adaptor with a restriction site 3' of the sample-ID barcode in the PCR amplicon pool. During cloning with cloning primers, desired amplicons are amplified from a plate-specific amplicon pool using 5' primers that are complementary to the sample-ID barcode sequences, and chain specific 3' primers (for the kappa, lambda and gamma chains). 3' primers will add on 3' restriction sites. 5' primers do not need to add restriction sites as the 5' primer already contains a restriction site 3' of the well-ID barcode. Following this amplification, restriction enzymes are used to cut the amplicon for ligation into the vector containing the constant region insert. During the restriction enzyme digest, sequences added on to the 5' end of the Ig gene sequences, such as barcodes and universal sequences are cut as they are 5' of the 5' restriction site.

Alternative Methods for Cloning and Expression

In another aspect, variable regions of Ig genes may be cloned by DNA synthesis, and incorporating the synthesized DNA into the vector containing the appropriate constant region using restriction enzymes and standard molecular biology. During synthesis, the exact nucleotide sequence need not be followed as long as long as the amino acid sequence is unchanged, unless mutagenesis is desired. This allows for codon optimization that may result in higher expression levels. This also allows for adding in restriction sites for the purpose of cloning. Non-translated sequences such as 5' UTR and barcode sequences need not be synthesized, leader sequences can also be swapped for other signal peptide sequences known for higher expression levels. These result in an Ig nucleotide sequence that can be very different from the high-throughput reads but give identical amino acid sequenced when expressed.

In another aspect, the well-ID barcode adaptor added on during reverse transcription may already incorporate a restriction enzyme site. This results in an adaptor with a restriction site 3' of the well-ID barcode in the PCR amplicon pool. During cloning with cloning primers, desired amplicons are amplified from a plate-specific amplicon pool using 5' primers that are complementary to the well-ID barcode sequences, and chain specific 3' primers (for the kappa, lambda and gamma chains). 3' primers will add on 3' restriction sites. 5' primers do not need to add restriction sites as the 5' primer already contains a restriction site 3' of the well-ID barcode. Following this amplification, restriction enzymes are used to cut the amplicon for ligation into the vector containing the constant region insert. During the restriction enzyme digest, sequences added on to the 5' end of the Ig gene sequences, such as barcodes and universal sequences are removed as they are 5' of the 5' restriction site.

Cloning of Heavy and Light Chains into Lonza Vectors

Cloning Immunoglobulin Constant Regions

Lonza vectors were obtained through Stanford University's academic licensing agreement with Lonza. Kappa and lambda light chains were inserted into vector pEE12.4 and the gamma heavy chain was inserted into vector pEE6.4. Heavy and light chain sequences were cloned in two steps: first, the constant regions were cloned in, followed by the 5' end of the immunoglobulin chains (the leader and V(D)J sequences). Constant regions inserts were gene-synthesized by Intergrated DNA Technologies (IDT), and contained appropriate silent mutations for gene optimization and incorporation of restriction sites. Inserts were obtained from IDT in their proprietary pIDTSmart vector. Insert sequences are in Table 17. IgG1 was used as the gamma heavy chain constant region. The alleles used were Km3, Mcg$^-$Ke$^-$Oz$^-$ and Glm3 for kappa, lambda and gamma chains respectively. To incorporate the constant regions into the Lonza vectors, the Lonza vectors and the pIDTSmart-constant region inserts were all individually transformed into competent dam$^-$dcm$^-$ $E.$ $coli$ and plasmids were purified using Qiagen miniprep kit following manufacturer's instructions. Plasmids were then digested using HindIII and BclI at 37° C. for 1 hour and run on a 1.2% agarose gel at 150V for 1 hour. Digested Lonza vectors and the constant region inserts were gel purified and ligated (pEE12.4 with Km3 or Mcg$^-$Ke$^-$Oz$^-$ light chains and pEE6.4 with Glm3 gamma1 heavy chain) using T4 DNA ligase for 10 minutes at RT in a ratio of 3:1 insert:vector. T4 DNA ligase was then inactivated at 70° C. for 8 minutes and 5 ul of the ligation mix was transformed into heat shock competent TOP10 cells using standard molecular biology techniques. Colonies were picked and insertion was verified via Sanger sequencing.

Cloning Immunoglobulin Variable Regions

Next, pEE12.4 containing either lambda or kappa light chain was digested using AscI and XmaI for 5 hours at 37° C. and gel purified. pEE6.4 containing the gamma 1 heavy chain was digested using AscI and AgeI for 5 hours at 37° C. and gel purified. Selected amplicons were selectively amplified using well-ID specific forward primers and constant region-specific reverse primers (Tables 4 and 5) from the specific plate-ID 100× dilution of the 1$^{st}$ PCR. The forward primers had the restriction site AscI on the 5' end of the primer, and the reverse primers contained the XmaI or AgeI restriction site for the light and heavy chain primers constant region primers respectively. PCR cycling was done using an initial denaturation at 98° C. for 30 seconds, and 35 to 45 cycles at 98° C. for 10 seconds, 68° C. for 15 seconds and 72° C. for 20 seconds. The final extension was 72° C. at 5 minutes and on hold at 4° C. indefinitely. The PCR products were purified using PCR$_{u96}$ ultrafiltration plates from Millipore, following manufacturer's instructions. Following this, PCR products were double digested for 3 hours at 37° C. using AscI and XmaI for the light chains and AscI and AgeI for the gamma 1 heavy chain. Digested products were then run on a 2.5% low melt agarose with gelgeen (Biotium) and visualized under blue light. Gel slices containing bands at the appropriate sizes were excised. In gel ligation was performed by melting the gel slices at 65° C. and adding the appropriate digested and Antarctic phosphatase (NEB)-treated Lonza vectors containing the constant region insert, and incubating with T4 DNA ligase for 1-3 hours at RT. Heat-shock competent bacteria were then transformed and plated on ampicillin agar. 6 clones per construct were picked and grown in 2×LB (2× concentrated Luria-Bertani broth). Miniprep was performed using Millipore's Multiscreen 96-well filter plates according to manufacturer's instructions (www.millipore.com/techpublications/tecg1/tn004) to obtain plasmid DNA. Colony PCR was performed using an initial denaturation of 95° C. for 5 minutes, and 40 cycles of 95° C. for 1 minute, 50° C. for 2 minutes, 72° C. for 1 minute, and a final extension at 72° C. for 5 minutes and holding t 4° C. indefinitely. Clones with the appropriate insert were sent for Sanger sequencing at Sequetech, Mountain View, Calif., USA. Clone VDJ identification was done using IMGT HIGHV-Quest and the correct clones were kept as both bacterial stock (stored at −80° C. with 15% glycerol) and plasmids.

Expression of Monoclonal Antibodies in 293T

Transient dual transfections of paired pEE12.4-lightchain and pEE6.4-heavychain constructs were done using Lipofectamine 2000 following manufacturer's protocol. Transfections have been done in 48-well, 24-well, 6-well, 60 mm and 100 mm dishes. In brief, 293T cells were cultured in DMEM+10% ultralow IgG FBS (Invitrogen) to prevent bovine IgG from competing with secreted human IgG at the downstream protein A purification step. 293T cells were cultured for 20 passages before new aliquots liquid N$_2$ were thawed and used. For 48-well plate transfections, each well was seeded the day before with 8×10$^4$ cells, and allowed to grow to ~90% confluency the next day. 50 ng each of heavy and light chain constructs were incubated in Optimem media for a final volume of 50 ul, and Lipofectamine 2000 was also separately incubated with 50 ul of Optimem media. Both incubations were from 5-25 minutes. Lipofectamine 2000 and the constructs were then mixed by gentle pipetting and incubated for 20 minutes before adding to 293T cells and gently mixed. Media was changed the next day and culture supernatants were collected every other day (e.g., Monday, Wednesday, and Friday) for 2 weeks. For transfections of other sizes, the following amounts of constructs and Lipofectamine 2000 were used: for 24-well plate transfections, 100 ng of each construct were used with 1.25 ul of Lipofectamine 2000. For 60 mm dishes, 625 ng of each construct were used with 12.5 ul of Lipofectamine 2000. For 100 mm dish transfections, 3 ug of each construct were used in 37.5 ul of Lipofectamine 2000.

Anti-Human IgG ELISA

In some instances, human IgG ELISA was done on the sample to quantitate the amount of expressed IgG in the culture supernatant, and the culture supernatant was used directly in downstream applications after normalizing the amount of antibody. Anti-human IgG ELISA quantitation kit was purchased from Bethyl Laboratories and performed according to manufacturer's instructions. In brief, 100 ul of capture antibody was coated on Nunc Maxisorp plates overnight at 4° C. and washed 5× with PBST (PBS with 0.05% Tween20). Wells were blocked with 1% BSA in PBS for an hour at RT, then washed 5× with PBST. Wells were then incubated with the appropriate standard dilutions from the kit or diluted culture supernatants for 1 hr at RT, then washed 5× with PBST. 100 ul of diluted HRP detection antibody was added to each well and incubated at RT for an hour, then washed 5× with PBST. 50 ul of TMB substrate solution was added and the reaction stopped with 50 ul of stop solution. Absorbance was read on a SpectraMax M5 spectrophotometer at 450 nm and standard curves generated with a 4-parameter curve. Antibodies were kept at 4° C. in PBS with 0.1% sodium azide as a preservative.

Protein A-IgG Purification of Expressed Monoclonal Antibodies

In other instances, antibodies were first purified from culture supernatant and quantitated using BCA before use. In brief, culture supernatants were collected 3× a week for 2 weeks into 50 ml tubes and stored at 4° C. with 0.1% sodium azide as an additive until protein A-IgG purification. Culture supernatants were spun down and decanted to remove any cellular aggregates. 1M pH 9.0 Tris was added to culture supernatants to ensure pH is between 7.5-8.0 as determined by pH indicator strips. Protein A plus agarose beads (Pierce) were washed 2× with PBS before 400 ul of a 50% slurry was added to culture supernatants and incubated at 4° C. overnight on a rotator to ensure even mixing of the beads. Beads were recovered by spinning culture supernatant at 1000g for 5 minutes and pipetting out the beads from the bottom of the tubes into 5 ml gravity flow columns. Beads were washed with 4×2 ml of PBS before elution with 2×1.5 ml of IgG elution buffer (Pierce), which is a low pH elution buffer, into an Amicon-4 100 kDa concentrator column. Eluted antibody was immediately neutralized with 400 ul of 1M Tris pH8.0. Antibodies were then concentrated by spinning at 1000g in Amicon-4 100 kDa concentrators for 10 minutes, followed by a 2 mL wash of PBS, and a 2 ml wash of PBS with 0.1% sodium azide. Antibody concentrations were determined by BCA assay, and adjusted to 0.5 mg/ml. Protein A Plus Agarose was regenerated by washing with 1×2 ml of PBS, 3×2 ml of IgG elution buffer and a wash with 3 ml of PBS with 0.1% sodium azide and kept at 4° C. Columns can be regenerated up to 5 times.

Screening of Expressed Human Antibodies

Screens for Antibody-Antigen Binding

Selected antibodies (see cloning and expression section above) are first screened for their ability to bind to the antigen of interest, and then antibodies of the entire clonal family are expressed and screened for their ability that block or neutralize the antigen (see "functional screens" below). The IgG concentration in supernatants containing antibodies of interest is first determined by IgG ELISA, so that the same amount of IgG can be used for each sample in the antibody-antigen binding screen. In other cases, IgG was purified from the supernatant using Protein A agarose beads, and quantified with BCA assay using bovine immunoglobulins as the standard. Purified IgGs were then normalized to the same concentration before use in screening antibodies. To screen antibodies that bind antigen, we perform an indirect ELISA. A 96-well plate is coated overnight with the antigen of interest, and excess antigen is then washed off. Supernatants containing antibodies of interest are then added to the wells and incubated for four hours, after which the wells are washed. As a positive control, known amounts of commercially available antibodies (from non-human species) that are specific for the antigen are added to separate wells containing the antigen. As a negative control, commercially available antibodies specific for an irrelevant antigen are added to separate wells containing the antigen of interest. An HRP-conjugated secondary antibody is then added to the wells, incubated for 30 minutes, and excess washed off. Tetramethylbenzidine (TMB) is then added to the plate, and the reaction allowed to proceed until color is observed in the positive-control wells. The reaction is then stopped with acid, and absorbance is measured. Specific well supernatants are deemed to contain antibodies that bind the antigen of interest if the absorbance readout they yield is significantly higher than that in the negative control.

Fluzone ELISA

Volunteers were administered the 2010/2011 season flu vaccine from Fluzone, which consists of 3 strains of inactivated virus, the A/California/7/2009, A/Perth/16/2009, B/Brisbane/60/2008 strains. Fluzone ELISAs were done to determine if monoclonal antibodies derived from vaccinated volunteers bind to the flu vaccine itself as an initial screen for expressed antibodies with binding activity. Fluzone vaccine was diluted 100× in a pH9 carbonate buffer and coated on Nunc Maxisorp plates either at RT for 1 hour or overnight at 4° C. Plates were then washed 5× with PBST (PBS w/0.05% Tween20) and blocked with PBS w/1% BSA for 1 hour at RT. 100 ul of 100 ng/ml of expressed flu antibodies were then added to wells at RT for 1 hour, before washing 5× with PBST and adding diluted HRP detection antibody (from Bethyl Labs human IgG ELISA quantitation kit) for 1 hour at RT. Plates were washed 5× with PBST and 50 ul of TMB substrate were added. Color was allowed to develop for up to 30 min before stopping the reaction with 50 ul of stop solution. Plates were read on a SpectroMax M5 spectrophotometer at 450 nm absorbance. Antibodies used in this assay are described in Table 19. Sequences of antibodies can be referred to in the master table, Table 18.

Surface Plasmon Resonance Determination of Flu Antibody Affinities

Binding of monoclonal antibodies (mAbs) to HA molecules was analyzed at 25° C. using a ProteOn surface plasmon resonance biosensor (BioRad Labs). Expressed flu monoclonal antibodies derived from the plasmablasts of a flu-vaccinated donor (25 nM in pH 4.5 acetate buffer) were coupled to a GLC sensor chip with amine coupling at a target density of 800 resonance units (RU) in the test flow cells using EDAC-NHS chemistry. Unreacted active ester groups were quenched with ethanolamine. Purified recombinant hemagglutinin H3 (HA($\Delta$TM)(H3N2/Perth/16/2009) and H1 (HA($\Delta$TM)(A/California/07/2009)(H1N1)) were purchased from Immune Technology Corp. (New York, N.Y.) and were diluted to 100, 50, 25, 12.5, 6.25, nM, along with a blank buffer control were injected at a flow rate of 30 $\mu$L/min with 120 seconds contact time and 2000 seconds dissociation time. Binding kinetics and data analyses were performed with BioRad ProteON manager software. Affinity measurements were calculated using the bivalent analyte algorithm, as HA consisted of several repeating units. The accuracy of the fitted curves was verified by checking that the $\chi 2$ values of the goodness of each fit was below 10% of the peak binding value (Rmax). Antibodies used in this assay are described in Table 20. Sequences of antibodies can be referred to in the master table, Table 18.

RA Antibody Reactivities on RA Antigen Microarrays

To print the antigen microarrays, antigens were diluted in phosphate buffered saline to 0.2 mg/mL and attached to ArrayIt SuperEpoxy slides using an ArrayIt NanoPrint Protein LM210 system. Slides were marked with a hydrophobic marker pap pen and blocked overnight in PBS with 3% fetal bovine serum and 0.05% Tween 20 at 4° C., gently rocked at 30 rpm. Arrays were probed with 400 uL of 40 ug/mL monoclonal antibody for one hour at 4° C., gently rocked at 30 rpm. Arrays were then washed and incubated in Cy3 conjugated anti-human IgG/IgM secondary antibody diluted at 1:2500 for 45 minutes at 4° C., gently rocked at 30 rpm. Following another wash, slides were scanned using a GenePix 4300A Microarray Scanner. GenePix 7 software was used to find the median florescence intensity of each feature and background.

To analyze the data, background fluorescence intensities were subtracted from each feature and expressed as the median value of the four antigen features on each array. Median intensities were log transformed with a cut-off value of 10. These values were subjected to hierarchical clustering using Cluster software to arrange antigens based on similarities to each other. The relationships were displayed as a heatmap using Java TreeView software. Antibodies used in this assay are described in Table 21. Sequences of antibodies can be referred to in the master table, Table 18.

Anti-Histone 2A ELISA

A direct ELISA was used for detection of antibodies to histone 2A. Microtiter plates (Nunc Maxisorp) were coated with 100 µl of recombinant H2A in carbonate buffer, at a concentration of 20 µg/ml, and incubated at 4° C. overnight. After blocking in PBS containing 1% bovine serum albumin (BSA), RA patient-derived antibodies were used in a titration from 15 ug/ml to 250 ug/ml in dilution buffer (PBS containing 0.1% BSA and 0.1% Tween-20), added to the plate in duplicate at 100 µl/well, and incubated for 2 hours at room temperature. The samples were then incubated for 1 hour at room temperature with a 1:5,000 dilution of a monoclonal, horseradish peroxidase-labeled goat anti-human antibody. The reaction was developed by application of 3,3',5,5'-tetramethylbenzidine substrate (TMB) (Sigma-Aldrich) for 15 minutes and stopped by addition of 50 µl of 2N H2SO4. Relative quantification of antibodies against was performed by optical densitometry at 450 nm using known seropositive RA serum as a positive control. Antibodies used in this assay are described in Table 22. Sequences of antibodies can be referred to in the master table, Table 18.

Anti-CCP2 ELISA

Anti-CCP2 ELISA was performed according the manufacturer's instructions (Eurodiagnostica, Malmo, Sweden). Briefly, antibodies derived from RA patients are diluted to approximately 125 ug/ml in dilution buffer (PBS containing 0.1% BSA and 0.1% Tween-20), added to the pre-blocked commercial CCP2 ELISA plate at 100 µl/well, and incubated for 2 hours at room temperature. The samples were then incubated for 1 hour at room temperature with a 1:5,000 dilution of a monoclonal, horseradish peroxidase-labeled goat anti-human antibody. The reaction was developed by application of 3,3',5,5'-tetramethylbenzidine substrate (TMB) (Sigma-Aldrich) for 15 minutes and stopped by addition of 50 µl of 2N H2SO4. Relative quantification of antibodies against was performed by optical densitometry at 450 nm using standards provided by the vendor and known positive RA serum. Antibodies used in this assay are described in Table 22. Sequences of antibodies can be referred to in the master table, Table 18.

Anti-Rheumatoid Factor ELISA

For detection of antibodies to rheumatoid factor (RF), microtiter plates (Nunc Maxisorp) were coated with 10 ug/ml of rabbit IgG in carbonate buffer, and incubated at 4° C. overnight. After blocking in PBS containing 1% bovine serum albumin (BSA), RA patient derived antibodies were at 5 ug/ml dilution buffer (PBS containing 0.1% BSA and 0.1% Tween-20), added to the plate in duplicate at 100 and incubated for 2 hours at room temperature. The samples were then incubated for 1 hour at room temperature with a 1:5,000 dilution of a monoclonal, horseradish peroxidase-labeled goat anti-human antibody. The reaction was developed by application of 3,3',5,5'-tetramethylbenzidine substrate (TMB) (Sigma-Aldrich) for 15 minutes and stopped by addition of 50 µl of 2N H2SO4. Relative quantification of antibodies against was performed by optical densitometry at 450 nm using two known RF+ control serum as a positive controls. Antibodies used in this assay are described in Table 23. Sequences of antibodies can be referred to in the master table, Table 18.

Immunohistochemistry of Antibodies from Lung Adenocarcinoma Patient on Lung Cancer Tissue Arrays Two different types of tissue microarray slides were purchased from US Biomax. They were VLC 12 and BS0481. A variety of lung carcinomas tissue cores are included on the slides, including lung adenocarcinomas, and also normal lung tissue controls. Slides were heated in a citrate pH6.0 antigen retrieval buffer at 95-99° C. for 40 minutes before allowing to cool to RT. Slides were pretreated with 0.02% Triton-X and 0.6% H2O2 for 20 minutes. Slides were then blocked with 10% normal goat serum in TBST (TBS with 0.05% Tween20) for 2 hours before further blocking in 100 ug/ml of F(ab) goat-anti-human IgG (Jackson Immunoresearch) overnight at 4° C. Slides then underwent an avidin/biotin block (Vector Laboratories) according to manufacturer's instructions. Slides were then incubated in 5 or 10 ug/ml of expressed lung antibody for 1 hour at RT, washed 3×5 minutes with TBST, and then incubated with a biotinylated goat-anti-human secondary antibody for 20 minutes at RT. Slides were then washed 3×5 minutes with TBST and incubated with prepared Vectastain ABC reagent for 30 minutes at RT. Slides were then washed 3×5 minutes of TBST and stained with Vector Red (Vector Laboratories) and the color development tracked with a light microscope. After the appropriate staining time, the reaction was stopped by washing with distilled water and counterstained with hematoxylin. Slides were aqueous-mounted and photographed with a BX-51 microscope. Antibodies used in this assay are described in Table 24. Sequences of antibodies can be referred to in the master table, Table 18.

Flow Cytometry Determination of Binding of Antibodies Expressed from Lung Adenocarcinoma Patient to Lung Cancer Cell Lines Lung cancer cell lines used were A549, H226, H441, H23, H1975, H1437, H2126, H1650 and H2009. HEK 293T cells were also used as a negative control. Cells were detached by incubating cells in PBS without $Ca^{2+}$ and $Mg^{2+}$ with 2 mM EDTA for 1 hour at 37° C. This is to prevent damaging cell surface antigens that may be done with trypsinizing or any other proteolytic digest to detach cells. Cells were washed once with FACS buffer (HBSS with 2% FCS) before suspended in 50 ul of FACS buffer and incubated with 10 ug/ml, 3 ug/ml, 1 ug/ml, 0.2 ug/ml of expressed lung antibodies to titrate the dose. The optimal concentration was found to be from the 0.2-1 ug/ml range. Therefore, 1 ug/ml, 0.5 ug/ml, 0.25 ug/ml of lung antibodies were used subsequently. Lung antibodies were incubated for 30 minutes at 4° C. before washing with 2×200 ul of FACS buffer in 96-well plates. Anti-human IgG-PE was then added and incubated for 15 minutes at 4° C. in the dark. Samples were then washed 2×200 ul with FACS buffer and resuspended in 200 ul of FACS buffer and analyzed on a BD LSR II or LSR Fortessa. Sytox blue was used as a live/dead staining. Antibodies used in this assay are described in Table 24. Sequences of antibodies can be referred to in the master table, Table 18.

Staph Flow Cytometry

Fixed *S. aureus* particles (Wood strain) were obtained from Invitrogen. Wood strain is a strain that expresses minimal protein A by some of the bacteria. The particles were suspended in 50 ul of FACS buffer at $10 \times 10^6$ cells/50 ul, and incubated with a titration of 10 ug/ml, 5 ug/ml or 1 ug/ml of expressed antibodies derived from staph individuals for 0.1 hour minutes at 4° C. Fixed staph particles were then washed with twice with FACS buffer before incubating for 15 min in the dark at 4° C. with anti-human IgG-FITC antibody. Particles were then washed with 1 ml of FACS buffer and resuspended in 200 ul of FACS buffer for analysis on a BD LSR II or LSR Fortessa. Antibodies used in this assay are described in Table 25. Sequences of antibodies can be referred to in the master table, Table 18.

Functional Screens

Blocking Antibody to Receptor-Ligand Interactions

To screen antibodies for their ability to block ligand-receptor interactions (e.g. cytokine-receptor interactions), we transfect 293T cells with a vector encoding the appropriate receptor. These 293T cells are also stably transfected with an NF-κB-dependent luciferase reporter—such that these stably transfected 293T cells express luciferase when NF-κB is activated. We then culture the transfected 293T cells with the appropriate ligand in the presence or absence of the candidate antibodies. 293T cells are finally assayed for luciferase expression by measuring luciferase-dependent light emission. Interaction between the ligand and its receptor, e.g. interaction between IL-17A and IL-17R, activates NF-κB. Blocking antibodies prevent NF-κB signaling by ligand-receptor binding and therefore abrogate the expression of luciferase. In cases where the ligand-receptor interaction does not activate NF-κB, other transcriptional response elements are used to drive the promoter of the luciferase gene, e.g. AP-1 response elements, etc.

Screening Antibodies for their Ability to Inhibit Cytokine Function or Inhibit a Functional Assay Functional assays can also be used to screen for anti-cytokine antibodies in patient sera or in cloned and expressed antibodies. In this approach, the expressed human antibodies are tested for their ability to inhibit cytokine or other immune mediator induction of a cellular response.

Antibodies Targeting Bacteria, Virally-Infected Cells, Parasites or Cancer Cells To screen for antibodies that kill or neutralize bacteria, virally-infected cells, parasites, or cancer cells, we culture the appropriate cell type either in the presence or absence of antibody, together with non-heat-inactivated serum (which contains complement factors). If the antibody is a neutralizing antibody, it will opsonize the bacteria, other microbes, or cancer cells and activate complement components that form the membrane attack complex (MAC), which induces cell death. To test neutralization, we run a fluorescent live/dead assay (Invitrogen), in which live and dead cells are stained with different fluorophores. Cells can be assayed for percentages of live and dead cells by using flow cytometry. The antibody that results in the highest percentage of dead cells will be a good candidate neutralizing antibody that will be further analyzed in in vivo screens.

Antibodies that Neutralize Viruses

To screen for antibodies that neutralize viruses, we perform a standard plaque-reduction assay or other in vitro cellular infection assays. Neutralizing antibodies are expected to decrease viral infection of cells. Candidate antibodies are then tested in an in vivo model.

Influenza Microneutralization Assay

Some expressed flu antibodies that showed binding activity to the Fluzone ELISA were sent to an external CRO, Virapur, LLC for microneutralization assays. In brief, two-fold dilutions of each antibody, starting from 100 ug/ml, were mixed with an equal volume of approximately 100 TCID$_{50}$ infectious units of titered stock virus in quadruplicates in wells of a 96-well plate. Virus/antibody solutions were incubated for 2 hours and then the mixture was transferred to a 96-well plate containing 80% confluent MDCK cells. Cells, antibody and virus were incubated for an additional 2 hours at 37° C., after which virus was removed, monolayers rinsed and viral growth media added to each well. Wells were observed microscopically after 72 hours for the presence of influenza virus infection. Antibodies used in this assay are described in Table 26. Sequences of antibodies can be referred to in the master table, Table 18.

Staph Inhibition Assay

S. aureus were used when in log-phase growth. They were added to 96-well polypropylene plates, and anti-staph antibody from staph patients was added at 10 ug/ml. Baby rabbit complement (Cedarlane) was added at manufacturer's recommended amount and mixed thoroughly. Plates were incubated at 37° C. for 45 minutes before being diluted 1:10, 1:100 and 1:1000 and plated on 5% TSA blood agar plates and grown overnight. Bacterial CFUs were counted and tabulated the next day. Antibodies used in this assay are described in Table 27. Sequences of antibodies can be referred to in the master table, Table 18.

Immunoprecipitation of Staph Antigens with Antibodies Derived from Staph-Infected Patients Staph protein lysate was made by lysing S. aureus using B-Per Bacterial Protein Extraction Reagent (Pierce) with 100 ng/ml of lysostaphin for 30 minutes at RT along with 1× Halt protease inhibitor, and separated from the insoluble fraction by centrifuging at 15000 rpm in a microcentrifuge. Lysate was precleaned by incubating with protein G Dynabeads for 1 hour at RT. 5 ug of antibody derived from Staph patient was bound onto protein G Dynabeads by incubating for 1 hour at RT. Protein G-bound antibodies were then incubated with precleaned staph lysate overnight at 4° C. Beads were then washed 3× with PBST (PBS with 0.1% Tween20) and heated with 5× reducing lane sample buffer (Thermo Scientific) at 95° C. for 5 minutes before running an SDS-PAGE on a 4-12% Criterion Bis-Tris gel. Proteins were visualized with RAPIDStain Reagent (Calbiochem). Antibodies used in this assay are described in Table 28. Sequences of antibodies can be referred to in the master table, Table 18.

Mass Spectrometry Identification of Peptides

Stained protein bands of interest were cut out of the gels, immersed in 10 mM ammonium bicarbonate containing 10 mM DTT and 100 mM iodoacetamide, treated with 100% acetonitrile, and then digested overnight at 37° C. with 0.1 mg trypsin (Sigma-Aldrich) in 10 mM ammonium acetate containing 10% acetonitrile. The trypsinized proteins were identified with LCMS by using the Agilent 1100 LC system and the Agilent XCT Ultra Ion Trap (Agilent Technologies, Santa Clara, Calif.) as previously described (Lopez-Avila V, Sharpe O, Robinson W H: Determination of ceruloplasmin in human serum by SEC-ICPMS. Anal Bioanal Chem 2006, 386:180-7.). LCMS data was scanned against the SwissProt or NCBInr databases by using the SpectrumMill software (Agilent) for the detection of peptides used to identify proteins. Antibodies used in this assay are described in Table 29.

Example 1: High-Throughput Sequencing of Paired Heavy- and Light-Chain Sequences from Individual B Cells We developed a method of adding compound barcodes (sample-ID+plate-ID) to sequences in order to unambiguously identify which sequences originated from the same well in a plate. We used this approach to sequence paired heavy chain and light chain immunoglobulin genes from individual B cells. Individual B cells can be sorted by flow cytometry from blood, bulk peripheral blood mononuclear cells (PBMCs), bulk B cells, plasmablasts, plasma cells, memory B cells, or other B cell populations (FIG. 1).

Figure 2:
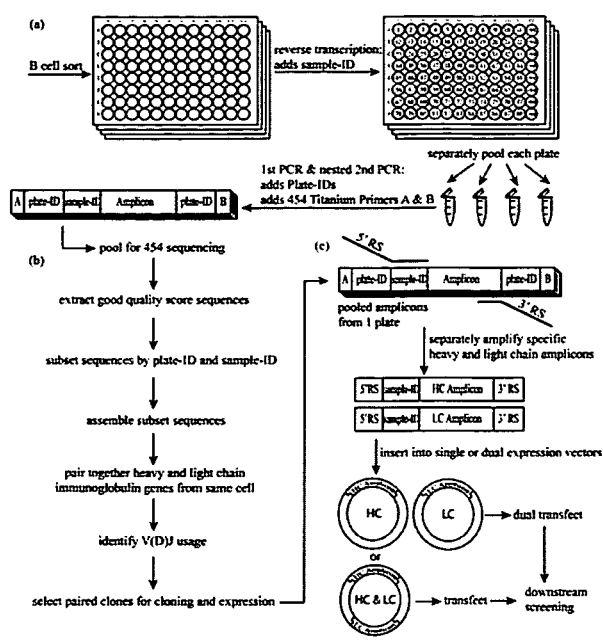
FIG. 2. Schematic of high-throughput sequencing, cloning, and expression of paired genes from single sorted cells. Desired cell populations are single cell sorted based on their expression of cell surface markers into 96-well PCR plates. During reverse transcription, barcoded (sample-IDs) DNA adaptor molecules are added onto synthesized $1^{st}$ strand cDNA utilizing the template-switching property of MMLV $H^-$ reverse transcriptases. RT products from each plate are then pooled separately and 2 rounds of PCR performed to amplify specific amplicon regions (amplicons). PCR is done with primers with 5' flanking barcodes to add plate identification regions (plate-IDs) to amplicons. Amplicons are then sent for 454 sequencing (a). Obtained sequences are subset by plate-IDs and sample-IDs before sequence assembly. Amplicons from the same cell are paired together using plate-IDs and sample-IDs and desired clones selected for cloning and expression (b). Specific amplicons can be amplified from each pooled plate of amplicons by using cloning primers that are complementary to the sample-ID of that particular amplicon. Cloning primers also add restriction site regions (RS) which are then used to insert the clone into mammalian expression vectors for downstream expression and screening. In this example, the amplicons are immunoglobulin (Ig) heavy and light chain genes which code for antibody. Expressed antibodies can then be used for downstream screening (c). 5' RS and 3' RS: 5' and 3' restriction sites respectively. HC and LC: heavy chain and light chain respectively.

First, B cells were single-cell-sorted into 96-well PCR plates, leaving one column of wells empty, as a negative control. Oligonucleotides containing different sample-ID barcodes were added into different wells during reverse transcription (RT). After reverse transcribing the mRNA, the MMLV II reverse transcriptase switches templates and transcribes the oligonucleotide, incorporating it and the sample-ID barcode into the 3' end of the 1$^{st}$ strand cDNA (FIG. 2a). All cDNAs (barcoded with a sample-ID) from one plate were then pooled and subjected to two rounds of PCR. During the PCR, 454 sequencing primers (first and second sequencing regions) and plate-ID barcodes were added onto the 5' and 3' ends of the amplicon by using PCR primers with 5'-flanking barcode sequences. Amplicons (amplicon regions) from different plates now have n different plate-IDs, and the compound barcode comprising a plate-ID and a sample-ID unambiguously identifies sequences as coming from a particular cell, allowing pairing up of sequenced heavy- and light-chain genes (FIG. 2b-c).

Figure 3:
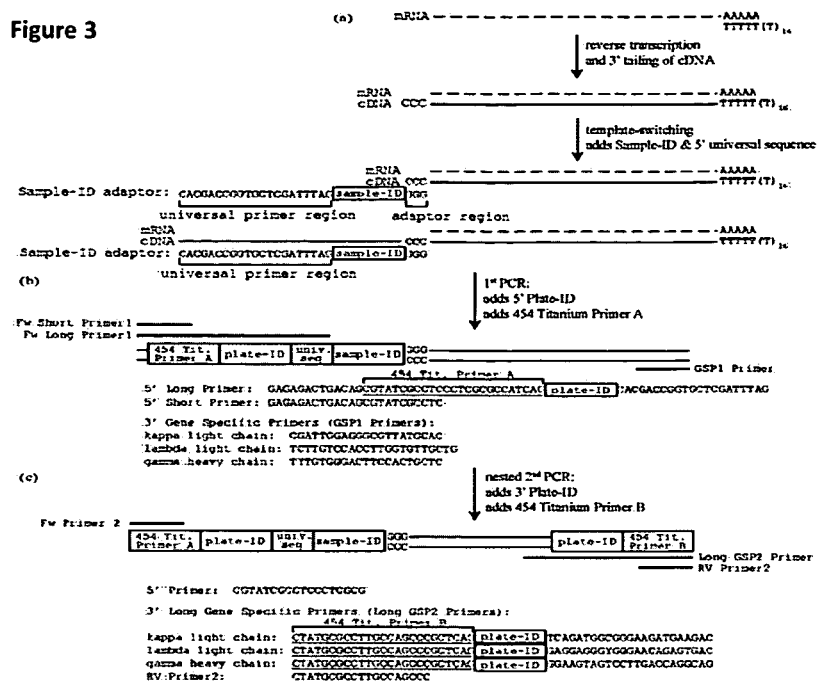
FIG. 3. Schematic of reverse transcription and PCR to add sample-Ms and plate-IDs to Ig amplicons. Reverse transcription (RT) was performed with Superscript II or Superscript III, which are MMLV H⁻ reverse transcriptases. These transcriptases have a 3' tailing activity and add a couple of cytosines to the 3' end of newly synthesized $1^{st}$ strand cDNAs. An oligonucleotide ending with -GGG (an adapter region) can complement base-pair to this and the reverse transcriptase then switches template to the oligonucleotide and carry on transcription, resulting in the incorporation of the sample-ID adaptor to the 3' end of the cDNA (a). As the sample-ID adaptor contains a 5' invariable sequence (universal primer region), forward primers complementary to this sequence can be used for subsequent PCRs. The $1^{st}$ PCR was done with Fw Long Primer1, Fw Short Primer1 and GSP1. The Fw Long Primer1 has a 5' flanking region containing a plate-ID barcode and the 454 Titanium Primer A for 454 sequencing, which were incorporated into the amplicon. The Fw Short Primer1 has a Tm similar to the GSP1 primer and was included to slightly increase the efficiency of the PCR. Each GSP1 (gene-specific primer 1) has a complementary gene specific sequence and was used to amplify a specific gene. Here, the gene-specific primers are for the kappa and lambda light chains and the gamma heavy chain to amplify these genes. Sequences for primers are shown (b). The second PCR is a nested PCR and was done with Fw Primer2, Long GSP2 Primer and RV Primer2. Sequences for primers are as shown. Long GSP2 Primer has a 5' flanking region containing a plate-ID barcode and the 454 Titanium Primer B for 454 sequencing, which were incorporated into the amplicon. Long GSP2 primers again amplify the kappa and lambda light chains and the gamma heavy chain. The RV Primer2 has a Tm similar to Fw Primer2 and was included to slightly increase PCR efficiency. Sequences for primers are shown. After RT and 2 PCRs, each amplicon will have 454 Titanium Primers A and B for 454 sequencing, two identical plate-IDs, each identifying the amplicon as coming from a particular single cell-sorted 96-well plate and a sample-ID determining its position on the 96-well plate (c). From left to right and top to bottom: SEQ ID NOs: 796593, 796594, 796593, 796061, 796062, 796064, 796063, 796065, 796595, 796365, 796595, 796369, 796595, 796372, and 796069.

FIG. 3 describes the general methodology used and the associated sequences. Primers and adapter molecules are shown in Table 1. Sample-ID sequences are shown in Table 2. Plate-ID sequences are shown in Table 3. Cloning primers are shown in Table 4, with the 3' sequence of cloning forward primers shown in Table 5.

Figure 4:
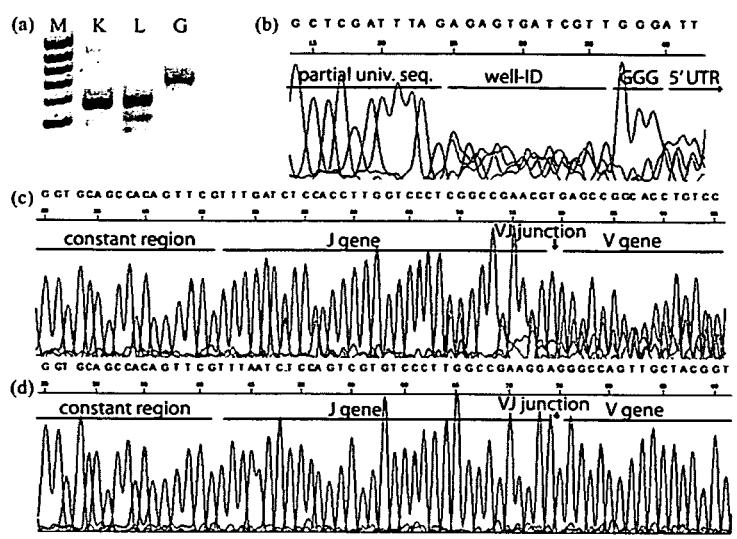
FIG. 4. Successful amplification of single-cell sorted B cells using sequencing and cloning primers. A 96-well plate of single-cell sorted B cells were reverse transcribed, pooled and amplified as shown in the schematics in FIG. 1a and FIG. 2. Bands for the kappa light chain, lambda light chain, and gamma heavy chain were visualized on an agarose gel at the expected sizes: ~600 bp for kappa and lambda and ~700 bp for gamma (a). DNA chromatogram of Sanger sequencing of the gamma heavy chain from the 5' end showed a 'variable' sequence corresponding to multiple sample-IDs for the pooled plate (b). Sanger sequencing of the kappa light chain from the 3' end showed a 'variable' sequence after the constant region and beginning at the VJ junction corresponding to multiple light chains (c). A cloning primer pair specific for well A1 was used to amplify the kappa light chain. Sanger sequencing showed that in contrast to (c), only one clean sequence was amplified (d). All results are representative of the other amplified immunoglobulin genes. M: 100 bp DNA ladder, K: kappa light chain, L: lambda light chain, G: gamma heavy chain. SEQ ID NO: 796627

We obtained PCR products at the expected sizes: ~600 bp for the kappa and lambda light chains, and ~700 bp for the gamma heavy chain (FIG. 4a). Next, we sent the material for Sanger sequencing. We obtained sequences that were identified by NCBI BLAST as kappa, lambda, and gamma chains (data not shown). Further investigation of the DNA chromatogram showed a mix of several peaks starting at the sample-ID barcodes, showing that we successfully added sample-ID barcodes to cDNA from cells in different wells during RT and successfully amplified them in two subsequent rounds of PCR (FIG. 4b). The Sanger sequencing chain from the 3' end also showed a mix of several peaks starting at the VJ junction, owing to amplification of genes from different cells, which differed after the VJ junction as a result of insertions and deletions and random recombination of different V and J genes. Furthermore, when we performed PCR with cloning primers specific for the well A1 sample-ID, we obtained a single peak rather than a mix of several peaks, showing that we indeed can amplify sequences from a specific cell within the pool (FIG. 4c-d).

Example 2: Gating Scheme for Single Cell Sorting of Plasmablasts

Figure 22:
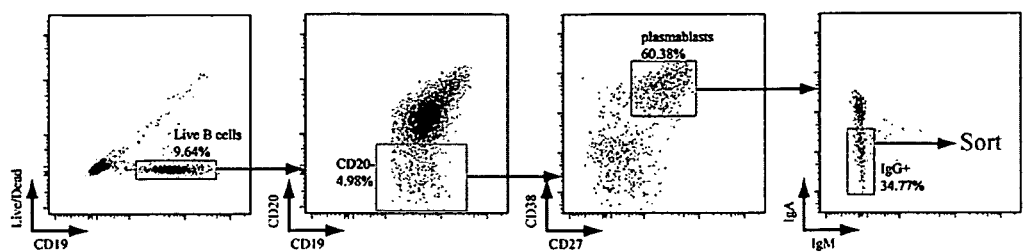
FIG. 22. Gating scheme for flow cytometry sorting of single cells into 96-well plates. Plasmablasts are defined as $CD19^+CD20^-CD27^+CD38^{++}$. Single PBMCs were first gated on based on their FSC and SSC profile (not shown). Live $CD19^+$ B cells were then gated on (left panel), and further narrowed down to CD20-B cells ($2^{nd}$ panel from left), and refined to $CD27^+CD38^{++}$ cells. From this, $IgG^+$ plasmablasts were determined as $IgA^-$ and $IgM^-$, as $IgG^+$ plasmablasts do not express cell surface IgG. This population was single cell sorted into 96-well plates.

Plasmablasts were defined as CD19$^+$CD20$^-$CD27$^+$CD38$^{++}$ for this experiment. FIG. 22 shows a gating scheme for flow cytometry sorting of single plasmablast cells into 96-well plates.

Single PBMCs were prepared and stained as described above. Cells were first gated on based on their FSC and SSC profile (data not shown). Live CD19$^+$ B cells were then gated on (left panel), and further narrowed down to CD20$^-$ B cells (2$^{nd}$ panel from left), and refined to CD27$^+$CD38$^{++}$ cells. From this, IgG$^+$ plasmablasts were determined as IgA$^-$ and IgM$^-$, as IgG$^+$ plasmablasts do not express cell surface IgG. This population was single cell sorted into 96-well plates.

Example 3: Plasmablasts are Present in Subjects Undergoing Immunological Challenge Plasmablasts generally represent about 0.15% of B cells in healthy donors, but can range from about 3.3%-16.4% in subjects undergoing a variety of immunological challenges including infections (e.g., S. aureus and C. diff infections), cancer associated with non-progression (e.g., metastatic melanoma and metastatic adenocarcinoma of the lung in which patients following an intervention (chemotherapy in the case of the lung adenocarcinoma patient and ipilimumab therapy in the case of the metastatic melanoma patient) became long-term non-progressors associated with an active B cell response), and vaccinations (e.g., influenza).

Figure 23:
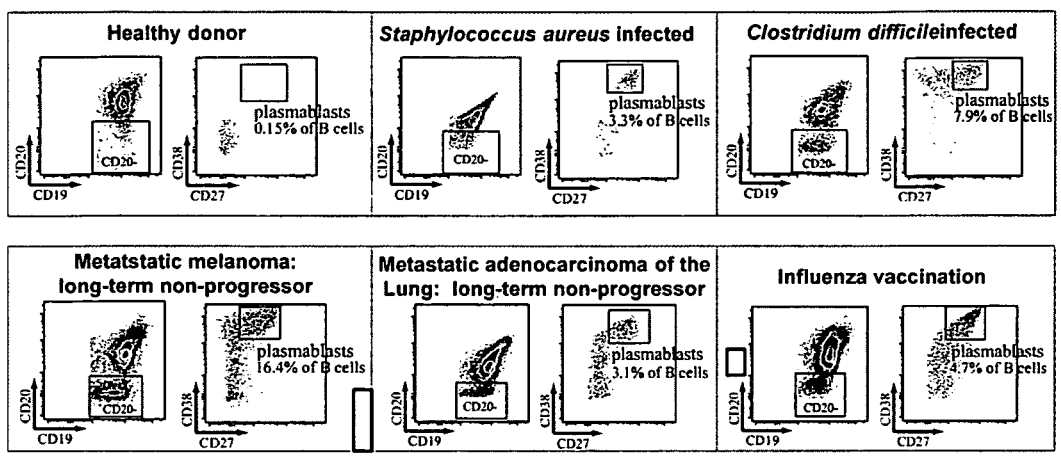
FIG. 23. Plasmablasts are present in people undergoing immunological challenge. Plasmablasts constituted 0.15% of peripheral blood B cells in a representative healthy donor, and range from 0.5%-16.4% in people undergoing a variety of immunological challenges including infections (*Staphylococcus aureus* and *Clostridium difficile* infections), cancer (a patient with metastatic melanoma who was a non-progressor for >4 years due to treatment with ipilimumab and a patient with metastatic adenocarcinoma of the lung who was a long-term non-progressor for >3 years after receipt of chemotherapy), and vaccination (receipt of influenza virus vaccine). This shows that plasmablasts are elevated in and obtainable from a range of subjects mounting immune responses of interest for isolation of individual plasmablasts for high-throughput sequencing of the antibody repertoire to characterize the active humoral response.
Figure 24:
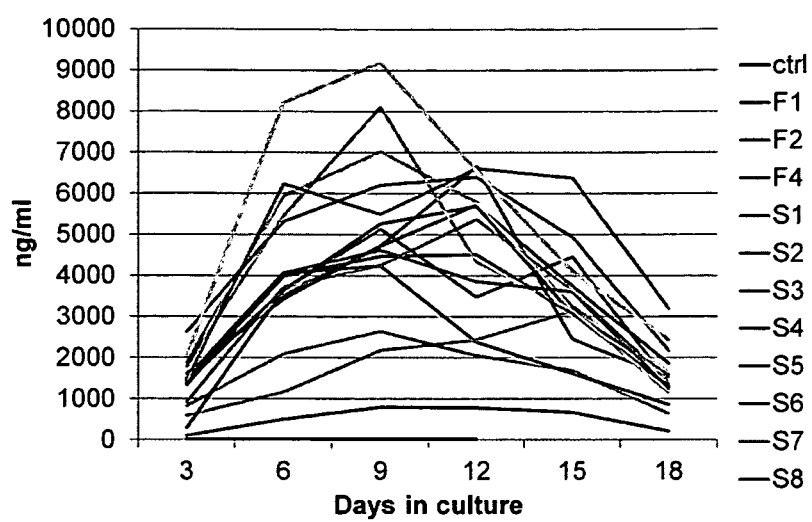
FIG. 24. Expressed recombinant antibodies were secreted for 2-3 weeks in transient transfections. As outlined in FIG. 2, the paired heavy and light chain immunoglobulin cDNA were cloned by PCR and co-transfected into 293T cells at the 48-well scale. Supernatants were collected every other day for 18 days. Anti-human IgG ELISA was performed to determine the amount of secreted antibodies in the collected supernatants, and the concentration of the antibodies in the supernatants of a panel of individual co-transfectants are graphed. Secretion tended to peak by day 9 and was substantially diminished by day 18.

FIG. 23 shows that plasmablasts were present in and obtainable from a range of subjects for high-throughput sequencing of the paired antibody repertoire and characterization of the active humoral response antibody repertoire. This demonstrates that the methodologies disclosed herein can be used to obtain evolutionary trees of heavy and light (H&L) chains and use this information to clone and/or express antibodies for, e.g.: a) novel antigen discovery; b) to inform vaccine design—for example, using the immune system to inform us as to which are the known and novel antigens are likely useful for opsonization and phagocytosis and/or killing/inhibition of a pathogen or target of interest and, optionally, to put that into vaccine design; c) making neutralizing monoclonal antibodies, e.g., from vaccines; d) making binding monoclonal antibodies; e) making antibodies against microbial pathogens; and f) making antibodies against cancers. Examples of these are described in more detail below.

Figure 5:
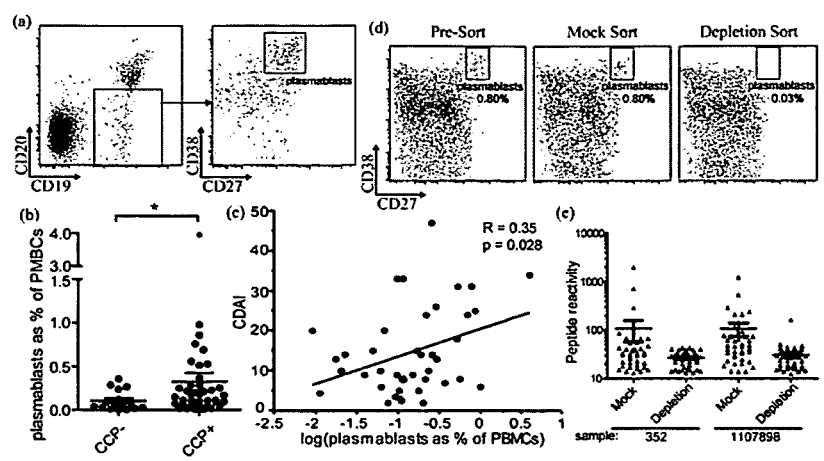
FIG. 5. CCP+ RA patients have peripheral blood plasmablasts percentages that correlated with disease activity and secreted anti-citrulline autoantibodies. Plasmablasts are $CD19^+CD20^-CD27^+CD38^{++}$ and were first gated on CD3- cells then gated as shown (a). Peripheral blood was obtained from consented RA patients and plasmablasts plotted as a percentage of total PBMCs. A Mann-Whitney test showed that CCP+ RA patients possess significantly higher (p<0.05) plasmablast percentages than CCP- RA patients (b). Plasmablast percentages were significantly correlated with clinical disease activity index (CDAI) in CCP+ patients by linear regression. Linear regression was performed on log transformed plasmablasts percentages to achieve normality of dataset (c). CCP+ plasmablasts were also either mock-sorted or underwent a plasmablast-depletion sort with >95% elimination of plasmablasts (d) and cultured for 7 days in RPMI supplemented with 10% FBS. Supernatant were collected and analyzed for anti-citrullinated peptide reactivity with Luminex. Mean fluorescence intensities for antibody reactivity against each peptide were plotted as peptide reactivities (e).

Example 4: Disease Activity in CCP+ RA is Correlated with Circulating Plasmablasts Having shown that our method can be used for sequencing of immunoglobulin genes in identifiable pairs, we used our method to investigate the antibody repertoire of plasmablasts in CCP+ RA patients. We obtained blood samples from consented RA patients and stained for plasmablasts by flow cytometry (FIG. 5a). Circulating plasmablasts were expressed as a percentage of total PBMCs. We found that CCP+ RA patients have significantly higher peripheral blood plasmablast percentages than CCP− RA patients (FIG. 5b). Furthermore, plasmablast percentages in CCP+ patients, but not in CCP− patients, correlated with disease activity (r=0.35 and p=0.028) (FIG. 5c).

Example 5: Plasmablasts Produced Anti-CCP Antibodies

Although CCP+ patients have plasmablast percentages that correlate with disease activity, these patients could have an ongoing infection or other factors that elevated their circulating plasmablast percentages. To determine the specificity of circulating plasmablasts in CCP+ patients, RosetteSep-enriched B cells from patients were cultured in RPMI supplemented with 10% FBS. Other media supplements, such as anti-IgM, IL-6, BAFF etc., were not used so that plasmablasts would be the only cells secreting antibodies (with other B cells remaining inactivate). To confirm that only plasmablasts produce antibodies, we depleted some of the samples of plasmablasts (FIG. 5d). B cells were then cultured for seven days before collecting the supernatant and running it on a Luminex peptide array. The array assays antibody reactivity to citrullinated peptides. Antibody reactivity was absent in supernatants of plasmablast-depleted samples compared to supernatants of mock-depleted B cells, suggesting that plasmablasts secrete significant amounts of anti-citrulline peptide autoantibodies (FIG. 5e). Furthermore, when peptides with a mean fluorescent intensity (MFI) above 60 for each sample were counted, a strong correlation was found between circulating plasmablast percentages and the number of peptides to which antibodies reacted (r=0.90 and p=0.0139). An MFI of 60 was chosen as this was the threshold below which >99% of peptide reactivity falls in supernatants of plasmablast-depleted samples.

Example 6: 454 Sequencing and Analysis of Sequences

Plasmablasts from patients were single-cell sorted into 96-well plates as described above, and their RNA reverse transcribed and PCR amplified according to "Touchdown PCR" in materials and methods section such that they contained sample-ID (sample identification region) and plate-ID (plate identification region) barcodes, as described above. See FIG. 3. Sequences of the cDNA were then obtained from a 454-sequencing facility (DNA Sequencing Center, Brigham Young University and 454 sequencing center, Roche).

Sequences were obtained from a first 454 sequencing run using the shotgun pipeline. Sequences of acceptable quality were obtained from a 2nd 454 sequencing run through a modified amplicon filter of the 454 GS FLX data analysis suite. The amplicon filter was modified to have <vfScanAll-Flows> set to "false", and <vfBadFlowThreshold> changed to "6". Sequences from a third and fourth run were obtained using a standard 454 amplicon filter. Filter-passed sequences were then processed as described in "Assignment of sequences to wells" section in the materials and methods, and sequences in each well were individually assembled as described in "Assembly of sequences" in the materials and methods. Assembled sequences were then parsed with IMGT HighV-Quest to obtain identification of VDJ regions used.

Figure 6:
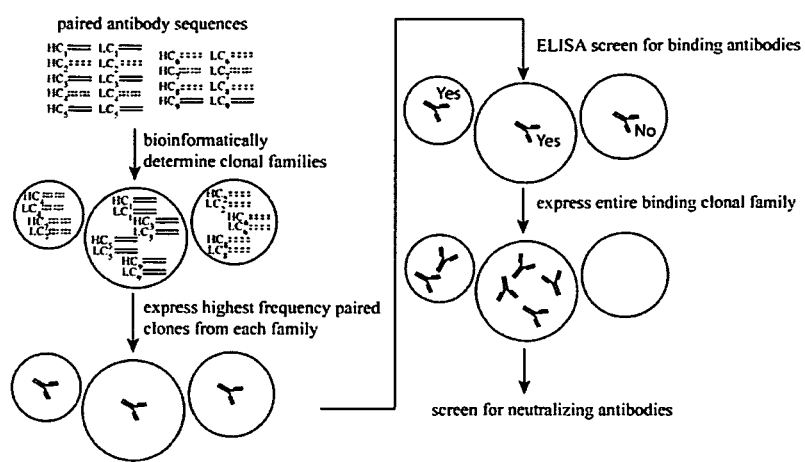
FIG. 6. Strategy for selection and screening of clones for neutralizing antibodies. Paired LC and HC antibody sequences are obtained from bioinformatic analysis of 454-sequenced amplicons and grouped into clonal families based on their LC and HC V(D)J usage. The clone(s) occurring at the highest frequency in each clonal family will be selectively cloned, expressed, and screened for binding to the target antigen of interest using ELISA. Representative clone (s) from the entire clonal family which secrete binding antibodies will then be cloned and expressed for screening of neutralizing antibodies. Each antibody diagram represents a clone.

After sequence assembly and V(D)J usage identification, ClustalX was used to cluster sequences into clonal families (FIG. 6). Alternatively, sequences can be assembled using both forward and reverse reads. In this case, subdivided forward sequences are first assembled as above. Forward and reverse sequences V(D)J usage are then identified using HighV-QUEST and forward and reverse sequences subset according to plate-ID and V(D)J usage, and forward and reverse sequences assembled using Newbler. Because immunoglobulin sequences are largely similar, assembly from a smaller subset of sequences avoids potential problems of sequences from different cells being incorrectly paired.

Example 7: Clustering of Sequences into Evolutionary Trees

Peripheral blood mononuclear cells (PBMCs) were isolated from human subjects with the indicated diagnoses or after vaccination. Plasmablasts were single-cell sorted into individual wells in 96-well plates, creating single-cell samples in each well, the mRNA in each well was then reverse transcribed, and then well contents were pooled and subjected to two rounds of PCR to amplify the immunoglobulin heavy and light chain cDNAs. The reverse transcription added an identifying sample-ID to all cDNAs generated from each single sample, and the first round and second rounds of PCR added plate-IDs and then 454 Titanium Primers A and B to every amplicon, respectively, as described in "Touchdown PCR and non-touchdown PCR" in the materials and methods section. The general methodology is outlined in FIG. 3. Pooled amplicons were sequenced with 454 sequencing technology, reads of acceptable quality obtained as described above. Reads were assigned to wells and assembled as described in "Assignment of reads to well" and "Assembly of sequences" sections in the materials and methods. V(D)J segments in assembled sequences were then identified using HighV-QUEST. Identified heavy and light chain sequences with shared compound barcodes can then paired simply by putting assembled sequences with matching compound barcodes together.

Figure 7:
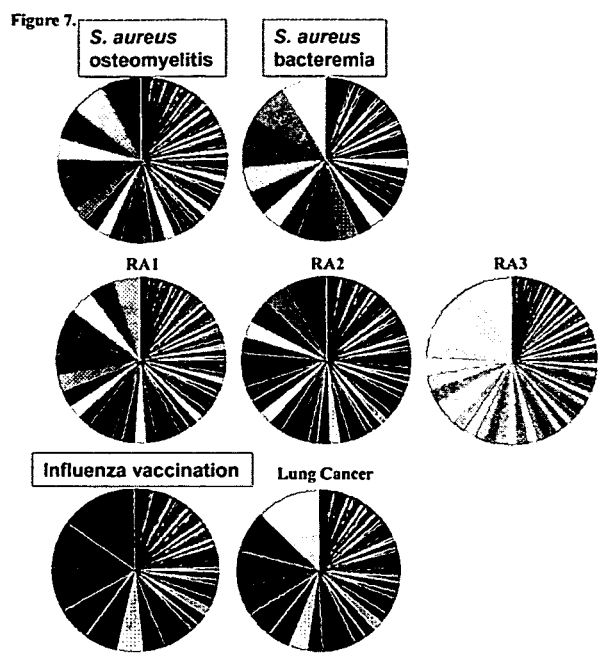
FIG. 7. Characterization of immunoglobulin heavy chain V(D)J sequences and clonal families derived from individual human subjects. Blood was obtained from humans with the following conditions: (i) chronic *Staphylococcus aureus* osteomyelitis in a human who was not taking antibiotics (due to non-compliance) but whose immune system effectively suppressed the infection and prevented fulminant infection for several months off antibiotics; (ii) a human with acute and fulminant *Staphylococcus aureus* bacteremia requiring transfer to the intensive care unit and aggressive intravenous antibiotic treatment; (iii) 3 humans with chronic active rheumatoid arthritis. (RA) (with disease activity scores (DAS) >5); (iv) a human 7 days following receipt of the trivalent influenza vaccine (Fluzone, Sanofi); and (v) a human with metastatic lung adenocarcinoma who was expected to expire but following chemotherapy went into a state of long-term non-progression. In all cases, the human patients exhibited elevations in their peripheral blood plasmablast levels (ranging from 1.5-6% of peripheral blood B cells being plasmablasts [$CD20^-CD19^+CD38^{++}CD27^+$], with levels in normal humans being 0.1-0.2% of peripheral blood B cells), indicating an activated immune response. Plasmablasts were single-cell sorted into 96-well plates, and barcoding and 454 sequencing of the expressed immunoglobulin cDNA was performed as described in FIGS. 2 and 3. Bioinformatic analysis was used to pair the heavy and light chain immunoglobulins expressed by individual plasmablasts. Pie chart diagrams of the percent of heavy chain V(D)J usage for the individual patients are presented—each wedge represents the percent of plasmablasts expressing a distinct heavy chain V(D)J sequence rearrangement.

Amplicons from individual human subjects were clustered based on these V(D)J segments, and sequences expressing the same V(D)J segments were classified as being from the same clonal family (FIG. 7). Each pie chart represents the percentage of clones derived from individual plasmablasts from an individual human subject expressing identical V(D)J gene segments (i.e., percentage of clones in each clonal family). Human subjects included those with sepsis (2 subjects), rheumatoid arthritis (3 subjects), lung cancer (1 subject), and after vaccination for influenza (1 subject). These subjects were chosen to show that clonal families can be isolated from plasmablasts of subjects undergoing both acute (sepsis and flu vaccine) and chronic conditions (rheumatoid arthritis and lung cancer).

Figure 8:
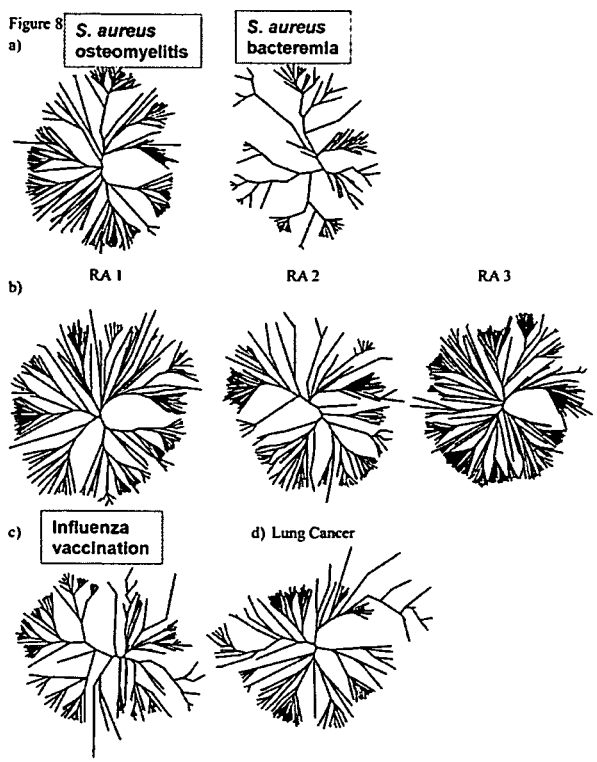
FIG. 8. Clustering of immunoglobulin heavy chain V(D)J sequences from human subjects demonstrates clonal families and clonal subfamilies. The immunoglobulin heavy chain sequence datasets generated in the studies described in FIG. 7 were subject to hierarchical clustering using the program Clustal. Hierarchical clustering yielded evolutionary trees representing the antibody response in each individual human.

The immunoglobulin heavy chain V(D)J sequences from the individual human subjects of FIG. 7 were clustered using ClustalX and displayed using Treeview as unrooted radial trees (FIG. 8). Each radial tree represents the heavy chain sequences derived from an individual human subject. For each radial tree, the terminal ends represent a unique sequence. The major branches represent clonal families, and the smaller branches represent clonal subfamilies that differ from one another by mutations that arose via junctional diversity (addition of P-nucleotides or N-nucleotides, or nucleotide deletion), somatic hypermutation and affinity maturation.

Example 8: Cloning, Expression, and Purification of Antibodies

All selected antibodies were cloned, expressed, and isolated as described above in the Materials and Methods section (See sections: Cloning of heavy and light chains into Lonza vectors; Expression of monoclonal antibodies in 293T; Anti-human IgG ELISA; and Protein A-IgG purification of expressed monoclonal antibodies). Purified antibodies were then used for further study, as discussed below.

Example 9: Characterization of Antibodies from Subjects Following Influenza Vaccination Antibodies from humans administered an influenza vaccine were selected and isolated as described above. The antibodies selected for further characterization below are indicated in the appropriate sections.

Fluzone ELISA

Volunteers were administered the 2010/2011 season flu vaccine from Fluzone, which consists of 3 strains of inactivated virus, the A/California/7/2009, A/Perth/16/2009, B/Brisbane/60/2008 strains. Fluzone ELISAs were performed as described above to determine if monoclonal antibodies derived from vaccinated volunteers bind to the flu vaccine itself as an initial screen for expressed antibodies with binding activity. 14 of 31 antibodies bound to Fluzone ELISA (FIG. 26) and a subset of these were subsequently selected and tested for binding activity to hemagglutinin using surface plasmon resonance. Antibodies characterized by Fluzone ELISA were: Flu14-Flu23, Flu25-Flu27, Flu29, Flu30, Flu34, Flu35, Flu37, Flu39-Flu41, Flu43-Flu46. S1 and S2 were used as negative controls.

Surface Plasmon Resonance Determination of Flu Antibody Affinities

Binding of monoclonal antibodies (mAbs) to HA molecules was analyzed at 25° C. using a ProteOn surface plasmon resonance biosensor (BioRad Labs) as described above. Of the 14 antibodies that bound to Fluzone ELISA, 10 bound to H3, and 1 bound to H1, while 3 did not bind (FIG. 27). One of the non-binders, the H1 binder, and 4 other randomly chosen H3 binders were selected and sent to a contract research organization (CRO) to test neutralization activity in a microneutralization assay. Antibodies characterized by SPR were: Flu14-Flu22, Flu26, Flu29, Flu34, Flu35, Flu46.

Influenza Microneutralization Assay

Some of the expressed flu antibodies that showed binding activity in the Fluzone ELISA were sent to an external CRO, Virapur LLC, for microneutralization assays as described above. The results of the assays showed that the antibody that bound to H1 in previous assays neutralized H1, while the antibodies that bound to H3 in previous assays neutralized H3. The non-binder did not neutralize influenza virus (FIG. 28). Antibodies characterized by microneutralization assay were Flu15, Flu16, Flu18, Flu19, Flu20, Flu21.

CDR Variation

Figure 25A:
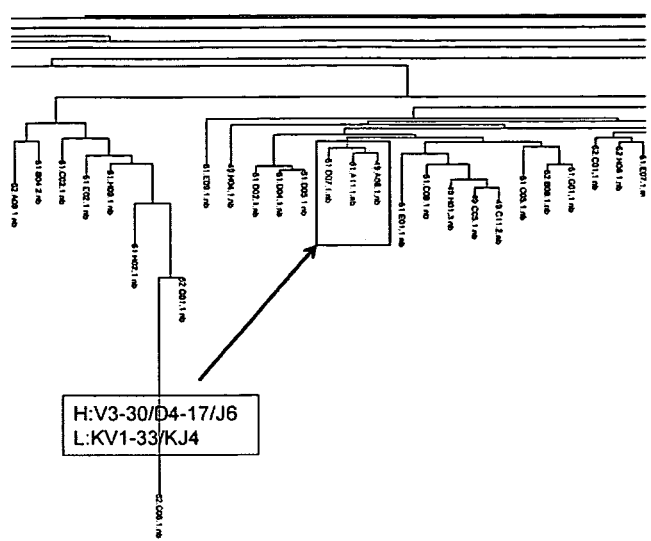
FIG. 25A: Partial dendrogram of flu antibodies. After pairing of heavy and light chains, a multiple sequence alignment was generated for heavy chains, and another multiple sequence alignment was generated for light chains. Both multiple sequence alignments were generated using Clustalw2 2.1 with default parameters. The two alignments were concatenated together and used to build a tree in CLC Sequence Viewer v. 6.5.2 using the neighbor joining method with 100 bootstrap replicates.
Figure 25B:
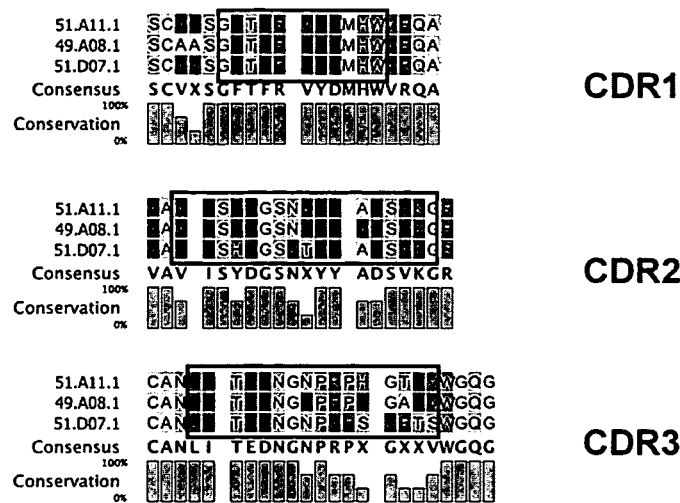
FIG. 25B: Heavy chain CDRs for a clonal family from flu-vaccinated patient. Identifiers in figure correspond to sequence names in Sequence Listing as follows: 51.A11.1=NA.51.11.A11.1.454.heavy.3.nb-aa, 49.A08.1=NA.49.8.A08.1.454.heavy.3.nb-aa, 51.D07.1 is the amino acid sequence obtained by translating NA.51.40.D07.1.454.heavy.3.nb in frame 1. From top to bottom: SEQ ID NOs: 796628-796639.
Figure 25C:
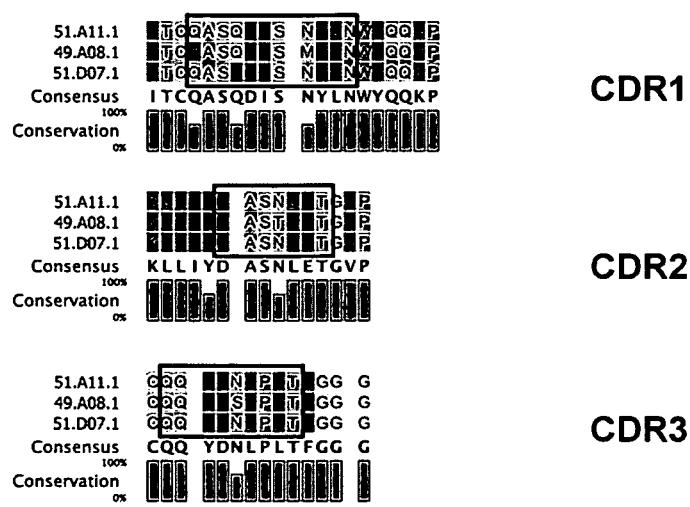
FIG. 25C: Light chain CDRs for a clonal family from flu-vaccinated patient. Identifiers in figure correspond to sequence names in Sequence Listing as follows: 51.A11.1=NA.51.11.A11.1.454.light.4.nb-aa, 49.A08.1=NA.49.8.A08.1.454.light.4.nb-aa, 51.D07.1=NA.51.40.D07.1.454.light.4.zerom50-aa. From top to bottom: SEQ ID NOs: 796640-796651.

Flu antibodies were obtained as described above. FIG. 25 shows a partial dendrogram blown-up for clarity (a). Clonal families are clearly visible and the shaded clonal family has the assigned V(D)J as shown in the grey box. Amino acid sequence across the CDRs (boxed region) for the heavy and light chains are shown in FIGS. 25 (b) and (c) respectively, showing some residue differences between the chains.

These above results demonstrate that evolutionary trees can be obtained using the compositions and methods described herein. Fully human monoclonal antibodies can be isolated from activated B cells, such as plasmablasts, of subjects undergoing acute conditions using the compositions and methods described herein. These fully human monoclonal antibodies can also be neutralizing antibodies using the compositions and methods described herein. The results also demonstrate that the compositions and methods disclosed herein can be used to isolate mAbs targeted against foreign antigens.

Example 10: Characterization of Antibodies from Subjects with RA

Antibodies from humans suffering from rheumatoid arthritis (RA) were selected and isolated as described above. The antibodies selected for further characterization below are indicated in the appropriate sections.

RA Antibody Reactivities on RA Antigen Microarrays

Figure 37:
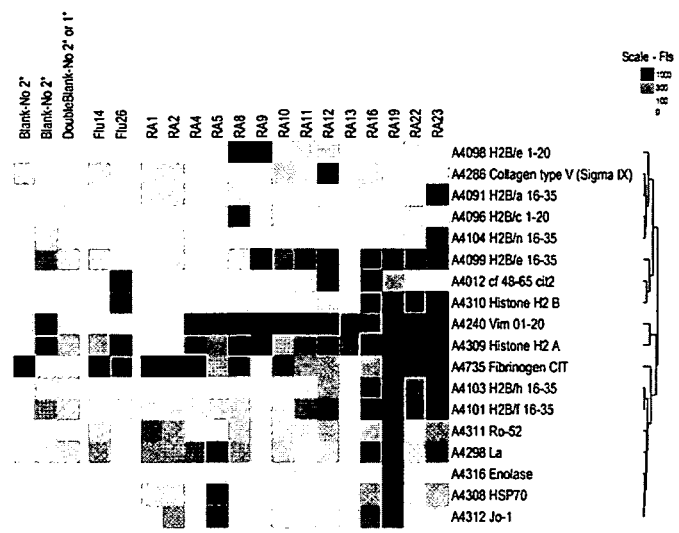
FIG. 37. Identification of anti-histone and anti-citrullinated protein antibodies using RA antigen arrays. Antibodies derived from RA patients were used to probe an RA antigen array containing a spectrum of native and citrullinated proteins and peptides. Following incubation with a Cy-3-labeled anti-human IgG secondary antibody, recombinant antibody binding was quantitated by scanning with an Axon Instruments GenePix microarray scanner. Reactivities are displayed as a heatmap. Recombinant antibodies derived from RA bound to several distinct citrullinated or native antigens.

Antibodies derived from RA patients were probed on an RA antigen array and florescence scanned with a GenePix machine as described in "RA antibody reactivities on RA antigen arrays" section in materials and methods. The identified relationships were displayed as a heatmap using Java TreeView software (FIG. 37). The antibodies characterized by this assay were: RA1, RA2, RA3, RA4, RA8-RA13, RA16, RA19, RA22 and RA23. Flu14 and Flu26 were used as negative controls.

Anti-Histone 2A ELISA

Figure 35:
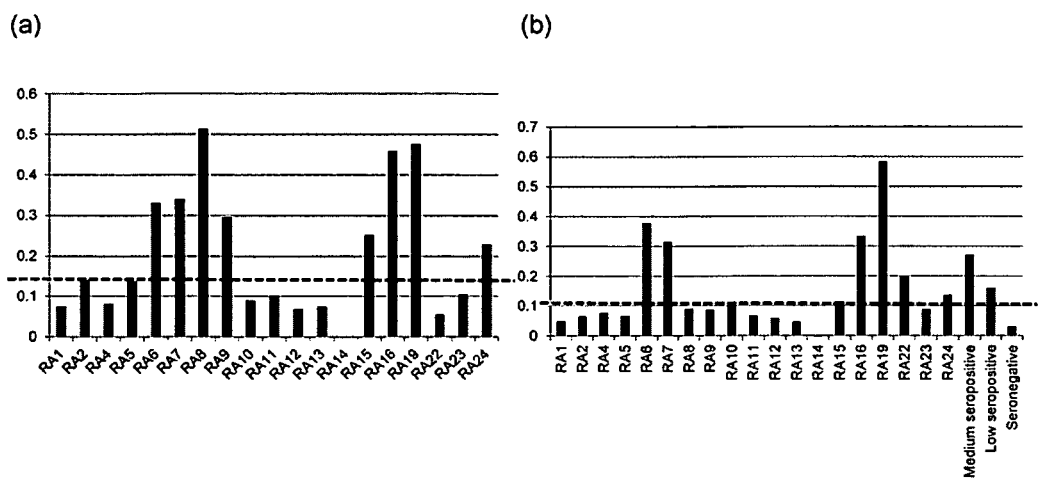
FIG. 35. Generation of anti-CCP and anti-histone 2A antibodies from RA patients. Additional recombinant antibodies generated from RA patients with active disease were characterized using a histone 2A ELISA and a cyclic-citrullinated peptide (CCP) ELISA (using the CCP2 ELISA kit [Axis Shield]). Recombinant antibodies were used at 125 ug/ml. Panel (a) presents the results from a histone 2A ELISA, and multiple recombinant antibodies bound to histone 2A. Panel (b) present the results of the CCP2 ELISA, and several recombinant antibodies exhibited positive reactivity. The anti-CCP2 ELISA included a seronegative and 2 seropositive controls. For both assays, absorbance was recorded as the readout. Absorbance values above the background (dotted line) were considered to be positive.
Figure 36:
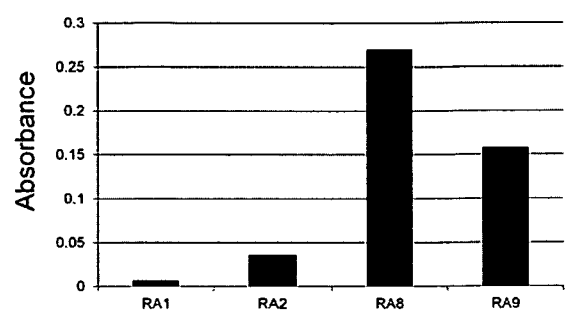
FIG. 36. Confirmatory independent experiment demonstrating generation of anti-histone 2A antibodies from active RA patients. Recombinant antibodies derived from RA patient evolutionary trees (FIG. 8 and FIG. 35) were further tested in a histone 2A ELISA assay. Antibodies were used at 30 ug/ml, a 4-fold lower concentration that that used in FIG. 35. Absorbance was recorded as the readout. Absorbance values above the background were considered to be positive.

For detection of antibodies to H2A, a direct ELISA was performed as described in "Anti-histone 2A ELISA" in materials and methods section. FIG. 35a shows the absorbance values detected for each antibody tested. The antibodies characterized in FIG. 35a and in anti-CCP2 ELISA below were: RA1, RA2, RA4-RA16, RA19, RA23-RA24. FIG. 36 shows the selected antibodies (RA1, RA2, RA8, RA9) on another independent ELISA using 30 ug/ml of antibodies.

Anti-CCP2 ELISA

Anti-CCP2 ELISA was performed as described in "Anti-CCP2 ELISA" in materials and methods section. FIG. 35b shows the absorbance values detected for each antibody tested.

Anti-Rheumatoid Factor ELISA

Figure 34:
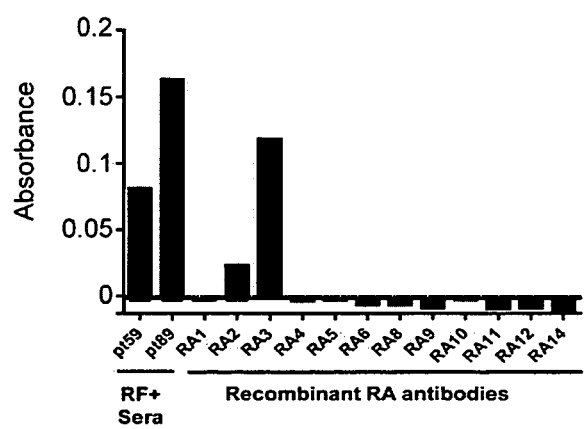

Antibodies derived from RA patients were used as the primary antibody in a direct ELISA and anti-human IgG-HRP was used as the secondary antibody, and visualized with TMB substrate. For detection of antibodies to rheumatoid factor (RF), Anti-RF ELISA was performed as described in "anti-rheumatoid factor" ELISA in the materials and methods section. FIG. 34 shows that antibodies RA2 and RA3 showed reactivity. Antibodies characterized here were: RA1-RA6, RA8-RA12, RA14.

These above results demonstrate that antibodies can be isolated from activated B cells, such as plasmablasts, of subjects undergoing chronic conditions using the compositions and methods described herein. The results also demonstrate that the compositions and methods disclosed herein can be used to isolate mAbs targeted against self antigens.

Example 11: Characterization of Antibodies from Subjects with Lung Cancer

Antibodies from a long-term non-progressor human suffering from metastatic lung adenocarcinoma were selected and isolated as described above. This human developed metastatic lung adenocarcinoma and was expected to succumb to cancer, however following chemotherapy this patient entered a state of long-term non-progression for over 4 years that was associated with plasmablasts constituting 3.1% of all peripheral blood B cells. The elevated peripheral blood plasmablast levels in this patient indicated that an ongoing immune response could be contributing to her long-term non-progression. The following antibodies were selected for further characterization below: LC1, LC5-LC7, LC9-LC18. Flu16 was used as the negative control.

Figure 32:
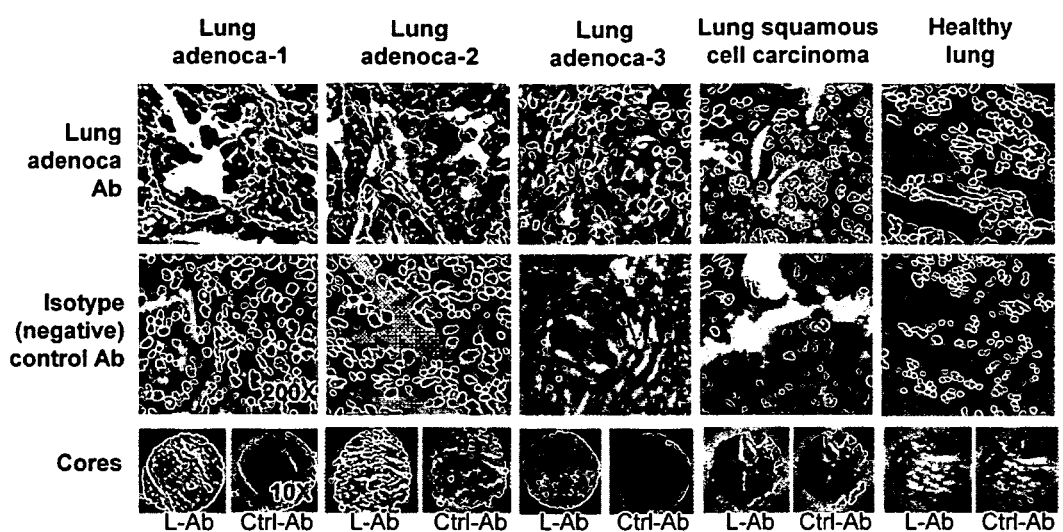

Immunohistochemistry of Antibodies from Lung Adenocarcinoma Patient on Lung Cancer Tissue Arrays Immunohistochemistry using two different types of tissue microarray slides was performed as described in "Immunohistochemistry of antibodies from lung adenocarcinoma patient on lung cancer tissue arrays" in the materials and methods section. Our results demonstrated one of the expressed antibody bound to lung adenocarcinoma (FIG. 32).

Figure 33:
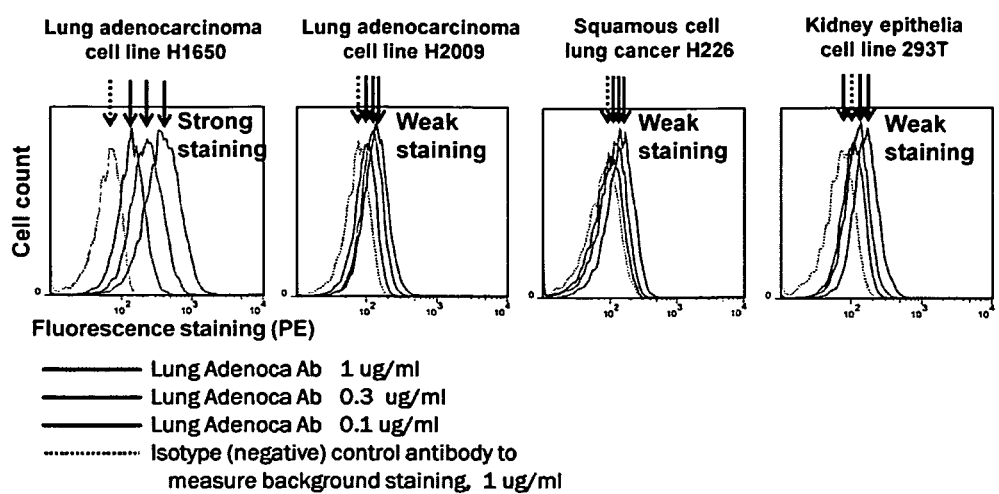

Flow Cytometry Determination of Binding of Antibodies Expressed from Lung Adenocarcinoma Patient to Lung Adenocarcinoma Cell Lines Binding of antibodies to various lung cancer cell lines was performed as described in "Flow cytometry determination of binding of antibodies expressed from lung adenocarcinoma patient to lung cancer cell lines" in the materials and methods section. Our results showed that one antibody bound to lung adenocarcinoma cell lines and may be specific for lung adenocarcinomas (FIG. 33).

These above results demonstrate that antibodies can be isolated from activated B cells, such as plasmablasts, of subjects undergoing chronic conditions such as cancer using the compositions and methods described herein. The results also demonstrate that the compositions and methods disclosed herein can be used to isolate mAbs targeted against self antigens.

Example 12: Characterization of Antibodies from Subjects with *Staphylococcus aureus* Infection Humans with *S. aureus* infections, including a human with chronic *S. aureus* osteomyelitis with immune-mediated control of the infection in the absence of antibiotics, were used as sources for peripheral blood from which peripheral blood plasmablasts were stained and sorted. cDNA processing with barcoding, 454 sequencing, and bioinformatics analysis generated evolutionary trees of antibody repertoires in humans mounting effective immune responses against *Staph. aureus*. Antibodies from humans mounting effective immune responses against *S. aureus* infection were selected and isolated as described above. The antibodies selected for further characterization below are indicated in the appropriate sections.

Staph Flow Cytometry

Figure 29:
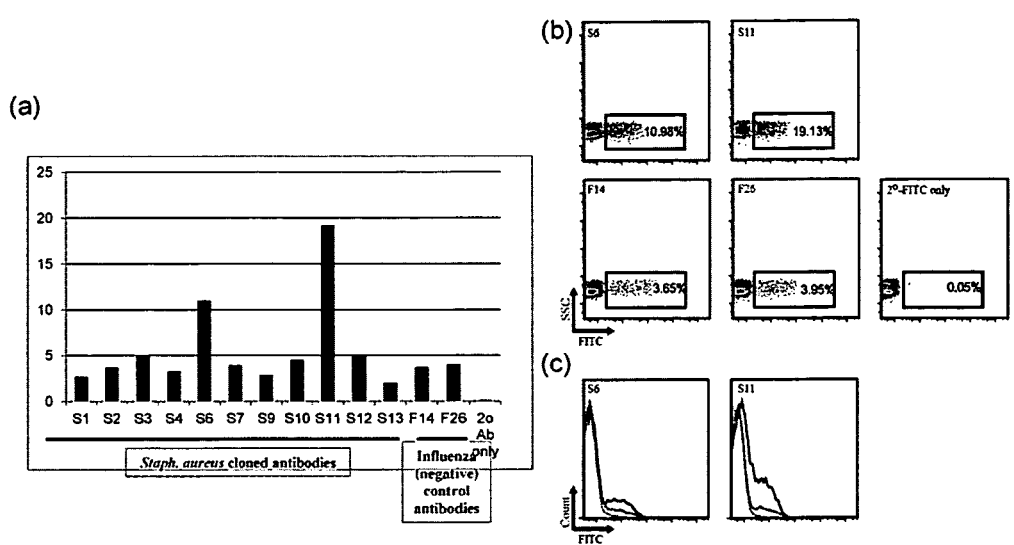

Anti-staph antibodies were used to stain fixed *S. aureus* as described in "Staph Flow Cytometry" in the materials and methods. Our results showed that antibodies S6 and S11 bind to the surface of *S. aureus* and may be candidates for opsonization, resulting in phagocytosis and killing/inhibition of *S. aureus* (FIG. 29). The antibodies characterized in this assay were: S1-S4, S6-S13, with F26 as a negative control.

Staph Inhibition Assay

Figure 30:
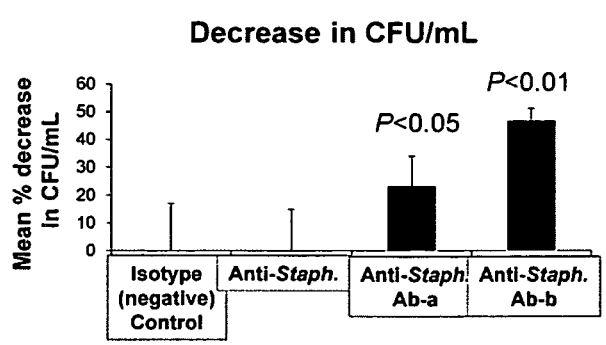

*S. aureus* in log-phase growth were combined with anti-staph antibody to determined the inhibitory activity of the antibodies as described in "Staph Inhibition Assay" in the materials and methods. Our results demonstrate that several of the antibodies cloned and expressed exhibited potent killing/inhibition activity on *S. aureus* (FIG. 30). Antibodies characterized by this assay were S6 and S9, with LC1 as the negative control.

Immunoprecipitation of Staph Antigens with Antibodies Derived from Staph-Infected Patients Antibodies were used to immunoprecipitate various candidate staph antigens as described in "Immunoprecipitation of staph antigens with antibodies derived from staph-infected patients" of the materials and methods. Immunoprecipitated proteins were then identified with mass spectrometry as described below. Antibodies characterized by this assay were S1-S13.

Mass Spectrometry Identification of Peptides

Stained protein bands of interest were selected and subjected to mass spectrometry as described in "*Mass spectrometry identification of peptides*" of the materials and methods. The results identified either phenol-soluble modulin alpha 1 peptide or delta-hemolysin as the likely binding target for antibody S4. This demonstrates that the methods disclosed herein can be used to perform novel antigen discovery (FIG. 31). Antibody characterized by this assay was S4.

These above results demonstrate that antibodies can be isolated from activated B cells, such as plasmablasts of subjects undergoing acute conditions such as a bacterial infection using the compositions and methods described herein. The results also demonstrate that the compositions and methods disclosed herein can be used to isolate mAbs targeted against foreign antigens and to determine the identity of antigens bound by selected antibodies.

Example 13: Blasting Cells and Plasmablast Characterization

Immunoglobulin sequences from B cells that are activated by an ongoing immune response can be used to produce an evolutionary tree of an ongoing immune response, as described above. This evolutionary tree is typically characterized by multiple clonal families representing activated B cells from multiple lines of descent. Sequences from naive B cells will not generally be able to be used to produce such an evolutionary tree, as they have not been activated and therefore provide little to no information on the active, ongoing immune response. Activated B cells first become blasting cells, which are activated and are larger in size. These blasting cells then go on to become either memory B cells or plasma cells. In humans, although memory B cells and plasma cells result from an immune response, they join large pools of memory B cells and plasma cells that have resulted from responses to previous immunological insults, making it difficult to distinguish memory B cells and plasma cells against recent or previous immune responses. Therefore, in humans, blasting cells are a preferred candidate for sequencing to obtain evolutionary trees of an ongoing immune response. In research animals bred in controlled conditions (e.g., mice) however, blasting B cells, memory B cells, and plasma cells are all candidates for sequencing to obtain evolutionary trees as they are bred in a clean environment, making it possible for the majority of memory B cells and plasma cells after a rigorous immune response to be against the insult, especially after booster shots, as they should not have large memory or plasma cell populations that have seen any major immunological challenge before.

Similarly for T cells, in humans, the preferred cells to sequence to obtain an evolutionary tree of an ongoing immune response will be blasting T cells. For mice, activated, blasting, and memory T cells are all preferred candidates to sequence to obtain an evolutionary tree.

Blasting B cells are known to be larger than typical B cells. The size of a small lymphocyte, of which a resting B cell is one, is typically between 6-8 μm in size. Blasting lymphocytes (T and B cells) are typically between 8-14 μm in size. (See FIG. 41, also Tzur et al, PLoS ONE, 6(1): e16053. doi:10.1371/journal.pone.0016053, 2011; Teague et al, Cytometry, 14:7 2005). Plasmablasts can have the following expression pattern: $CD19^{low/+}$, $CD20^{low/-}$, $CD27^+$ and $CD38^{high}$. Although use of all of these markers results in the purest population for single cell sorting, not all of the above markers need to be used to isolate plasmablasts.

Figure 39:
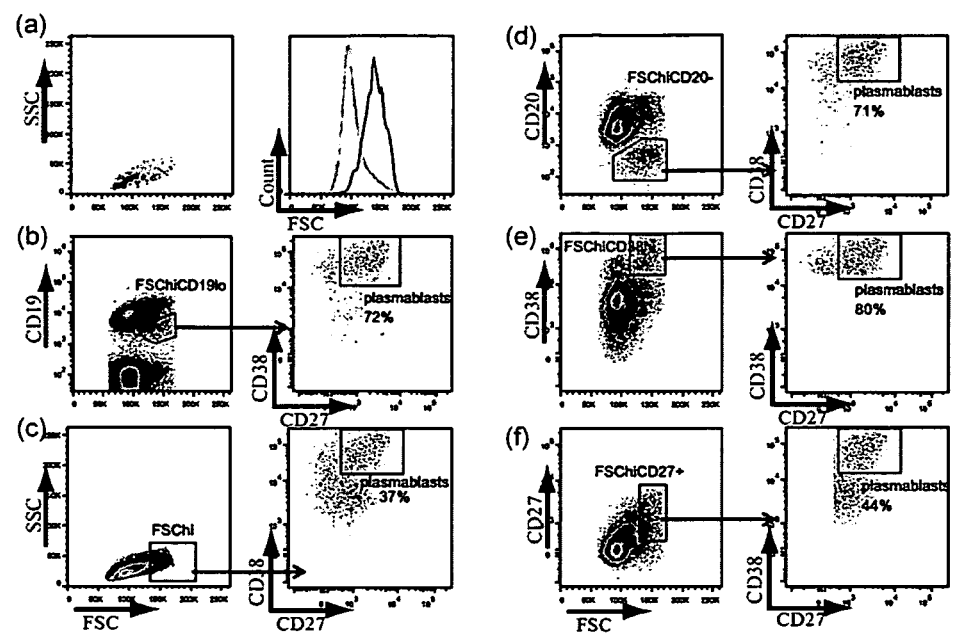
FIG. 39. Use of alternative cell surface markers and other cellular features to identify blood plasmablasts. Plasmablasts can be identified and sorted through use of a variety of cell surface markers and/or cellular features. Panel (a) demonstrates that plasmablasts exhibit higher forward scatter (FSC) than resting B cells. Plasmablasts were identified based on $CD19^+CD20^-CD27^+CD38^{hi}$ staining, and these results demonstrate that B cells (grey) are smaller than plasmablasts (black). Panel (b) demonstrates that use of anti-CD19 staining combined with FSC identifies a population of B cells that contains 72% plasmablasts. Panel (c) demonstrates that, for a population of $CD19^+$ B cells (cells were pre-gated as being CD19 positive), side scatter (SSC) and FSC can be used to identify a population of B cells that contains 37% plasmablasts. Panels (d-f) present several approaches to identify plasmablasts within the $CD19^+$ B cell population. Gating on $FSC^{hi}$ cells gave 37% purity of plasmablasts (c). Gating on $FSC^{hi}CD20^-$ cells gave 71% purity in plasmablasts (d). Gating on $FSC^{hi}CD38^+$ cells gave 80% purity in plasmablasts (e). Gating on $FSC^{hi}CD27^+$ cells gave 44% purity in plasmablasts (f).

As exemplified in FIG. 39, plasmablasts can be gated on by using an $FSC^{hi}$ for larger cells, resulting in a 37% pure plasmablast population. Gating on $FSC^{hi}CD19^{hi}$ cells gives 72% plasmablast purity. Gating on $FSC^{hi}$ and $CD27^+$, $CD38^{hi}$, or $CD20^-$ gives 44, 80, and 71 percent plasmablast purity, respectively. Combination of any of these markers or other markers found to be able to distinguish plasmablasts from other B cells can be used to increase the purity of sorted plasmablasts, however any one of these markers alone can distinguish plasmablasts from other B cells, albeit with a lower purity.

Example 14: Alternative Platform for Sequencing and Analysis

Figure 38:
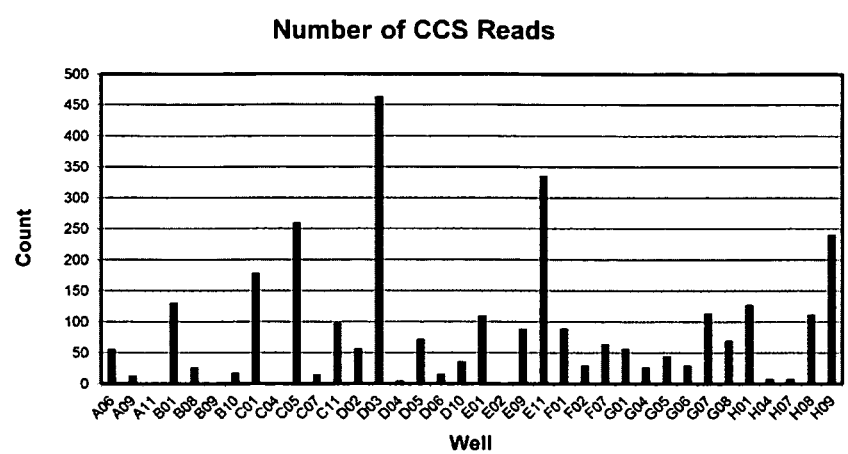
FIG. 38. Pacific Biosciences sequencing provides full-length sequencing reads of IgG heavy chain amplicon. IgG heavy chain amplicons from plate 44 were provided to Pacific Biosciences for SMRT sequencing. The number of circular consensus sequence (CCS) reads with barcodes corresponding to selected wells are shown.

Heavy chain reads from a single plate, plate 44, was prepared for PacBio sequencing run using the methods described in "Touchdown PCR" in the materials and methods to amplify gamma heavy chain cDNA. 48 2nd PCRs were done to obtain sufficient DNA for PacBio run. Pooling and cleanup of DNA was done as described in "Preparing for PacBio sequencing run". DNA was sent to PacBio for prep and sequencing. CCS reads were obtained from PacBio and assigned to wells and assembled according to "Assignment of sequences to wells" and "Assembly of sequences" in the materials and methods. Results of the assignment is in FIG. 38. This shows that our methods and compositions are not platform-specific for high-throughput sequencing.

Example 15: Sequencing and Analysis on 454 XL+ Runs

Sequencing can be adapted to 454 XL+ runs by following the method described in "Preparing for 454 XL+ sequencing run". This needs to be done as 454 XL+ runs currently only support Lib-L chemistry, while our 454 XLR70 runs utilize the Lib-A chemistry. This can also generally be adapted to situations where Lib-L chemistry is preferred to the typical Lib-A chemistry for amplicon sequencing on XLR70 runs. Reads from 454 XL+ runs can still be assigned to wells and assembled following the methods described in "Assignment of sequences to wells" and "Assembly of sequences". Reads from XLR70 and XL+ runs after 454 filtering can be used in identical fashion, i.e. downstream selection of antibodies for cloning and expression and assaying of antibody functional properties can still proceed as per FIGS. 6 and 9.

Example 16: Cloning of Paired Immunoglobulin Genes

Assuming that each clonal family recognizes the same epitope, and that sequence variance within each family is due to somatic hypermutation, we can first clone and express the most frequent clone of each clonal family for screening of antibodies that bind the antigen of interest (FIG. 6). We use the most frequent clone because, during affinity maturation and selection in the germinal center, centrocytes that bind antigen with the highest affinity out compete other centrocytes for survival factors. Therefore, we expect the highest frequency clone to also have the highest binding affinity. Once a clone has been identified as an antibody capable of binding antigen, representative paired immunoglobulin sequences from the entire clonal family are then cloned, expressed, and screened for being neutralizing antibodies (FIG. 6). This process may involve cloning and expression of sequences representing multiple sub-clones within the clonal family, or encoding antibodies of different isotypes within the clonal family, to enable direct testing and comparison of the binding and functional properties of specific clones representing the spectrum of antibodies contained within the clonal family. The specific clone exhibiting the desired binding and functional properties are then selected for further characterization and consideration for development as a therapeutic human antibody.

An alternative approach to selecting candidates for cloning from a family (or any other set of antibodies of interest) is to build a phylogenetic tree for the antibodies (rooted at the germline sequence in the case of a clonal family). Leaf nodes in such a tree correspond to the antibody family members. Candidates for cloning are then selected by descending from the top of the tree, always choosing the branch with the largest number of leaf nodes underneath (choosing randomly in case of a tie), then at the last node above the leaves choosing the leaf with the largest number of mutations, or choosing randomly in the event of a tie. Additional candidates could then be selected, if desired, by repeatedly selecting candidates until the desired number is achieved, as follows. For every node in the tree, if none of the leaves that are descendants of the node have been selected, count the number of leaves that are descendants. For the node with the largest such count (choosing randomly in case of a tie), descend, always choosing the branch with the largest number of descendant leaf nodes (choosing randomly in case of a tie between branches). Then, at the last node above the leaves, choose the leaf with the largest number of mutations or choose randomly in case of a tie.

Yet another approach to selecting candidates from a family of antibodies (or any other set of antibodies of interest) is to list the antibodies by descending number of non-silent mutations relative to germline and select from the list in order, thereby choosing the antibodies that are most evolved.

Example 17: Permanent Transfection and Expression of Candidate Human Antibodies Desired clones are selectively amplified from a pooled plate of sequences by using cloning primers specific to a given sample-ID; these primers also incorporate different 5' and 3' restriction sites into the clone. The restriction sites are then used for inserting the clone into vectors. Because the amplified clones may contain only a partial constant region sequence, vectors already contain either the kappa, lambda or gamma constant regions with the appropriate restriction sites needed for inserting the amplified clones in the open reading frame. Multiple restriction sites are engineered into the vector, because clones have variable sequences, to avoid the potential problem of the restriction site existing also in the clone itself, which would then also be cut by the restriction enzyme. This allows as many clones to be inserted as possible. Vectors used are either two separate vectors with different mammalian selectable markers (modified Invitrogen pcDNA3.3 or pOptivec vectors that contain constant-region gene with engineered restriction sites) or a dual-expression vector containing both the genes (Lonza GS system; pEE6.4 and pEE12.4). See Tables 16 and 17 respectively for sequences of the constant region inserts. Selection markers are amplifiable, such as dihydrofolate reductase (DHFR) in pOptivec or glutamine synthetase (GS) in Lonza GS system, to allow for gene amplification and efficient production of antibodies for further screening purposes requiring large amounts of antibody (e.g. an in vivo screen). Mammalian cells are either transfected using a double transfection, with a light chain in one and the heavy chain in the other vector (modified pOptivec and pcDNA3.3), or a dual-expression vector (Lonza GS system) containing both genes.

Modified Invitrogen Vectors.

Vectors are two separate vectors with different mammalian selectable markers and engineered restriction sites). pcDNA3.3 has a Neomycin resistance gene as a selectable marker, and pOptivec has a DHFR-selectable marker. CHO DHFR− cells are co-transfected with modified pcDNA3.3 and pOptivec under selection from. Geneticin. Only DHFR− cells transfected with pOptivec, which contains a copy of DHFR, will survive, and the Neomycin resistance gene in pcDNA3.3 confers resistance to Geneticin, This allows for selection of cells that are successfully transfected with both vectors (containing the light chain in one vector and heavy chain in the other vector), and therefore will produce functional immunoglobulins.

Lonza GS System.

Lonza GS system utilizes the vectors pEE12.4 and pEE6.4. Vector pEE12.4 contains the GS gene as the amplifiable selection marker, and pEE6.4 is a supplementary vector. The light chain will be cloned into one of the vectors and the heavy chain into the other vector. Thereafter, both vectors are cut with restriction enzymes and ligated together to form a single vector that can express both heavy and light chain genes on separate promoters. Therefore, is a dual-expression vector system, allowing for expression of both genes from a single vector. CHO cells are transfected with the dual-expression vector under the selection of methionine sulfoximine. Transfected cells are thus selected for.

Gene Amplification

Both dihydrofolate reductase (DHFR) and GS are amplifiable selection markers. Under selection pressure from increasing amounts of methotrexate and methionine sulfoximine respectively, transfected cell lines that have duplicated genomic regions containing the DHFR and GS genes will survive because they are more resistant to the selection reagents. Genes near the selection markers, such as the inserted heavy- and light-chain immunoglobulin genes are also amplified, resulting in higher gene copies and greater production rates of immunoglobulins. Clones producing antibodies that have been found to have neutralizing properties in the in vitro screens (see below) are amplified so that more antibodies can be obtained for subsequent in vivo studies.

Example 18: Identifying the Specificity of the Expressed Human Antibodies

Antibody screening occurs in two stages. We are utilizing a novel 'selective screening' process, in which we first select appropriate clonal families to be used in the screen for neutralizing antibodies. We screen the most frequent 1-3 clones of each clonal family for its ability to bind to the antigen. Our screen typically takes the format of an indirect ELISA, although flow cytometry may be used to identify cell-binding antibodies. This comprises first binding the appropriate antigen to an ELISA plate, then incubating it with supernatants containing the expressed antibodies. Antibodies that bind to the antigen are detected by a specific secondary antibody.

Once binding antibodies have been identified, the entire clonal family of that clone is cloned and expressed in the screening stage of the 'selection screen'. Although all antibodies in a clonal family are expected to bind to the same epitope, they may differ slightly in avidity of antigen binding and in their positioning over the antigen, differences that may affect the binding properties and/or neutralization ability of the antibodies; thus, in most cases, several different antibodies (possessing minor differences in their CDR3 regions) are expressed and screened for binding and neutralizing properties.

For neutralizing antibodies that target a specific ligand/receptor pair, 293T cells are first stably transfected with a signaling pathway reporter construct, such as a plasmid containing the luciferase gene linked to NF-kB transcription response elements. Activation of NF-kB in the transfected cell induces the expression of luciferase, whose levels can be determined in a luciferase assay. This measures NF-kB signaling activated by ligand-receptor binding. NF-kB is the signaling element of choice because most signaling events activate NF-kB. For assaying other signaling pathways, the luciferase gene promoter region contains the appropriate transcriptional binding site, such as that for AP-1, for example. Next, the 293T cells are transfected with the target receptor. 293T cells are then incubated with the ligand and binding antibodies of interest in 96-well plates. After 24 or 48 hours, a luciferase assay is done to determine expression of luciferase gene. Wells with neutralizing antibodies have minimal to no luciferase expression. Results are verified by Western blotting for phosphorylated signaling proteins in the NF-kB signaling pathway. A neutralizing antibody prevents ligand-receptor signaling; and consequently abrogates phosphorylation of signaling proteins.

For antigens present on live cells, such as cancer antigens and bacterial antigens, the in vitro neutralization assay takes the form of an assay that detects live/dead cells, and can be done in a high-throughput format. Cancer cells or bacteria are incubated in 96-well plates with a candidate antibody. A stain that distinguishes live from dead cells and is compatible with flow cytometry can then be applied to each well. Live and dead cells are stained with different fluorophores and screened using flow to give percentages of live and dead cells. Antibodies that pass the in vitro screen will then be screened in vivo for their neutralizing activity.

Virus in vitro neutralization assay may be conducted using a standard plaque neutralization assay. By doing plaque neutralization assays in 96-well plates, each well can be imaged using a microscope and plaque counting can be automated with image-analysis software. Neutralizing antibodies reduce plaque formation. These antibodies are then further screened in vivo for neutralizing activity.

See example 9 section "Fluzone ELISA", example 11 section "Flow cytometry . . . " and example 12 section "Staph Flow Cytometry" for successful assays of binding activity using ELISA (example 7) and flow cytometry (examples 9 and 10). See example 9 section "Influenza microneutralization assay" for a successful assay of antibodies with neutralizing activity.

Example 19: Sequencing of B Cells with More than One Cell Per Well

Figure 9:
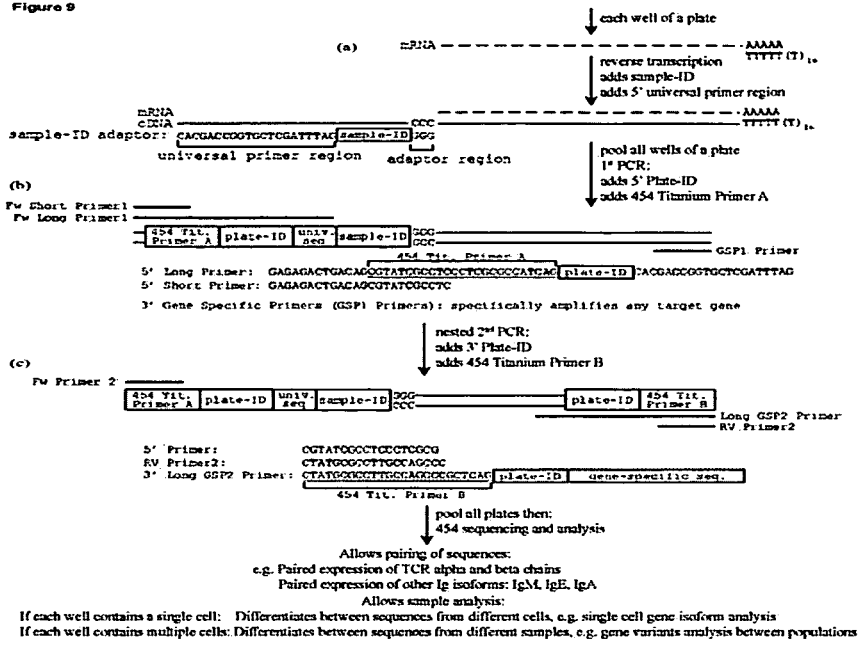
FIG. 9. Schematic of RT and PCR to add sample-Ms and plate-Ms to any amplicon and downstream utility. Individual samples comprising either single cells or multiple cells are separately reverse transcribed in wells. Reverse transcription adds a sample-ID and a 5' universal primer region to all $1^{st}$ strand cDNA as previously described (a). cDNA from all wells of a plate are pooled and undergo 2 rounds of PCR. The 1 PCR uses Fw Short Primer1, Fw Long Primer 1 as forward primers and adds a 454 Titanium Primer A for 454 sequencing and a plate-ID to the 5' end of the sequence. The Fw Short Primer1 has a Tm similar to the GSP1 primer and was included to slightly increase the efficiency of the PCR. Each GSP1 primer has a gene specific sequence and can specifically amplify that gene. Sequences for primers are shown. Note that regardless of which gene is amplified, the forward primers remain constant (b). The second PCR is a nested PCR. Fw Primer 2 is the forward primer, and the reverse primers are Long GSP2 Primer and Rv Primer 2. Long GSP2 is gene-specific and only amplifies a specific gene. It also adds the 454 Titanium Primer B for 454 sequencing and a plate-ID to the 3' end of the amplicon. RV Primer2 has a Tm similar to Fw Primer2 and was included to slightly increase PCR efficiency. Sequences for primers are shown. After RT and 2 PCRs, amplicons from all plates are pooled and 454-sequenced. The combination of plate-IDs and sample-IDs allows for identification of sequences that originate from the same sample. This allows for comparison of sequences between multiple samples. Sequences from the same origin may also be expressed in pairs to obtain the exact protein from the original cell, such as the T-cell receptor and other Ig isotypes such as IgM, IgE and IgA (c). From left to right and top to bottom: SEQ ID NOs: 796593, 796594, 796593, 796061, 796065, 796069, and 796595.

Individual samples having multiple B cells are separately reverse transcribed in containers. Reverse transcription adds a sample-ID and a 5' universal primer region to all $1^{st}$ strand cDNA. cDNA from all containers of a set of containers are pooled and undergo 2 rounds of PCR. Steps are as described in "Touchdown PCR and non-touchdown PCR", "Preparing for 454 XLR70 sequencing run" in the materials and methods. Sequences for primers are also shown in FIG. 9. Note that regardless of which gene is amplified, the forward primers remain constant (b). After RT and 2 PCRs, amplicons from all container sets are pooled and 454-sequenced. Assignment to wells and assembly of sequences follow the protocol as described in "Assignment of sequences to wells" and "assembly of sequences" in the materials and methods. The combination of plate-IDs and sample-IDs allows for identification of sequences that originate from the same sample.

Even though there are multiple cells in a well, we can pair individual heavy chains with light chains. The heavy chains from B cells derived from a common progenitor will be clonally related, as will the light chains. Therefore, we can associate a heavy chain clonal family to a light chain clonal family by observing the correlation across wells. Once an association is established between the heavy chains of a clonal family and the light chains of a clonal family, pairs are assigned in each well by selecting the heavy chain that is a member of the heavy chain clonal family and a light chain that is a member of the light chain clonal family. The selection of the pair is unambiguous when only a single instance of the heavy chain family and a single instance of the light chain family is present in a well. After determining which heavy and light chains are associated with one another, evolutionary trees may be drawn and antibodies selected for downstream characterization of their functional properties.

Example 20: Sequencing of B Cells with One or More Cells Per Well

Samples could be sorted with one B cell per well in some plates, and multiple B cells per well in other plates, yet heavy and light chains could still be paired for those wells having more than one B cell. We examined the sequences generated from the flu vaccination patient of example 9 above, where some wells had more than one distinct heavy chain sequence assembly or more than one distinct light chain sequence assembly observed. RT, PCR, sequencing and assignment to wells and assembly of sequences followed the protocol in example 9 above. For determining which heavy and light chains were associated with each other, heavy chains were assigned to clonal families by grouping all heavy chains with the same V and J gene usage, and the same number of nucleotides between the end of the V gene segment and the beginning of the J gene segment. Light chains were assigned to clonal families by grouping all light chains with the same V and J gene usage, and the same number of nucleotides between the end of the V gene segment and the beginning of the J gene segment. Pairing relationships between heavy and light chains were first assigned for wells with exactly one heavy chain and one light chain, based on them sharing a well (i.e. having the same compound barcodes). Then, a score was computed for each possible pairing of a heavy chain clonal family with a light chain clonal family. The score was determined by counting the number of times a member of the heavy chain family and the light chain family share a well. Then, each heavy chain family was associated with the light chain family with which the highest score was achieved, or the heavy chain family was not associated to a light chain family if the highest score was achieved with more than one light chain family. Individual heavy and light chains were then paired by starting with the overall highest-scoring heavy chain family, and proceeding well by well through the family assigning pairs, then continuing on with the next heavy chain family. For a given heavy chain family, for each well, if there was a single heavy chain within the well that was a member of the heavy chain family, then the light chain from that well which belonged to the heavy chain family's associated light chain family was assigned to be the heavy chain's pair. If more than one such light chain existed, no pairing was assigned. This process of associating heavy chains with light chains was continued until all families and all chains within those families had been considered. If, for a given heavy or light chain, the process resulted in more than one candidate for pairing, both heavy and light chain were discarded. Evolutionary trees were generated from the paired chains, and antibodies selected for downstream characterization of their functional properties. A portion of the evolutionary tree is shown in FIG. 25A.

Example 21: Use of Sorted Plasmablasts to Generate Human Monoclonal Antibodies

From a subject with a recent or current condition resulting in acute, subacute, or ongoing generation of circulating plasmablast, flow cytometry is performed on peripheral blood (either whole blood or peripheral blood mononuclear cells (PBMCs)) to identify the plasmablast population. This population of B cells is then sorted by flow cytometry as single cells into wells containing a hypotonic buffer with an RNAse inhibitor. Sorted cells can be frozen at this time or used immediately for RT-PCR to create cDNA. During RT, well-specific sample-ID adaptor oligonucleotides are added to the reaction. These adaptors have well-specific barcode sequences (sample-IDs) that can identify sequences as originating from different wells. Utilizing the 3' tailing and template-switching activity of MMLV H$^-$ reverse transcriptases, sample-IDs are added to the 3' end of the 1$^{st}$ strand cDNA. cDNA from each plate are pooled together. During the first round of PCR, a plate-specific FW long primer1 adds the plate-ID to the 5' end of the amplicons. Thus, FW long primer1 with different plate-IDs are added to different plates giving each PCR product an identifying barcode sequence. Gene specific reverse primers are used to amplify the kappa, lambda and gamma chains, they are kappa GSP1, lambda GSP1 and gamma GSP1 respectively. These primers bind to the constant region of the immunoglobulin genes. Products from the first round of PCR are diluted and used for a second nested PCR. FW primer2 is used as the forward primer and reverse primers kappa, lambda, and gamma GSP long primers are used to amplify their respective amplicons. Notably, the GPS long primer2 for each plate adds a common plate ID to the 3' end of each amplicon for each plate, thus each will end up having two plate-IDs and a sample-ID barcode. Further details for RT, 1st and 2nd PCR are found in "non-touchdown PCR" in the materials and methods. Multiple plates are then pooled according to the method detailed in "preparing for 454 XLR70 sequencing run" and subjected to high-throughput 454 DNA sequencing and individual sequences identified with their barcodes serving as identifiers of which heavy and/or light chain is obtained from each well thus providing a guide for matching individual variable heavy and light chains derived from the same initial cell, according to the methods detailed in "Assignment of sequences to wells" and "Assembly of sequences" in the materials and methods. Evolutionary trees are then drawn and antibodies selected for cloning, expression and determination of functional activity (see FIGS. 6-8).

Figure 26:
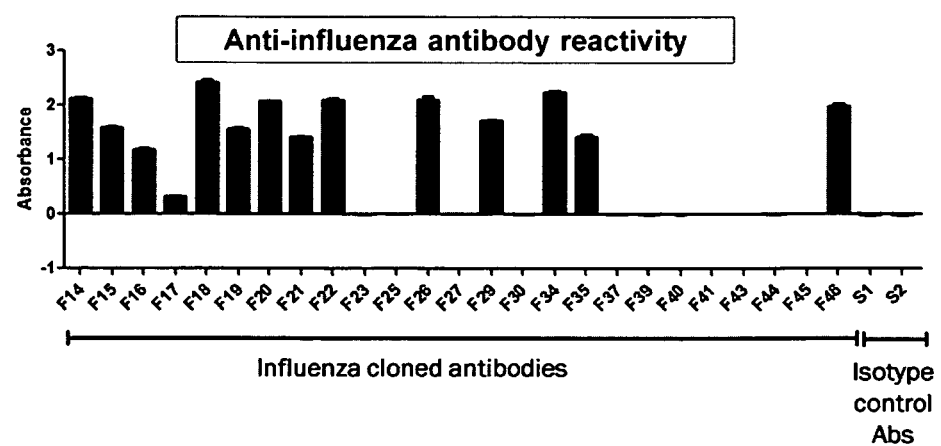
FIG. 26. Recombinant anti-influenza antibodies bound to Fluzone influenza virus vaccine. Analysis of the evolutionary tree (FIG. 8) of the heavy and light chain antibody repertoire dataset generated for the influenza vaccinated human described in FIG. 7 was performed to select antibodies representative of the clonal families identified. The heavy and light chains for the selected antibodies representing both clonal families as well as several singlet branches were cloned by PCR and co-transfected into 293T cells (as outlined in FIG. 2), and supernatants collected from transfectants as described in FIG. 24. The recombinant antibodies were then tested for reactivity against the Fluzone influenza virus vaccine (Sanofi) by ELISA, with the Fluzone vaccine coated on the ELISA plate. The recombinant influenza virus antibodies were incubated in the ELISA plate at 100 ng/ml, and a horse radish peroxidase (HRP)-conjugated anti-human IgG antibody used to detect antibody binding. The TMB substrate reaction was allowed to go for 30 minutes before quenching with acid stop. Readout is displayed as 450 nm absorbance as no standards were available. Multiple recombinant antibodies representing the identified clonal families bound to the influenza virus vaccine, while recombinant antibodies representative of other clonal families and the "dead ends" did not bind influenza vaccine.

Candidate heavy and light chain genes from particular cells of origin are then cloned and expressed for screening of desired properties as in example 8. Once stably or transiently transfected, the expression of the paired heavy and light chains will result in generation of monoclonal antibodies recapitulating the specificity of the initially sorted cell. Supernatants containing secreted antibodies are then screened for desired properties including but not limited to antigen specificity against the target antigen of interest as well as functionality by appropriate functional assays. FIGS. 9 and 6 each provide one example of a general methodology for carrying out this method. FIGS. 26-27 demonstrate how this was done using the compositions and methods herein to obtain human monoclonal antibodies against hemagglutinin from single cell sorted plasmablasts from an influenza-vaccinated human.

Example 22: Use of Sorted Unbiased or Antigen-Specific Memory B Cells to Generate Human Monoclonal Antibodies From a subject with a documented or suspected exposure to an antigen of interest, FACS is performed on peripheral blood (either whole blood or isolate peripheral blood mononuclear cells, PBMCs) to identify the memory B cell population (defined as CD19$^+$CD20$^+$CD27$^+$). Additionally, memory B cells specific against antigens of interest may also be sorted by staining peripheral blood or PBMCs with memory B cell surface markers and with fluorophore-conjugated antigen(s) (CD19$^+$CD20$^+$CD27$^+$ antigen$^+$). This population of cells is then sorted by FACS either as single cells or multiple cells into wells. The process described in detail in Example 21 is repeated to barcode and obtain sequences from 454 sequencing and assign sequences to wells and assemble sequences. HighV-QUEST is used to identify VDJ gene usage, and a few members of each clonal family on an evolutionary tree selected for cloning and expression as in example 8. Cloning and expression is done as detailed in example 8. Once transfected, the expression of the entire paired heavy and light chains will result in generation of monoclonal antibodies recapitulating the specificity of the initially sorted cell. Supernatants containing antibodies will be screened for antigen specificity against the target antigen(s) of interest as well as functionality by appropriate functional assays. FIGS. 9 and 6 each provide one example of a general methodology for carrying out this method. FIGS. 26-27 provide another example of obtaining human monoclonal antibodies from functional characterization of selected cloned and expressed antibodies from evolutionary trees.

Example 23: Use of Sorted Unbiased or Antigen-Specific Total B Cells to Generate Human Monoclonal Antibodies From a subject with or without documented or suspected prior exposure an antigen of interest, FACS is performed on peripheral blood (either whole blood or isolate peripheral blood mononuclear cells, PBMCs) to identify the CD19$^+$ B cell population. This population of cells is then sorted by FACS either as single cells or multiple cells into wells. The process described in detail in Example 21 is repeated. The process described in detail in Example 21 is repeated to barcode and obtain sequences from 454 sequencing and assign sequences to wells and assemble sequences. HighV-QUEST is used to identify VDJ gene usage, and a few members of each clonal family on an evolutionary tree selected for cloning and expression as in example 8. Once transfected, the expression of paired heavy and light chains will result in generation of monoclonal antibodies recapitulating the specificity of the initially sorted cell. Supernatants containing expressed antibodies will be screened for antigen specificity against the target antigen of interest as well as functionality by appropriate functional assays. FIGS. 9 and 6 each provide one example of a general methodology for carrying out this method. FIGS. 26-27 provide another example of obtaining human monoclonal antibodies from functional characterization of selected cloned and expressed antibodies from evolutionary trees.

Example 24: Use of Plasma Cells to Generate Human Monoclonal Antibodies

From a subject with or without documented or suspected prior exposure an antigen of interest, FACS is performed on peripheral blood (either whole blood or isolate peripheral blood mononuclear cells, PBMCs) or bone marrow cells to identify the CD138$^+$ plasma cell population. This population of cells is then sorted by FACS either as single cells or multiple cells into wells. The process described in detail in Example 21 is repeated to barcode and obtain sequences from 454 sequencing and assign sequences to wells and assemble sequences. HighV-QUEST is used to identify VDJ gene usage, and a few members of each clonal family on an evolutionary tree selected for cloning and expression. Once transfected, the expression of paired heavy and light chains will result in generation of monoclonal antibodies recapitulating the specificity of the initially sorted cell. Supernatants containing expressed antibodies will be screened for antigen specificity against the target antigen of interest as well as functionality by appropriate functional assays. FIGS. 9 and 6 each provide one example of a general methodology for carrying out this method. FIGS. 26-27 provide another example of obtaining human monoclonal antibodies from functional characterization of selected cloned and expressed antibodies from evolutionary trees.

Example 25: Use of Blasting B Cells to Generate Human Monoclonal Antibodies

From a subject with or without documented or suspected prior exposure an antigen of interest, FACS is performed on peripheral blood (either whole blood or isolate peripheral blood mononuclear cells, PBMCs) to identify the FSC$^{hi}$ blasting B cell population. Blasting cells are activated B cells, and therefore are cells that have responded against the antigen and are actively proliferating. These B cells consist of clonal families and their paired heavy and light chains can be used to obtain evolutionary trees. Other markers of B cell activation, such as CD69$^{hi}$ and CD44$^{hi}$ may also be used in conjunction. Additionally DNA content, which may be stained using cell permeable DNA stains such as SYTO Blue (Invitrogen), to determine cells that are activated, proliferating and in the cell cycle may also be used in conjunction to delineate blasting B cells. This population of cells is then sorted by FACS either as single cells or multiple cells into wells. The process described in detail in Example 21 is repeated to barcode and obtain sequences from 454 sequencing and assign sequences to wells and assemble sequences. HighV-QUEST is used to identify VDJ gene usage, and a few members of each clonal family on an evolutionary tree selected for cloning and expression. Once transfected, the expression of paired heavy and light chains will result in generation of monoclonal antibodies recapitulating the specificity of the initially sorted cell. Supernatants containing expressed antibodies will be screened for antigen specificity against the target antigen of interest as well as functionality by appropriate functional assays. FIGS. 9 and 6 each provide one example of a general methodology for carrying out this method. FIGS. 26-27 provide another example of obtaining human monoclonal antibodies from functional characterization of selected cloned and expressed antibodies from evolutionary trees.

Example 26: Use of Murine B Cells to Generate Monoclonal Antibodies

A mouse is challenged with an antigen of interest, and may be given booster shots several times before sacrificing the mouse to obtain murine B cells. Murine B cells may be obtained from blood, from splenocytes or from the bone marrow. Flow cytometry is performed to obtain CD19$^+$ or B220$^+$ B cells. This population of B cells is then sorted by flow cytometry as single cells into wells containing a hypotonic buffer with an RNAse inhibitor. Sorted cells can be frozen at this time or used immediately for RT-PCR to create cDNA. RT, 1st and 2nd PCR is performed as detailed in "non-touchdown PCR" in the materials and methods. Mouse gene-specific primers are found in Table 11 and other primers used for RT and PCR are found in Table 1. Multiple plates are then pooled according to the method detailed in "preparing for 454 XLR70 sequencing run" and subjected to high-throughput 454 DNA sequencing and individual sequences identified with their barcodes serving as identifiers of which heavy and/or light chain is obtained from each well thus providing a guide for matching individual variable heavy and light chains derived from the same initial cell, according to the methods detailed in "Assignment of sequences to wells" and "assembly of sequences" in the materials and methods. Evolutionary trees are then drawn and antibodies selected for cloning, expression and determination of functional activity.

Sequences for cloning can either be obtained through synthetic gene synthesis or amplified from the 1$^{st}$ PCR products using cloning primers. The forward cloning primer is sample-ID specific and can amplify specific sequences from a pool of amplicons. The sequence for each heavy and light chain is then cloned into an expression vector containing complementary restriction sites for those introduced by the cloning primers. Vectors also contain the either the heavy or light chain constant region, which the heavy or light chain sequences are cloned into (reading frame aligned) to produce the entire antibody. Vectors contain either heavy or light chain clones are then dual transfected into a mammalian expression system or alternately, both amplicons can be cloned into a dual expression vector to allow for a single transfection into mammalian cells.

Candidate heavy and light chain genes from particular cells of origin are then expressed using the for screening of desired properties as above. Once stably or transiently transfected, the expression of the paired heavy and light chains will result in generation of monoclonal antibodies recapitulating the specificity of the initially sorted cell. Supernatants containing secreted antibodies are then screened for desired properties including but not limited to antigen specificity against the target antigen of interest as well as functionality by appropriate functional assays. FIGS. 9 and 6 each provide one example of a general methodology for carrying out this method. FIGS. 26-27 provide another example of obtaining monoclonal antibodies from functional characterization of selected cloned and expressed antibodies from evolutionary trees.

Example 27: Use of Murine Plasma Cells to Generate Monoclonal Antibodies

A mouse is challenged with an antigen of interest, and may be given booster shots several times before sacrificing the mouse to obtain murine B cells. Murine plasma cells may be obtained from blood, from splenocytes or from the bone marrow, although the splenocytes and bone marrow are typically used. Flow cytometry is performed to obtain CD19$^{low/-}$B220$^{low/-}$CD138$^+$plasma cells. This population of plasma cells is then sorted by flow cytometry as single cells into wells containing a hypotonic buffer with an RNAse inhibitor. Sorted cells can be frozen at this time or used immediately for RT-PCR to create cDNA. RT, 1st and 2nd PCR is performed as detailed in "non-touchdown PCR" in the materials and methods. Mouse gene-specific primers are found in Table 11, and other primers used for RT and PCR are found in Table 1. Multiple plates are then pooled according to the method detailed in "preparing for 454 XLR70 sequencing run" and subjected to high-throughput 454 DNA sequencing and individual sequences identified with their barcodes serving as identifiers of which heavy and/or light chain is obtained from each well thus providing a guide for matching individual variable heavy and light chains derived from the same initial cell, according to the methods detailed in "Assignment of sequences to wells" and "assembly of sequences" in the materials and methods. Evolutionary trees are then drawn and antibodies selected for cloning, expression and determination of functional activity.

Sequences for cloning can either be obtained through synthetic gene synthesis or amplified from the 1$^{st}$ PCR products using cloning primers as described in example 26. Candidate heavy and light chain genes from particular cells of origin are then expressed using the for screening of desired properties as above. Once stably or transiently transfected, the expression of the paired heavy and light chains will result in generation of monoclonal antibodies recapitulating the specificity of the initially sorted cell. Supernatants containing secreted antibodies are then screened for desired properties including but not limited to antigen specificity against the target antigen of interest as well as functionality by appropriate functional assays. FIGS. 9 and 6 each provide one example of a general methodology for carrying out this method. FIGS. 26-27 provide another example of obtaining monoclonal antibodies from functional characterization of selected cloned and expressed antibodies from evolutionary trees.

Example 28: Use of Unbiased or Antigen-Specific Murine Memory B Cells to Generate Monoclonal Antibodies A mouse is challenged with an antigen of interest, and may be given booster shots several times before sacrificing the mouse to obtain murine B cells. Murine memory B cells may typically be obtained from splenocytes or lymph nodes. Flow cytometry is performed to obtain CD19$^+$ or B220$^+$ and CD38$^+$IgG$^+$ memory B cells. Other markers, such as CD45RO, may also be used. Antigen-specific memory B cells may also be visualized by staining with fluorophore-conjugated antigen and sorted for. This population of memory B cells is then sorted by flow cytometry as single cells into wells containing a hypotonic buffer with an RNAse inhibitor. Sorted cells can be frozen at this time or used immediately for RT-PCR to create cDNA. RT, 1st and 2nd PCR, followed by sequencing, assignment of sequences to wells and sequence assembly is performed as in example 26. Evolutionary trees are then drawn and antibodies selected for cloning, expression and determination of functional activity.

Sequences for cloning can either be obtained through synthetic gene synthesis or amplified from the 1$^{st}$ PCR products using cloning primers as described in example 26. Candidate heavy and light chain genes from particular cells of origin are then expressed using the for screening of desired properties as above. Once stably or transiently transfected, the expression of the paired heavy and light chains will result in generation of monoclonal antibodies recapitulating the specificity of the initially sorted cell.

Supernatants containing secreted antibodies are then screened for desired properties including but not limited to antigen specificity against the target antigen of interest as well as functionality by appropriate functional assays. FIGS. 3 and 9 each provide one example of a general methodology for carrying out this method. FIGS. 26-27 provide another example of obtaining monoclonal antibodies from functional characterization of selected cloned and expressed antibodies from evolutionary trees.

Example 29: Use of Murine Short-Lived Plasmablasts to Generate Monoclonal Antibodies A mouse is challenged with an antigen of interest, and may be given booster shots several times before sacrificing the mouse to obtain murine B cells. Murine short-lived plasmablasts may typically be obtained from splenocytes. These plasmablasts have been variously described as $CD19^{low/-}B220^{low/-}$ and $CD22^{low}$ or $CD11c^+$, and also as $CD138^+$. Flow cytometry is performed to obtain plasmablasts. This population of plasmablasts is then sorted by flow cytometry as single cells into wells containing a hypotonic buffer with an RNAse inhibitor. Sorted cells can be frozen at this time or used immediately for RT-PCR to create cDNA. RT, 1st and 2nd PCR, followed by sequencing, assignment of sequences to wells and sequence assembly is performed as in example 26. Evolutionary trees are then drawn and antibodies selected for cloning, expression and determination of functional activity.

Sequences for cloning can either be obtained through synthetic gene synthesis or amplified from the $1^{st}$ PCR products using cloning primers as described in example 26. Candidate heavy and light chain genes from particular cells of origin are then expressed using them for screening of desired properties as above. Once stably or transiently transfected, the expression of the paired heavy and light chains will result in generation of monoclonal antibodies recapitulating the specificity of the initially sorted cell. Supernatants containing secreted antibodies are then screened for desired properties including but not limited to antigen specificity against the target antigen of interest as well as functionality by appropriate functional assays. FIGS. 9 and 6 each provide one example of a general methodology for carrying out this method. FIGS. 26-27 provide another example of obtaining monoclonal antibodies from functional characterization of selected cloned and expressed antibodies from evolutionary trees.

Example 30: Use of Murine Blasting B Cells to Generate Monoclonal Antibodies

A mouse is challenged with an antigen of interest, and may be given booster shots several times before sacrificing the mouse to obtain murine B cells. Murine blasting B cells may typically be obtained from splenocytes. Blasting cells are activated B cells, and therefore are cells that have responded against the antigen and are actively proliferating. These B cells consist of clonal families and their paired heavy and light chains can be used to obtain evolutionary trees. Blasting B cells may be gated as $FSC^{hi}$, and may also be further identified via cell surface markers such as $CD44^{hi}$ $CD69^{hi}$ and as blasting B cells are proliferating, they may also be identified as having entered the cell cycle by having increased DNA content as stained by cell permeably DNA stains such as SYTO Blue. Flow cytometry is performed to obtain blasting B cells. This population of plasmablasts is then sorted by flow cytometry as single cells into wells containing a hypotonic buffer with an RNAse inhibitor. Sorted cells can be frozen at this time or used immediately for RT-PCR to create cDNA. RT, 1st and 2nd PCR, followed by sequencing, assignment of sequences to wells and sequence assembly is performed as in example 26. Evolutionary trees are then drawn and antibodies selected for cloning, expression and determination of functional activity.

Sequences for cloning can either be obtained through synthetic gene synthesis or amplified from the $1^{st}$ PCR products using cloning primers as described in example 26. Candidate heavy and light chain genes from particular cells of origin are then expressed using the for screening of desired properties as above. Once stably or transiently transfected, the expression of the paired heavy and light chains will result in generation of monoclonal antibodies recapitulating the specificity of the initially sorted cell. Supernatants containing secreted antibodies are then screened for desired properties including but not limited to antigen specificity against the target antigen of interest as well as functionality by appropriate functional assays. FIGS. 9 and 6 each provide one example of a general methodology for carrying out this method. FIGS. 26-27 provide another example of obtaining monoclonal antibodies from functional characterization of selected cloned and expressed antibodies from evolutionary trees Example 31: Obtaining Monoclonal Antibodies from Unbiased or Antigen-Specific Human IgA+ B Cells From a subject with or without documented or suspected prior exposure an antigen of interest, FACS is performed on peripheral blood (either whole blood or isolate peripheral blood mononuclear cells, PBMCs) or on bone marrow to isolate IgA+ B cells. These B cells may be memory B cells, plasma cells, or plasmablasts. These IgA B cells may also be antigen-specific, by sorting for antigen-positive B cells using a fluorophore-conjugated antigen to stain for the IgA+ B cells. This population of cells is then sorted by FACS either as single cells or multiple cells into wells. The process described in detail in Example 21 is repeated to barcode and obtain sequences from 454 sequencing and assign sequences to wells and assemble sequences, and IgA constant region specific primers used for PCR are in Table 10. HighV-QUEST is used to identify VDJ gene usage, and a few members of each clonal family on an evolutionary tree selected for cloning and expression as in example 8. Supernatants containing expressed antibodies will be screened for antigen specificity against the target antigen of interest as well as functionality by appropriate functional assays. FIGS. 9 and 6 each provide one example of a general methodology for carrying out this method. FIGS. 26-27 provide another example of obtaining human monoclonal antibodies from functional characterization of selected cloned and expressed antibodies from evolutionary trees.

Example 32: Obtaining Monoclonal Antibodies from Unbiased or Antigen-Specific Human IgM+ B Cells From a subject with or without documented or suspected prior exposure an antigen of interest, FACS is performed on peripheral blood (either whole blood or isolate peripheral blood mononuclear cells, PBMCs) to isolate IgM+ B cells. These B cells may be memory B cells, plasma cells, or blasting B cells. These $IgM^+$ B cells may also be antigen-specific, by sorting for antigen-positive B cells using a fluorophore-conjugated antigen to stain for the IgM+ B cells. This population of cells is then sorted by FACS either as single cells or multiple cells into wells. The process described in detail in example 21 is repeated to barcode and obtain sequences from 454 sequencing and assign sequences to wells and assemble sequences, and IgM constant region specific primers used for PCR are in Table 10. HighV-QUEST is used to identify VDJ gene usage, and a few members of each clonal family on an evolutionary tree selected for cloning and expression as in example 8. Supernatants containing expressed antibodies will be screened for antigen specificity against the target antigen of interest as well as functionality by appropriate functional assays. FIGS. 9 and 6 each provide one example of a general methodology for carrying out this method. FIGS. 26-27 provide another example of obtaining human monoclonal antibodies from functional characterization of selected cloned and expressed antibodies from evolutionary trees.

Example 33: Obtaining Monoclonal Antibodies from Unbiased or Antigen-Specific Murine IgA+ B Cells A mouse is challenged with an antigen of interest, and may be given booster shots several times before sacrificing the mouse to obtain murine IgA$^+$ B cells. These B cells may be memory B cells, plasma cells, plasmablasts or blasting B cells, and can typically be obtained from splenocytes. These IgA$^+$ B cells may also be antigen-specific, by sorting for antigen-positive B cells using a fluorophore-conjugated antigen to stain for the IgA$^+$ B cells. This population of IgA$^+$ B cells is then sorted by flow cytometry as single cells into wells containing a hypotonic buffer with an RNAse inhibitor. Sorted cells can be frozen at this time or used immediately for RT-PCR to create cDNA. RT, 1st and 2nd PCR, followed by sequencing, assignment of sequences to wells and sequence assembly is performed as in example 26, and IgA constant region specific primers used for PCR are in Table 11. Evolutionary trees are then drawn and antibodies selected for cloning, expression and determination of functional activity. FIGS. 9 and 6 provides one example of a general methodology for carrying out this method.

Example 34: Obtaining Monoclonal Antibodies from Unbiased or Antigen-Specific Murine IgM+ B Cells A mouse is challenged with an antigen of interest, and may be given booster shots several times before sacrificing the mouse to obtain murine IgM$^+$ B cells. These B cells may be memory B cells, plasma cells, plasmablasts or blasting B cells, and can typically be obtained from splenocytes. These IgM$^+$ B cells may also be antigen-specific, by sorting for antigen-positive B cells using a fluorophore-conjugated antigen to stain for the IgM+ B cells. This population of IgM$^+$ B cells is then sorted by flow cytometry as single cells into wells containing a hypotonic buffer with an RNAse inhibitor. Sorted cells can be frozen at this time or used immediately for RT-PCR to create cDNA. RT, 1st and 2nd PCR, followed by sequencing, assignment of sequences to wells and sequence assembly is performed as in example 26, and IgA constant region specific primers used for PCR are in Table 11. Evolutionary trees are then drawn and antibodies selected for cloning, expression and determination of functional activity. FIGS. 9 and 6 provides one example of a general methodology for carrying out this method.

Example 35: Sequencing of More than One Sequence from Human T Cells

From a subject with a recent or current condition resulting in acute, subacute, or ongoing generation of circulating T cells, flow cytometry is performed on peripheral blood (either whole blood or peripheral blood mononuclear cells (PBMCs)) to identify the T cell population of interest. This population of T cells may be activated T cells or blasting T cells. Activated T cells may be identified using CD44$^{hi}$, CD69$^{hi}$, CD154$^+$, CD137$^+$, or blasting T cells, which are also activated T cells may be delineated by their size or FSC$^{hi}$, and may also be identified as being in the cell cycle using a cell permeant DNA dye such as SYTO Blue. Activated T cells should consist of clonal families which then can be clustered into an evolutionary tree, with identical family members in clonal families, which can be used to select clones for downstream functional analysis. T cells are then sorted by flow cytometry as single cells into wells containing a hypotonic buffer with an RNAse inhibitor. Sorted cells can be frozen at this time or used immediately for RT-PCR to create cDNA. RT and PCR to barcode the TCR genes are detailed in "Non-touchdown PCR" in the materials and methods, sequencing prep is detailed in "Preparing for 454 XLR70 sequencing run" in the materials and methods, and assignment of sequences to wells and assembly of reads are detailed in "Assignment of sequences to wells" and "assembly of sequences" in the materials and methods, TCR gene-specific primers are found in Table 10. Evolutionary trees are then constructed and candidate genes from particular cells of origin are then chosen to be cloned and expressed for screening of desired properties. Sequences for cloning can either be gene-synthesized or amplified from the 1$^{st}$ PCR products with cloning primers. Specific clones can be isolated from a pool of clones by having the forward cloning primer specific for the sample-ID barcode sequence. Reverse cloning primers are complementary for the appropriate gene. Both forward and reverse primers contain flanking restriction sites to integrate the clone (coding frame aligned) into a vector. Cells are either doubly transfected with two expression vectors, each containing either a gene of interest, or singly transfected with a dual expression vector that expresses both genes of interest, e.g., T cell alpha and beta chains.

Once stably or transiently transfected, the genes of interest can be expressed and screened for function properties using the desired screens.

Example 36: Sequencing of More than One Sequence from Murine T Cells

A mouse is challenged with an antigen of interest, and may be given booster shots several times before sacrificing the mouse to obtain murine T cells. T cells are CD3$^+$, and helper T cells are CD4$^+$ and cytotoxic T cells are CD8$^+$. This population of T cells may be memory or activated T cells or blasting T cells. Memory T cells may be identified as CD45RO$^+$. Activated T cells may be identified using CD44$^{hi}$, CD69$^{hi}$, or blasting T cells, which are also activated T cells may be delineated by their size or FSC$^{hi}$, and may also be identified as being in the cell cycle using a cell permeant DNA dye such as SYTO Blue. All these T cells in a mouse kept in a clean environment after repeated antigen exposure should have a large fraction of clonal families which can then be displayed as an evolutionary tree, which can then be used to select TCRs for cloning and expression and downstream functional analysis.

T cells are sorted by flow cytometry using the suggested markers above. as single cells into wells containing a hypotonic buffer with an RNAse inhibitor. Sorted cells can be frozen at this time or used immediately for RT-PCR to create cDNA. RT and PCR to barcode the TCR genes are detailed in "Non-touchdown PCR" in the materials and methods, sequencing prep is detailed in "Preparing for 454 XLR70 sequencing run" in the materials and methods, and assignment of sequences to wells and assembly of reads are detailed in "Assignment of sequences to wells" and "assembly of sequences" in the materials and methods, TCR gene-specific primers are found in Table 11. Evolutionary trees are then constructed and candidate genes from particular cells of origin are then chosen to be cloned and expressed for screening of desired properties. Sequences for cloning can either be gene-synthesized or amplified from the $1^{st}$ PCR products with cloning primers. Specific clones can be isolated from a pool of clones by having the forward cloning primer specific for the sample-ID barcode sequence. Reverse cloning primers are complementary for the appropriate gene. Both forward and reverse primers contain flanking restriction sites to integrate the clone (coding frame aligned) into a vector. Cells are either doubly transfected with two expression vectors, each containing either a gene of interest, or singly transfected with a dual expression vector that expresses both genes of interest, e.g., T cell alpha and beta chains.

Once stably or transiently transfected, the genes of interest can be expressed and screened for function properties using the desired screens.

Example 37: Sequencing of More than One Sequence from a Sample

A single sample comprising nucleic acids of interest is identified. The single sample can have a single cell or a population of cells. The sample can be sorted by flow cytometry as single cells into wells containing a hypotonic buffer with an RNAse inhibitor. Sorted cells can be frozen at this time or used immediately for RT-PCR to create cDNA. This population of B cells is then sorted by flow cytometry as single cells into wells containing a hypotonic buffer with an RNAse inhibitor. Sorted cells can be frozen at this time or used immediately for RT-PCR to create cDNA. RT, 1st and 2nd PCR is performed as detailed in "non-touchdown PCR" in the materials and methods. Multiple plates are then pooled according to the method detailed in "preparing for 454 XLR70 sequencing run" and subjected to high-throughput 454 DNA sequencing and individual sequences identified with their barcodes serving as identifiers of which heavy and/or light chain is obtained from each well thus providing a guide for matching individual variable heavy and light chains derived from the same initial cell, according to the methods detailed in "Assignment of sequences to wells" and "assembly of sequences" in the materials and methods. Evolutionary trees are then drawn and antibodies selected for cloning, expression and determination of functional activity.

Candidate genes from particular cells of origin are then chosen to be cloned and expressed for screening of desired properties or other needs. Sequences for cloning can either be gene-synthesized or amplified from the $1^{st}$ PCR products with cloning primers. Specific clones can be isolated from a pool of clones by having the forward cloning primer specific for the sample-ID barcode sequence. Reverse cloning primers are complementary for the appropriate gene. Both forward and reverse primers contain flanking restriction sites to integrate the clone (coding frame aligned) into a vector. Cells are either transfected with two or more expression vectors, each containing either a gene of interest, or singly transfected with an expression vector that expresses the genes of interest.

Once stably or transiently transfected, the genes of interest can be expressed and screened where desired. FIGS. 9 and 6 provides one example of a general methodology for carrying out this method.

Example 38: Cloning of Immunoglobulin V(D)J Regions by DNA Synthesis

The desired immunoglobulin light chain and heavy chain V(D)J regions can be synthetically generated by DNA synthesis for cloning into expression vectors. The sequence used for the synthesis can be derived directly from the high-throughput 454 sequences, or alternatively cDNA encoding the heavy and light chain immunoglobulins from the sample(s) of interest can be re-sequenced from the individual sample or pooled samples for further verification of the sequence, and this sequence is used to synthesize the selected light chain and heavy chain V(D)J regions. Variable regions of Ig genes may be cloned by DNA synthesis, and incorporating the synthesized DNA into the vector containing the appropriate constant region using restriction enzymes and standard molecular biology. During synthesis, the exact nucleotide sequence need not be followed as long as the amino acid sequence is unchanged, unless mutagenesis is desired. This allows for codon optimization that may result in higher expression levels. This also allows for adding in restriction sites for the purpose of cloning. Non-translated sequences such as 5' UTR and barcode sequences need not be synthesized, leader sequences can also be swapped for other signal peptide sequences known for higher expression levels. These result in an Ig nucleotide sequence that can be very different from the high-throughput reads but give identical amino acid sequenced when expressed.

In one embodiment, the amplified V(D)J regions are inserted into vectors that already contain either the kappa, lambda, gamma or other heavy chain isotype constant regions with the appropriate restriction sites needed for inserting the amplified clones in the open reading frame. In another embodiment, the entire variable region may be gene synthesized with constant region and cloned into an expression vector for expression and downstream functional testing of antibody properties.

Example 39: Cloning of Immunoglobulin V(D)J Regions by Using Restriction Site Already Present in Sample Identification Adaptor In another aspect, the desired immunoglobulin light chain and heavy chain V(D)J regions can be cloned using restriction site already incorporated in the sample-ID adaptor added on during reverse transcription. This results in an adaptor with a restriction site 3' of the well-ID barcode in the PCR amplicon pool. During cloning with cloning primers, desired amplicons are amplified from a plate-specific amplicon pool using 5' primers that are complementary to the well-ID barcode sequences, and chain specific 3' primers (for the kappa, lambda and gamma chains). 3' primers will add on 3' restriction sites. 5' primers do not need to add restriction sites as the 5' primer already contains a restriction site 3' of the well-ID barcode. Following this amplification, restriction enzymes are used to cut the amplicon for ligation

Example 40: Identification of Clonal Families by Sequencing of Just One Immunoglobulin Chain (Heavy Chain or Light Chain), Followed by Cloning of Paired Immunoglobulin Heavy and Light Chain V(D)J Regions Antibody heavy and light chains are reversed transcribed from mRNA, incorporating distinct sample-IDs on the cDNAs generated from each sample, and sample cDNAs pooled for amplifying PCR. The immunoglobulin cDNAs are amplified and either the immunoglobulin heavy chain or the light chain is sequenced using 454 high-throughput sequencing, and the sequences grouped according to their use of immunoglobulin heavy chain V(D)J or light chain V(D)J sequences that exhibit use of the same genome-encoded V(D)J segments. Bioinformatics is used to identify clonal families of interest, and the desired immunoglobulin light and heavy chain V(D)J regions from the same sample are then selectively amplified for sequencing and/or cloning. For PCR amplification, the forward primer includes the sample-ID and the reverse primer is specific for the light chain or heavy chain constant region. The primers can incorporate restriction sites into the amplicons. Amplicons can then be inserted into the appropriate expression vectors that already contain a heavy or light chain constant region. Antibodies can then be expressed and screened for desired properties.

Example 41: Identification of Clonal Families from Immunoglobulin Heavy and Light Chain V(D)J Sequencing for Cloning and Expression of Antibodies Using Only Sample-IDs (and No Plate-IDs)

Antibody heavy and light chains are reversed transcribed from mRNA in each sample, incorporating distinct sample-IDs into the cDNA generated from each sample. Each sample-ID is at least 6 nucleotides long and 1 base-pair different, resulting in 4096 distinct potential sample-IDs. A distinct sample-ID is used for each sample, and the unique sample-IDs identify cDNA derived from different samples and enables paired sequencing and cloning of 2 or more cDNAs expressed in an individual sample. Heavy and light chain amplicons are amplified using PCR, which adds on the Titanium adaptors A and B required for 454 high-throughput sequencing and all samples are then sent for sequencing. Sequences are assigned to wells and assembled following "Assignment of sequences to wells" and "Assembly of sequences" sections in the materials and methods. V(D)J assignments are made using HighV-QUEST and grouped into clonal families based on their V(D)J usage. Selected clones are then specifically amplified with cloning primers, which also adds in restriction sites into the amplicon. Amplicons are then inserted in-frame into expression vectors which already contain the appropriate heavy or light constant regions for expression of the antibodies for screening for desired properties.

Example 42: Cloning of Paired Sequences by Ligating on the Universal Primer Sequence Antibody heavy and light chain genes are reversed transcribed from mRNA, which adds a 3' sequence to the newly synthesized cDNA consisting of an adaptor region and a sample-ID barcode. Samples are then pooled together and a universal primer sequence added to the 3' end of the 1st strand cDNA using T4 DNA ligase and a 5' phophorylated anti-sense universal primer oligonucleotide. Alternatively, 2nd strand cDNA synthesis may be done to obtain double stranded cDNA instead of an mRNA/cDNA hybrid before ligating on the universal primer sequence. Two rounds of PCR are then performed to amplify the cDNA and to add on plate-IDs and Titanium primers A and B for 454 sequencing. Alternatively, plate-IDs and Titanium Primers may also be added by DNA ligation instead of incorporated during PCR by using T4 DNA ligase. After 454 sequencing, sequences are assembled and clonal families identified. Selected clones from clonal families may be specifically cloned using cloning primers that add restriction sites to the amplicons. Sequences are then inserted in-frame into expression vectors that already have the appropriate heavy or light chain constant regions. Antibodies are then expressed and screened for desired properties.

Figure 10:
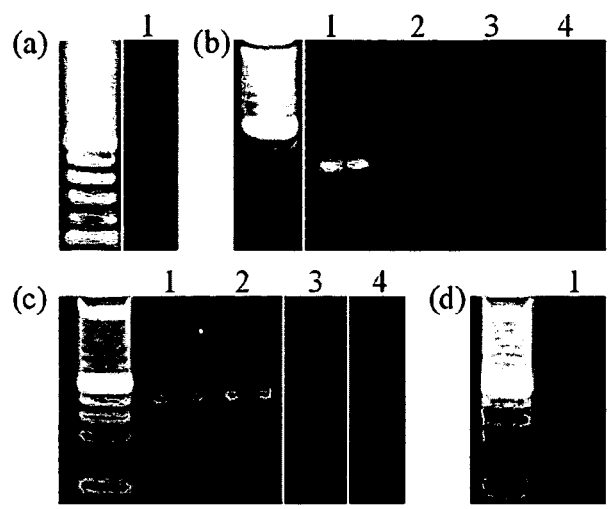
FIG. 10. Gene-specific primers for reverse transcription (RT-GSPs) of immunoglobulin heavy and light chains. RT-GSPs were used instead of oligo(dT)s as primers in reverse transcription of heavy and light chain genes. cDNA were then amplified by PCR and visualized on an agarose gel. RT-GSP primers IgKC_v3(a), IgLC_v5, IgLC_v6, IgLC_v7 and IgLC_v8 in lanes 1-4 respectively (b), IgHGC_v10, IgHGC_v11, IgHGC_v13 and IgGC_v15 in lanes 1-4 respectively (c) and IgHGC_v16 (d). KC, LC and GC in the primer names indicate that the primer is specific for the kappa chain, lambda chain and gamma heavy chain respectively. White bands in gel photos indicate where non-relevant lanes had been cropped out.

Example 43: Testing of Gene-Specific Primers for Reverse Transcription (RT-GSPs) of Immunoglobulin Heavy and Light Chains RT-GSPs were used instead of oligo(dT)s as primers in reverse transcription of heavy and light chain genes. cDNA were then amplified by PCR and visualized on an agarose gel. RT-GSP primers were IgKC_v3(a), IgLC_v5, IgLC_v6, IgLC_v7 and IgLC_v8 in lanes 1-4 respectively (b), IgHGC_v10, IgHGC_v11, IgHGC_v13 and IgGC_v15 in lanes 1-4 respectively (c) and IgHGC_v16 (d). KC, LC and GC in the primer names indicate that the primer is specific for the kappa chain, lambda chain and gamma heavy chain respectively. White bands in gel photos indicate where non-relevant lanes had been cropped out. See FIG. 10 and Table 6.

Example 44: Testing of Adaptor Region Sequences

Figure 11:
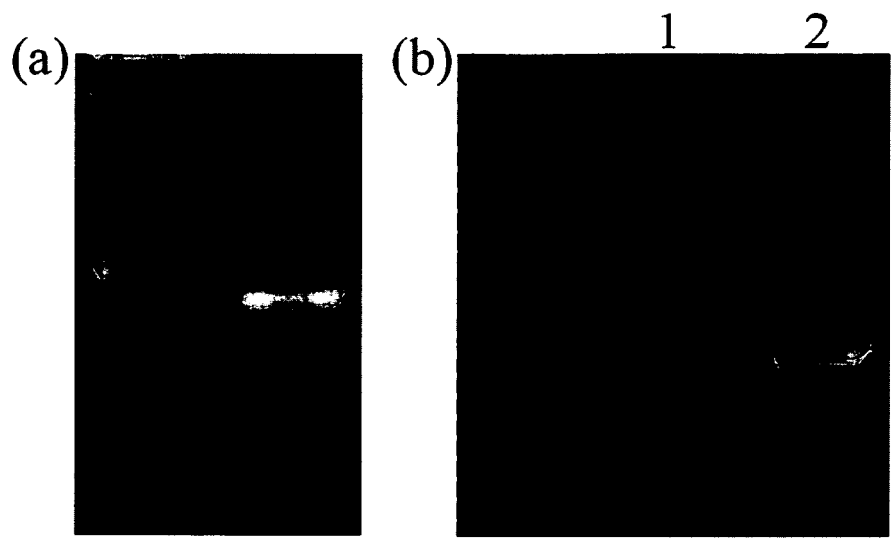
FIG. 11. Adaptor region sequences. RNA was reversed transcribed with oligonucleotides comprising a universal primer region and an adaptor region at the 3' terminal end. cDNA was then amplified using the universal primer region sequence as a forward primer and gene-specific sequences as reverse primers. Amplified products were visualized on an agarose gel. Adaptor region consists of G (a), GGGGG and rGrGrG in lanes 1 and 2 respectively (b). rG indicates RNA nucleotides instead of DNA nucleotides.

RNA was reversed transcribed with oligonucleotides comprising a universal primer region and an adaptor region at the 3' terminal end. cDNA was then amplified using the universal primer region sequence as a forward primer and gene-specific sequences as reverse primers. Amplified products were visualized on an agarose gel. Adaptor region consists of G (a), GGGGG and rGrGrG in lanes 1 and 2 respectively (b). rG indicates RNA nucleotides instead of DNA nucleotides. See FIG. 11 and Table 6.

Example 45: Testing of Universal Primer Sequences

Figure 12:
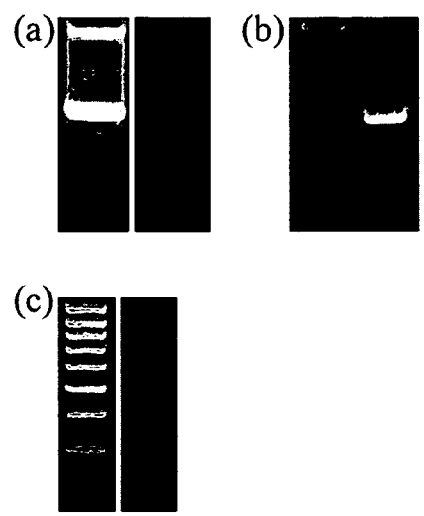
FIG. 12. Universal primer sequences. RNA was reverse transcribed with oligonucleotides comprising a universal primer sequence and an adaptor region at the 3' terminal. cDNA were then amplified by PCR using a forward primer complementary to the universal primer region and a reverse primer complementary to the gene specific sequence. Univ_seq_4 (a), univ_seq_5 (b) and univ_seq_f (c). Vertical white bands in gel photos indicate where non-relevant lanes have been cropped out. Otherwise lanes belong to the same gel photo.

RNA was reverse transcribed with oligonucleotides comprising a universal primer sequence and an adaptor region at the 3' terminal end. cDNA were then amplified by PCR using a forward primer complementary to the universal primer region and a reverse primer complementary to the gene specific sequence. Univ_seq_4 (a), univ_seq_5 (b) and uni-v_seq_f (c). Vertical white bands in gel photos indicate where non-relevant lanes have been cropped out. Otherwise lanes belong to the same gel photo. See FIG. 12 and Table 6.

Example 46: Testing of Gene-Specific Primer Sequences for 1st PCR Reaction

Figure 13:
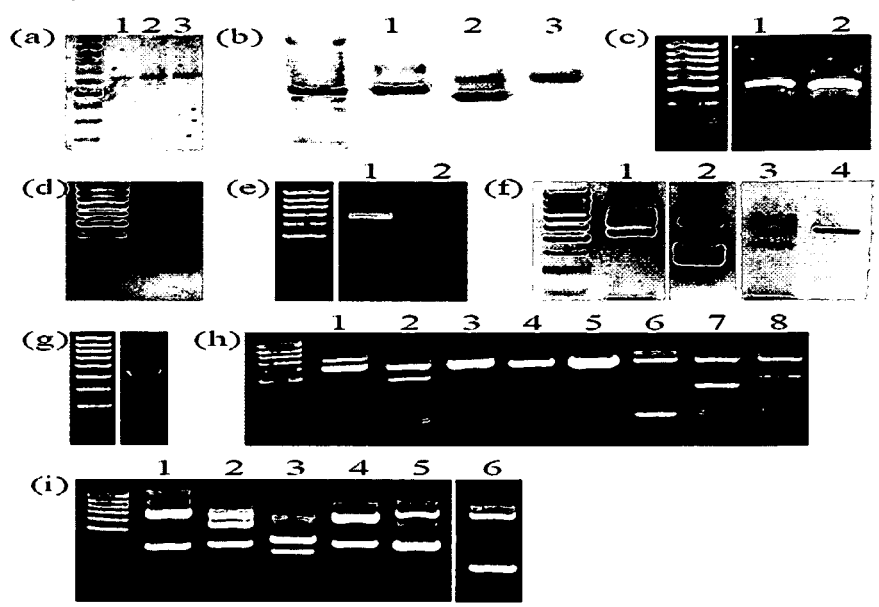
FIG. 13. Gene-specific primer sequences for 1st PCR reaction. Gene-specific reverse primers used in amplification of sequences in the first PCR reaction. Either the 1st PCR reaction or the subsequent 2nd nested PCR products were run and visualized on an agarose gel. Reverse primers used are IgKC_v4, IgLC_v5, IgHGC_v13 on lanes 1-3 respectively (a), K_GSP1, L_GSP1, G_GSP1 on lanes 1-3 respectively (b), K_GSP1c, L_GSP1c on lanes 1-2 respectively (c), G_GSP1 (d), L_GSP1d, G_GSP1g on lanes 1-2 respectively (e), G_GSP1h, G_GSP1k, L_GSP1f, L_GSP1g on lanes 1-4 respectively (f), G_GSP1d (g) L_GSP1h-o on lanes 1-8 respectively (h), G_GSP1 m-q and G_GSP1t on lanes 1-6 respectively (i). K, L and G in the primer names indicate that the primers are specific for the kappa, lambda and gamma immunoglobulin constant regions respectively. Each gel starts with a lane marker on the left followed by sample lanes. White bars between lanes on the same gel photo indicate where non-relevant lanes in-between have been cropped out.
Figure 43:
FIG. 43. Additional primers for human kappa, lambda and gamma constant regions. These primers were used for the $1^{st}$ PCR, and then the $2^{nd}$ PCR was performed using the primers from Table 1 and PCR products separated on a 2% agarose gel and the image was taken. Primers used for $1^{st}$ PCR are Kappa GSP1, kappa GSP1e, kappa GSP1f, lambda GSP1, lambda GSP1x and lambda GSP1y respectively. Sequences are in Table 10. White bars between lanes on the same gel photo indicate that non-relevant lanes in-between have been cropped out.

Gene-specific reverse primers were used in amplification of sequences in the first PCR reaction. Either the 1st PCR reaction or the subsequent 2nd nested PCR products were run and visualized on an agarose gel. Reverse primers used were IgKC_v4, IgLC_v5, IgHGC_v13 on lanes 1-3 respectively (a), K_GSP1, L_GSP1, G_GSP1 on lanes 1-3 respectively (b), K_GSP1c, L_GSP1c on lanes 1-2 respectively (c), G_GSP1 (d), L_GSP1d, G_GSP1 g on lanes 1-2 respectively (e), G_GSP1h, G_GSP1k, L_GSP1f, L_GSP1g on lanes 1-4 respectively (f), G_GSP1d (g) L_GSP1h-o on lanes 1-8 respectively (h), G_GSP1m-q and G_GSP1t on lanes 1-6 respectively (K, L and G in the primer names indicate that the primers are specific for the kappa, lambda and gamma immunoglobulin constant regions respectively). Each gel starts with a lane marker on the left followed by sample lanes. White bars between lanes on the same gel photo indicate where non-relevant lanes in-between have been cropped out. See Figure. 13. Also, more primers were tested in FIG. 43. These primers were used for the 1$^{st}$ PCR, and then the 2$^{nd}$ PCR was done using the primers from Table 1 and PCR products ran on a 2% agarose gel and image was taken. Primers used for 1$^{st}$ PCR are Kappa GSP1, kappa GSP1e, kappa GSP1f, lambda GSP1, lambda GSP1x and lambda GSP1y respectively. Also see Table 6 for sequences used.

Example 47: Testing of Gene-Specific Sequences for the 2nd PCR Reaction

Figure 14:
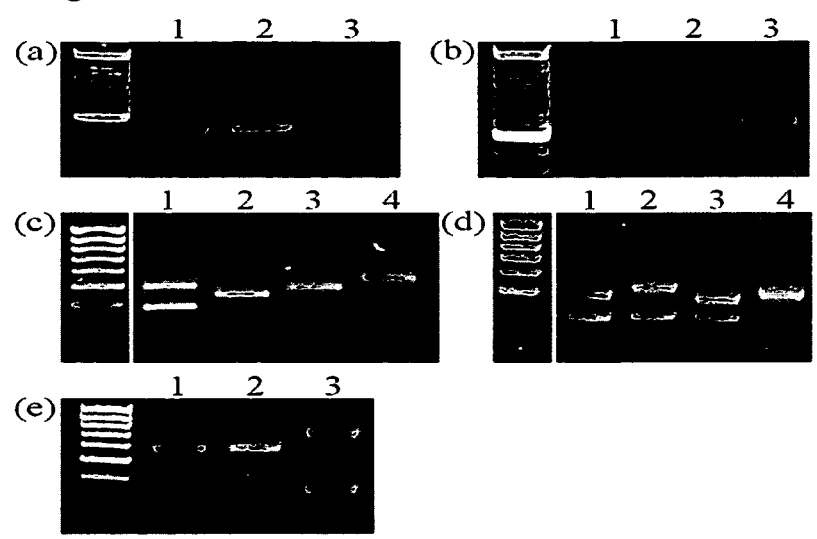
FIG. 14. Gene-specific sequences for the 2nd PCR reaction. Gene-specific reverse primers used in amplification of sequences in the 2nd PCR reaction. PCR products were run and visualized on an agarose gel. Reverse primers used are K_GSP2, L_GSP2, G_GSP2 in lanes 1-3 respectively (a), K_GSP2v2a, K_GSP2v2b, L_GSP2v2 in lanes 1-3 respectively (b), K_GSP2v2c, K_GSP2v2c, G_GSP2v2c1, G_GSP2v2c2 in lanes 1-4 respectively (c), K_GSP2v2d-f in lanes 1-3 respectively (d), K_GSP2v2g, L_GSP2v2d and G_GSP2b in lanes 1-3 respectively (e). K, L, G in the primer names indicates that they are specific for the kappa, lambda and gamma immunoglobulin constant regions respectively. Each gel starts with a lane marker on the left followed by sample lanes. White bars between lanes on the same gel photo indicate that non-relevant lanes in-between have been cropped out.

Gene-specific reverse primers were used in amplification of sequences in the 2nd PCR reaction. PCR products were run and visualized on an agarose gel. Reverse primers used were K_GSP2, L_GSP2, G_GSP2 in lanes 1-3 respectively (a), K_GSP2v2a, K_GSP2v2b, L_GSP2v2 in lanes 1-3 respectively (b), K_GSP2v2c, K_GSP2v2c, G_GSP2v2c1, G_GSP2v2c2 in lanes 1-4 respectively (c), K_GSP2v2d-f in lanes 1-3 respectively (d), K_GSP2v2g, L_GSP2v2d and G_GSP2b in lanes 1-3 respectively (e). K, L, G in the primer names indicates that they are specific for the kappa, lambda and gamma immunoglobulin constant regions respectively. Each gel starts with a lane marker on the left followed by sample lanes. White bars between lanes on the same gel photo indicate that non-relevant lanes in-between have been cropped out. See FIG. 14 and Table 6.

Figure 44:
FIG. 44. Additional primers for other human constant regions and genes. $1^{st}$ and $2^{nd}$ PCR were done and products ran on a 2% agarose gel and imaged. Lanes are from left: marker, mu, alpha constant regions, TCR alpha (a) and marker, TCR beta (b). Primers used and sequences are in Table 10. White bars between lanes on the same gel photo indicate that non-relevant lanes in-between have been cropped out.

Example 48: Testing of Gene-Specific Primers for Other Human Variable Region Genes 1$^{st}$ and 2$^{nd}$ PCR were done using gene-specific reverse primers and products ran on a 2% agarose gel and imaged. Lanes are from left: marker, mu, alpha constant regions, TCR alpha (a) and marker, TCR beta (b). sequences of 3' primers used are in table 10. White bars between lanes on the same gel photo indicate where non-relevant lanes in-between have been cropped out. See FIG. 44.

Example 49: Testing of Gene-Specific Primers for Mouse Variable Region Genes

Figure 45:
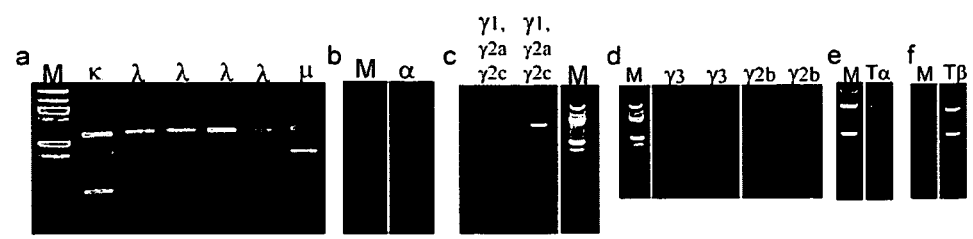
FIG. 45. Additional primers for mouse genes. $1^{st}$ and $2^{nd}$ PCR were done and products ran on a 2% agarose gel and imaged. Lanes are from left: marker, kappa, lambda, lambda, lambda, lambda light chains and mu heavy chain. The 4 lambda lanes had this combination of primers used: mouse_lambda_GSP1a with mouse_lambda_GSP2a, mouse_lambda_GSP1a with mouse_lambda_GSP2b, mouse_lambda_GSP1b with mouse_lambda GSP2a, and mouse_lambda_GSP1b with mouse_lambda GSP2a (a). Marker and alpha heavy chain (b). Gamma1, 2a, 2c heavy chains with $2^{nd}$ PCR using mo_g12_GSP2d and mo_g12_GSP2e respectively, marker (c). Marker, gamma 3 heavy chain with $2^{nd}$ PCR using mo_g3_GSP2d, mo_g3_GSP2e respectively followed by gamma 2b heavy chain with $2^{nd}$ PCR using mo_g2b_GSP2d, mo_g2b_GSP2e respectively (d). Marker, TCR alpha (e). Marker, TCR beta (f). White bars between lanes on the same gel photo indicate that non-relevant lanes in-between have been cropped out.

1$^{st}$ and 2$^{nd}$ PCR were done and products ran on a 2% agarose gel and imaged. Lanes are from left: marker, kappa, lambda, lambda, lambda, lambda light chains and mu heavy chain (a). The 4 lambda lanes had this combination of primers used: mouse_lambda_GSP1a with mouse_lambda GSP2a, mouse_lambda_GSP1a with mouse_lambda GSP2b, mouse_lambda_GSP1b with mouse_lambda GSP2a and mouse_lambda_GSP1b with mouse_lambda GSP2a. Marker and alpha heavy chain (b). Gamma1, 2a, 2c heavy chains with 2$^{nd}$ PCR using mo_g12_GSP2d and mo_g12_GSP2e respectively, marker (c). Gamma 3 heavy chain with 2$^{nd}$ PCR using mo_g3_GSP2d, mo_g3_GSP2e respectively followed by gamma 2b heavy chain with 2$^{nd}$ PCR using mo_g2b_GSP2d, mo_g2b_GSP2e respectively, followed by marker (d). Marker, TCR alpha (e). Marker, TCR beta(f). White bars between lanes on the same gel photo indicate where non-relevant lanes in-between have been cropped out. See FIG. 45 and Table 11.

Example 50: Generation of Linked Pairs of Antibody Heavy and Light Chains with a Barcode at One End As shown in FIG. 1, individual B cells can be sorted by flow cytometry from blood, bulk peripheral blood mononuclear cells (PBMCs), bulk B cells, plasmablasts, plasma cells, memory B cells, or other B cell populations. B cells are single-cell-sorted into 96-well PCR plates, leaving one column of wells empty, as a negative control. FIG. 17 describes the general methodology for a method that can be used to link two polynucleotide sequences of interest and add a barcode at one end.

Single step multiplex overlap-extension RT-PCR can be performed using a commercially available one-step RT-PCR kit (e.g., Qiagen one-step RT PCR kit) according to the manufacturer's recommendations. In this particular example, a polynucleotide synthesis reaction, such as a reverse transcription reaction, is used to generate cDNA templates from an mRNA sample. Referring to FIG. 17, the forward gene specific primer for the RT-PCR reaction contains a restriction enzyme site (RE1), a sequencing primer site, and a barcode, to add these elements to a first cDNA of interest. Two additional primers (shown as containing RE3) have complementary overlap-extension tails. Use of these primers in a PCR reaction results in the two cDNAs of interest carrying overlap extension tails, which allow the two cDNAs of interest to anneal and link during amplification. In the example shown, a product of the indicated structure would be generated in which the LC and HC chains are physically linked with a barcode at one end.

The RE1 and RE2 restriction sites can be used clone the PCR product into suitable vectors for sequencing.

Example 51: Generation of Linked Pairs of Antibody Heavy and Light Chains with an Internal Barcode As shown in FIG. 1, individual B cells can be sorted by flow cytometry from blood, bulk peripheral blood mononuclear cells (PBMCs), bulk B cells, plasmablasts, plasma cells, memory B cells, or other B cell populations. B cells are single-cell-sorted into 96-well PCR plates, leaving one column of wells empty, as a negative control. FIG. 18 describes the general methodology for a method that can be used to link two polynucleotides of interest with a barcode located in between. Primers and oligonucleotides which can be used for antibody heavy and light chains are shown in Table 30. Restriction sites AsiSI and PacI are included in the RT oligonucleotides. Sample-ID sequences are shown in Table 2.

The method shown in FIG. 18 relies on the 3' tailing and template switching activities of reverse transcriptase during a cDNA synthesis reaction. The 3' C tail added to the synthesized cDNA can be used for the annealing of an adaptor molecule carrying an overlap extension sequence and a barcode. Two types of adaptor molecules are used to link two cDNAs. A first adaptor carrying an overlap extension and barcode sequence is added to a first cDNA. A second adaptor carrying the reverse complement of the overlap extension without a barcode sequence is added to a second cDNA. The template switching property of reverse transcriptase adds these sequences to the 3' ends of their respective cDNAs.

In a PCR reaction, as shown in FIG. 18, the complementary overlap extension sequences anneal and corresponding strands of DNA are synthesized from the site of annealing. Subsequent rounds of PCR using external primers results in amplification of the linked cDNA molecules.

Through the addition of appropriate restriction sites and the addition of sequencing primer sites incorporated into primers for the amplification reaction or later by ligation, the PCR products can be cloned into suitable vectors for sequencing.

Example 52: Generation of Linked Pairs of Antibody Heavy and Light Chains with Two Internal Barcodes Using Universal Sequence Overlap-Extension Primers As shown in FIG. 1, individual B cells can be sorted by flow cytometry from blood, bulk peripheral blood mononuclear cells (PBMCs), bulk B cells, plasmablasts, plasma cells, memory B cells, or other B cell populations. B cells are single-cell-sorted into 96-well PCR plates, leaving one column of wells empty, as a negative control. FIG. 19 describes the general methodology for a method that can be used to introduce two internal barcodes in between two linked polynucleotides of interest. Primers and oligonucleotides which can be used for antibody heavy and light chains are shown in Table 31. Restriction sites AsiSI and PacI are included in the RT oligonucleotide. Sample-ID sequences are shown in Table 2.

The method shown in FIG. 19 relies on the 3' tailing and template switching activities of reverse transcriptase during a cDNA synthesis reaction. In this example, the 3' C tail added to oligo (dT) primed cDNA can be used for the annealing of an adaptor molecule carrying a universal sequence and a barcode to each of the cDNAs to be joined. The template switching property of reverse transcriptase adds these sequences to the 3' ends of their respective cDNAs. Subsequent overlap-extension PCR using primers to the universal sequence which carry complementary overlap-extension sequences in combination with external LC and HC specific primers results in a structure in which LC is linked to HC with two internal barcodes between them as shown in FIG. 19.

Through the addition of appropriate restriction sites and the addition of sequencing primer sites incorporated into primers for the amplification reaction or later by ligation, the PCR products can be cloned into suitable vectors for sequencing.

Example 53: Generation of Linked Pairs of Antibody Heavy and Light Chains with Two Internal Barcodes Using Overlap-Extension Adaptors As shown in FIG. 1, individual B cells can be sorted by flow cytometry from blood, bulk peripheral blood mononuclear cells (PBMCs), bulk B cells, plasmablasts, plasma cells, memory B cells, or other B cell populations. B cells are single-cell-sorted into 96-well PCR plates, leaving one column of wells empty, as a negative control. FIG. 20 describes the general methodology for another method that can be used to introduce two internal barcodes in between two linked polynucleotides of interest. Primers and oligonucleotides which can be used for antibody heavy and light chains are shown in Table 32. Restriction sites AsiSI and PacI are included in the RT oligonucleotides. Sample-ID sequences are shown in Table 2.

The method shown in FIG. 20 also relies on the 3' tailing and template switching activities of reverse transcriptase during a cDNA synthesis reaction. In this example, the 3' C tail added to cDNA synthesized using gene specific primers can be used for the annealing of adaptor molecules carrying self complementary or palindromic overlap-extension sequences and a barcode to each of the cDNAs to be joined. The template switching property of reverse transcriptase adds these sequences to the 3' ends of their respective cDNAs. Subsequent annealing of the overlap-extension sequences added to the LC and HC cDNAs links them together at the site of overlap. Overlap-extension PCR using external primers to LC and HC results in a structure in which LC is linked to HC with two internal barcodes between them as shown in FIG. 20.

Through the addition of appropriate restriction sites and the addition of sequencing primer sites incorporated into primers for the amplification reaction or later by ligation, the PCR products can be cloned into suitable vectors for sequencing.

Example 54: Studies on Different Methods of Adding Barcodes

We investigated a variety of methods through which barcode sequences could be added during the course of a reverse transcription or amplification reaction using an oligonucleotide comprising the barcode sequence. We tested the addition of barcodes by incorporating them into gene-specific primers (GSPs) and into oligonucleotides containing one or more Gs that can be added to the 3' end of cDNAs by template switching. Based on the literature and our scientific knowledge, our expectation was that we would be able to effectively barcode cDNA using either 5' barcoded oligonucleotides or 3' barcoded GSPs.

Figure 21:
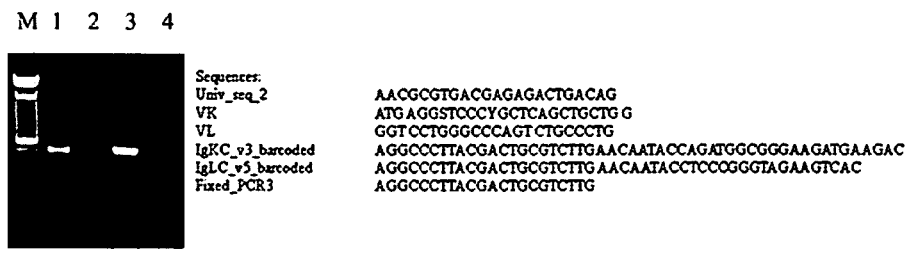

As demonstrated in FIG. 21, RT was performed with 1 μg of total PBMC RNA and 0.5 μM of univ_seq_2 template-switching oligo and 0.1 μM of IgKC_v3 GSP (lanes 1-2) and IgLC_v5 GSP (lanes 3-4) with an additional 5' flanking sequence, of which the first part is the Fixed_PCR3 sequence, and the last 8 bp AACAATAC is the barcode. The RT reaction was cleaned up using NucleoTraPCR (Macherey-Nagel) and dissolved in a final volume of 50 μl. 2 μl of this reaction was used in each subsequent PCR reaction, with either an internal 5' $V_K$ (lane 1) or $V_L$ (lane 3) primer or the Univ_seq_2 (lanes 2 and 4) as the 5' primer, and Fixed_PCR3 as the 3' primer. Note that the $V_K$ primer is specific for kappa V genes 1 and 2, and the $V_L$ primer is specific for lambda V gene 2. Sequences are in Table 33. As can be seen, the PCR products in lanes 2 and 4 ran as a smear. In contrast, the internal 5' primers produced distinct bands (lanes 1 and 3), showing that the primer pairs do work, and the smearing shown in lanes 1 and 3 cannot be attributed to poorly designed primers. As the oligonucleotide is added to all full-length reverse transcribed cDNA sequences, when a smear is obtained during PCR amplification with the univ_seq_2 and 3' barcoded GSPs, this suggests that reverse transcription with barcoded GSPs results in non-specifically primed nucleic acid sequences in the RT reaction. Our results suggest that use of 5' universal sequence adaptors and 3' barcoded primers is not a good strategy for the barcoding and specific amplification of immunoglobulin or other genes expressed by a B cell or other cell.

In hindsight, several biologic properties of DNA and the molecular reactions used likely contribute to our observations. Reverse transcription is usually performed at low temperatures such as 42° C. or 56° C. Unlike PCR, where the annealing step is usually performed at a temperature just slightly below the Tm of the primers to promote priming specificity, this cannot be done for reverse transcription, as reverse transcriptases are inactivated at high temperatures. Therefore, gene specific primers used during RT are typically not very specific for the gene of interest because the reaction proceeds at a temperature much lower than the Tm of the primer. In such a situation, the primer can also bind to off-target mRNA sequences with some mismatches, and mispriming occurs. If the barcode is added on the GSP, the primer also has to have a fixed sequence 5' of the barcode for use in subsequent PCR. This makes the primer very long (~60 nt), resulting in a primer with even a much higher degree of mispriming. However, specific amplification during PCR usually can still be achieved by using a highly gene-specific forward primer; as long as one member of the primer pair is specific, there usually can be specific amplification, as shown in lanes 1 and 3.

If a template switching technique is used to add an adaptor, this adaptor is added to all mRNAs that are synthesized to form first-strand cDNA. As mentioned above, the barcoded GSPs will have significant amounts of mispriming, especially as the RT enzyme Superscript III loses its template-switching activity at 56° C., and reverse transcription proceeds at 42° C. Specific nested 5' or 3' primers cannot be used as one would either lose the ability to PCR amplify all immunoglobulin genes (thus having to resort to multiplex PCR with multiple degenerate 5' primers due to variable V genes) or else lose the 3' barcode.

Therefore, barcoded GSPs are not suitable for use with template-switch added adaptors, or any other 5' adaptors, as other methods to add 5' adaptors such as TdT tailing or blunt end cloning also add adaptors non-discriminately. Therefore, internal 3' primers or a nested or semi-nested PCR amplification strategy is also required, and barcoded 3' GSPs do not allow for the use of these strategies for specific amplification of genes from a B cell or other cell. Based on our results, one would also anticipate that barcoded oligo(dT)s would also perform poorly for many of the same reasons we believe barcoded GSPs perform poorly. These reasons include but are not limited to an inability to use internal 3' primers or a nested or semi-nested PCR strategy for specific amplification of genes from a B cell or other cell.

In contrast, our results (see other examples) demonstrate the superiority of barcode sequence addition during the course of a reverse transcription reaction using a primer comprising the barcode sequence and an adaptor that anneals to the 3' tail of a cDNA generated during a reverse transcription reaction. In such an embodiment, the adaptor sequence can comprise a barcode sequence and be used to label genes encoding antibody heavy and light chains. Thus, as disclosed herein, template switching, or any other methods of tailing a cDNA adds a sequence that can be used for PCR amplification without prior knowledge of the 5' sequences themselves, enabling efficient and unbiased representation of the antibody repertoire. Furthermore, this approach allows one to obtain the repertoire of other co-expressed genes encoding proteins in addition to antibodies. Further, the approach of using template-switch adaptors has clear advantages over methods disclosed in the art that use sets of degenerate forward primers to amplify multiple V genes. These methods also fail to capture the entire antibody repertoire, because the known 5' primer sets: a) cover most but not the entire repertoire set; b) are not able to cover as yet known V genes variants (polymorphisms) in the human population; and c) may not be able to effectively amplify antibody sequences that have undergone extensive somatic hypermutation (SHM). See, e.g., Scheid et al., Sciencexpress, 14 Jul. 2011 for an example of the effect of SHM.

Accordingly, the use of template-switch adaptors for the preparation of libraries of expressed genes, e.g., antibody heavy and light chains, provides clear advantages over other methods known in the art by allowing for unbiased representation of particular gene families and other co-expressed genes. The use of template-switch adaptors or 5' adaptors added using any other methods such as but not limited to TdT tailing and blunt end ligation are also more compatible with the use of barcoded 5' adaptors rather than barcoded 3' GSPs or barcoded oligo(dT)s for the reasons discussed above.

Example 55: Sorting of Plasmablasts by Forward-Scatter and/or Side-Scatter on Flow Cytometer and/or in Conjunction with Other Cell Surface Markers Plasmablasts are blasting B cells that are activated, have proliferated/are proliferating and have undergone affinity maturation. Plasmablasts represent the active immune response and by practicing the methods and compositions herein allow for the bioinformatic construction of evolutionary trees with clonal families of antibodies that bind to target antigens of interest, whether it is an infection, a vaccine, autoimmune or cancer antigens.

Figure 40:
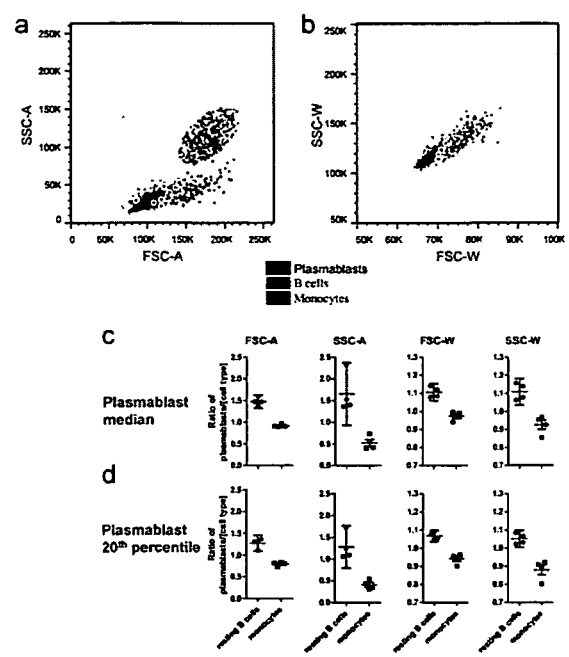
FIG. 40. Human blasting B cells (plasmablasts) are larger than resting B cells but smaller than monocytes on average. Singlet monocytes, B cells and plasmblasts were gated and compared for side- and forward-scatter parameters. Monocytes were defined by their characteristic FSC and SSC profile, and as $CD19^-CD3^-$. B cells were defined as $CD19^+CD20^+$. Plasmablasts were defined as $CD19^+CD20^-CD27^+CD38^{++}$. Cells shown on the FSC-A (forward scatter area) and SSC-A (side scatter area) axes (a). Cells shown on the FSC-W (forward scatter width) and SSC-W (side scatter width) axes (b). The median of the FSC-A, SSC-A, FSC-W, SSC-W of plasmablasts were divided by that of resting B cells or monocytes to obtain a ratio which represent the size relationship between the cell types (c). The median of the FSC-A, SSC-A, FSC-W, SSC-W of the $20^{th}$ percentile of plasmablasts were divided by that of the median of resting B cells or monocytes to obtain a ratio which represent the size relationship between the cell types wherein at least 80% of plasmablasts are larger than the ratio (d). Error bars indicate 95% confidence interval.

Plasmablasts are blasting B cells and are larger than resting B cells (FIG. 40A-B). Therefore, they can be sorted on a flow cytometer using their forward- and side-scatter properties. As shown in FIG. 40c, plasmablasts have a median FSC-A that is ~1.29-1.66× larger than the median FSC-A of other $CD20^+$ B cells, with a median FSC-W that is 1.04-1.16× larger than resting $CD20^+$ B cells. Plasmablasts also have a median FSC-A that is 0.85-0.98× that of monocytes, and a median FSC-W that is 0.92-1.02× that of monocytes as determined by the 95% confidence interval. Here FSC-A and FSC-H could be interchangeable and equivalent as FSC-A and FSC-H are scaled on calibrated flow cytometers to give the same values. Similarly for SSC-A (and SSC-H, due to scaling) and SSC-W, plasmablasts have a median SSC-A that is 0.74-2.56× that of $CD20^+$ B cells and 0.21-0.84× that of monocytes, and a median SSC-W that is 1.01-1.20× that of $CD20^+$ B cells and 0.82-1.03× that of monocytes. The ratio of plasmablasts to B cells is representative of that to lymphocytes, as resting lymphocytes are similar in size.

An alternative approach to identify plasmablasts is to use the 20th percentile FSC or SSC of plasmablasts to the median FSC or SSC of $CD20^+$ B cells or monocytes (FIG. 44D), which is 1.04-1.50× (1.02-1.11×) that of median FSC-A (FSC-W) for $CD20^+$ B cells and 0.70-0.88× (0.88-1.00×) for monocytes. Plasmablasts have a 20th percentile SSC-A (SSC-W) which is 0.67-1.89× (0.99-1.11×) that of median SSC-A (SSC-W) for $CD20^+$ B cells and 0.20-0.62× (0.77-0.99×) for monocytes. These numbers allows a gating cutoff to include 80% of plasmablasts and exclude other lymphocytes. This allows for using FSC (and/or SSC) in conjunction with single or dual color stains to gate for plasmablasts in single cell sorting plasmablasts. Such combinations may include $FSC^{hi}D19^{lo}$ (FIG. 39b), $CD19^+FSC^{hi}$ (FIG. 39c) CD19⁺FSC^hi CD20⁻ (FIG. 39d), CD19⁺ FSC^hi CD38^hi (FIG. 39e) and CD19⁺FSC^hi CD27⁺ (FIG. 39f). Sorted cells may then undergo RT, PCR for barcoding as carried out as in "non-touchdown" PCR in the materials and methods. Downstream preparation for sequencing, cloning and expression are as follows in examples 6 and 8. Note that ratios given are that of the 95% confidence interval, or where 95% of ratios should fall within this range.

Example 56: Sorting of Plasmablasts by Size on any Sieving Device, Such as a Microfluidics Device Plasmablasts are blasting B cells that are activated, have proliferated/are proliferating and have undergone affinity maturation. Plasmablasts represent the active immune response and by practicing the methods and compositions herein allow for the bioinformatic construction of evolutionary trees with clonal families of antibodies that bind to target antigens of interest, whether it is an infection, a vaccine, autoimmune or cancer antigens.

Figure 41:
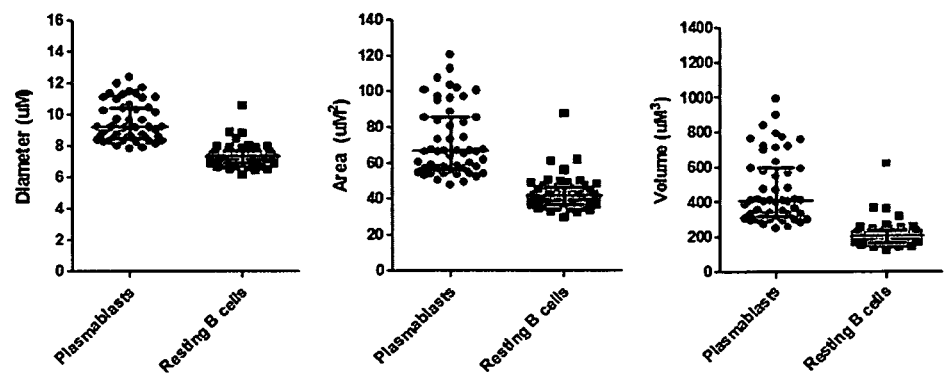
FIG. 41. Size of human plasmablasts compared to resting B cells by microscopy. Plasmablasts and resting B cells were sorted as $CD19^+CD20^-CD27^+CD38^{++}$ and $CD19^+CD20^+$ respectively. Cells were then imaged using an Olympus microscope at 200×. Cell area was measured using ImageJ and diameter determined using area=$\pi \times r^2$ where diameter=2×radius, and volume determined by $4/3 \times \pi r^3$. Error bars denote the inter-quartile range. A cut-off of ≥8 uM or ≥50 $uM^2$ or ≥268 $uM^3$ will include 96% of plasmablasts and exclude 92% of resting B cells.

Plasmablasts are blasting B cells and are larger than resting B cells. Plasmablasts and CD20⁺ B cells were FACS sorted and stained with trypan blue to exclude dead cells and imaged at 200× magnification. 52 plasmablasts and 51 CD20⁺ B cells were imaged and cell area measured with ImageJ. Plasmablasts imaged were between 7.8-13 uM in diameter, and between 48-121 uM² in area, and between in 251-996 uM³ in volume. CD20⁺ B cells are not blasting and are smaller, the majority is between 6-8 uM in diameter, or smaller than 50 uM², or smaller than 268 uM³, with only 4 cells of 51 larger than that (FIG. 41). Any sieving device that is capable of separating cells larger or smaller than 8 uM in diameter or 50 uM² in area or 268 uM³ in volume is capable of separating plasmablasts from CD20⁺ resting B cells, with 96% of the plasmablasts captured, and sieving out 92% of the resting B cells. Such a device may be a fine sieve with 8 uM diameter holes, or a microfluidics device with channels that only allows or prevents cells greater than 8 uM in diameter or 50 uM² in area or 268 uM³ in volume in passing through. These cells can then be sorted by actuators/pumps in the microfluidics device into wells such that there is only 1 or a few cell(s)/well and RT, PCR for barcoding may then be carried out as in "non-touchdown" PCR in the materials and methods using the same concentrations of reagents. Downstream preparation for sequencing, cloning and expression are as follows in examples 6 and 8.

Example 57: Anti-*Staphylococcus aureus* Antibodies Enhance Phagocytosis of *S. aureus* by a Neutrophil Cell Line Humans with *S. aureus* infections who mount effective immune responses against their *S. aureus* infection, for example humans who clear *S. aureus* without the need for antibiotic therapy, are used as sources for peripheral blood from which peripheral blood plasmablasts are stained and sorted. Plasmablasts are single-cell sorted and barcoded as detailed in "Non touchdown PCR" in the materials and methods, and prepared for sequencing as detailed in "Preparing for 454 XLR70 sequencing" in the materials and methods. Evolutionary trees are bioinformatically constructed and a few select representatives of each clonal family are selected and cloned for expression as recombinant antibodies as in example 8. *S. aureus* Wood strain, which is ~5% protein A positive, is plated on 5% trypticase soy agar (TCA) blood agar and a colony grown and kept at 4° C. as stock. This stock is refreshed weekly by picking another colony. 1 mL of this stock is used to inoculate *S. aureus* growth till OD550=0.5, which is approximately mid-log growth phase. *S. aureus* is lightly fixed in 4% paraformaldehyde (PFA) for 15 minutes at room temperature and washed once with Hanks balanced salt solution (FIBSS), before staining with 1 uM CFSE for 15 minutes at room temperature. Fixed bacteria are then washed and incubated with 10 ug/ml of the expressed recombinant anti-*S. aureus* antibodies, or 10 ug/ml of expressed anti-influenza virus antibodies as a negative control. Bacteria are then washed twice. HL-60, a neutrophil cell line, is activated for 96 hr with 25 uM retinoic acid, and incubated with labeled, fixed bacteria at 1:1 to 1:100 for 45 minutes at 37° C. gently shaking at 300 rpm in 96-well plates. HL-60 is then washed twice and analyzed on a flow cytometer. The amount of CFSE labeling in HL-60s is indicative of the amount of *S. aureus* phagocytosed. Some expressed anti-*S. aureus* antibodies will binding to staph cell surface proteins and opsonize the bacteria, leading to increased phagocytosis.

Example 58: Anti-*Staphylococcus aureus* Antibodies Enhance Neutrophil-Mediated Killing of *S. aureus*

Figure 46:
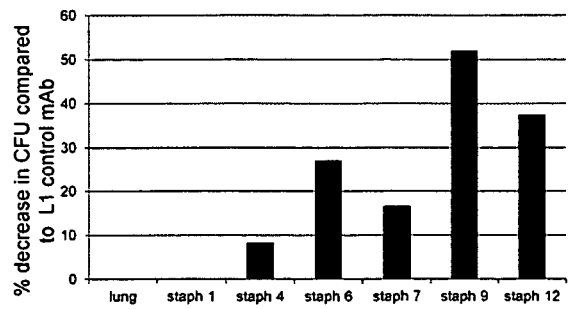
FIG. 46. Anti-*S. aureus* antibody-mediated killing of *S. aureus* by the HL-60 neutrophil cell line. Various recombinant anti-*S. aureus* antibodies (staph 1, staph 4, staph 6, staph 7, staph 9, staph 12) were incubated at 4° C. with *S. aureus* for 30 minutes, following which non-bound antibody was washed away, and the *S. aureus* incubated with activated HL-60 cells and baby rabbit complement for 45 minutes at 37° C. Cells were then washed twice and extracellular bacteria were serially plated on 5% TSA blood agar plates, incubated overnight, and colony forming units (CFUs) counted. Recombinant antibodies staph 6, stepha 9 and staph 12 induced greater than 20% killing of *S. aureus*.

Humans who were able to effectively control and/or clear their *S. aureus* infections were selected as in the relevant example above, and plasmablasts were isolated and single cell sorted for sequencing and cloning and expression as in the relevant example above. An *S. aureus* clinical isolate, was plated on 5% TCA blood agar and a colony grown and kept at 4° C. as stock. This stock was refreshed weekly by picking another colony. 1 mL of this stock was used to inoculate *S. aureus* growth till OD550=0.5, which is approximately mid-log growth phase. *S. aureus* was then incubated with 2 ug/ml of expressed anti-*S. aureus* antibodies for 30 minutes at 4° C. before washing twice. The HL-60 neutrophil cell was activated for 96 hr with 25 uM of retinoic acid, and incubated with baby rabbit complement and *S. aureus* in a 1:1 to 1:100 ratio for 45 minutes at 37° C. shaking at 300 rpm in 96-well plates. HL-60 cells were then rapidly put on ice and washed 3× to remove loosely attached *S. aureus*. Extracellular *S. aureus* was then serially diluted and plated on 5% TSA blood agar and cultured overnight at 37° C. Colonies were counted the next day to determine the number of colony forming units (CFU). A decrease in CFUs by specific anti-*S. aureus* recombinant antibodies (after incubation with *S. aureus*) demonstrate that those antibodies were effective in mediating enhanced phagocytosis and killing, or reducing growth, of *S. aureus* by HL-60 cells (FIG. 46).

Example 59: Treatment of *Staphylococcus aureus*-Infected Mice Using Expressed Anti-*S. aureus* Antibodies in Mouse Model Anti-*S. aureus* antibodies that demonstrate in vitro killing, reduced growth or binding activity as in example 58 may also have in vivo activity. Anti-*S. aureus* antibodies with killing activity are isolated from *S. aureus*-infected humans who are able to control their staph infection as in examples 55-58. Mice are given a lethal dose of *S. aureus* and are then treated with a control antibody or a recombinant anti-*S. aureus* antibody(ies) with demonstrated in vitro killing, reduced growth or binding activity. Mice are deemed to be protected if they have a longer survival or reduced severity of infection as determined by the Kaplan-Meier survival test. Anti-*S. aureus* antibodies derived from humans who control or reduce the severity of their *S. aureus* infections are thereby evaluated for their ability to confer passive protection against *S. aureus*.

Example 60: Use of the Antigen Targets of Effective Anti-*Staphylococcus aureus* Immune Responses to Develop Vaccines

*S. aureus* antigens that are targeted by anti-*S. aureus* antibodies that exhibit killing, reduced growth or binding activity are good candidates for a *S. aureus* vaccine. Vaccinees who develop a strong response against those specific antigens may be protected against or exhibit reduced severity of infection with *S. aureus*. Anti-*S. aureus* antibodies with killing, reduced growth or binding activity are isolated from *S. aureus*-infected humans who are able to control their *S. aureus* infection, and their target antigens identified using mass spectrometry as in examples 55-58. Mice are either vaccinated with a mock vector or vaccinated with candidate *S. aureus* antigens and then boosted twice over a period of a two months. Mice may be immunized with candidate *S. aureus* antigens individually or in combination. Anti-*S. aureus* antigen antibody titer is confirmed by ELISA. Mice are then challenged with a lethal dose of *S. aureus*. Mice are deemed to be protected against *S. aureus* if they have a longer survival as determined by the Kaplan-Meier survival test. Immunization against these selected *S. aureus* antigens therefore confers protection or reduces the severity of infection, showing that the compositions and methods herein can aid in vaccine design.

Example 61: Treatment of *Staphylococcus aureus*-Infected Humans Using Recombinant Anti-*S. aureus* Antibodies with In Vivo Killing, Reduced Growth or Binding Activity in Humans Antibodies derived from humans who control their *S. aureus* infection and exhibit in vitro and in vivo killing, reduced growth or binding activity as in examples 55-59 may be used to treat *S. aureus*-infected patients. Antibodies are obtained and tested for in vitro and in vivo killing activity as in examples 55-59. Good Manufacturing Practice (GMP) manufactured anti-*S. aureus* monoclonal antibodies may be given intravenously or subcutaneously to *S. aureus*-infected humans, especially patients infected with methicillin resistant *S. aureus* (MRSA) or other strains of drug-resistant-*S. aureus*, and compared to antibiotics along for efficacy. The anti-*S. aureus* antibodies are deemed to have therapeutic utility if patients are protected against invasive *S. aureus* infections, have less severe *S. aureus* infections, and/or recover more rapidly than patients given antibiotics alone or not given antibiotics. Recombinant anti-*S. aureus* antibodies can be given therapeutically to patients with active *S. aureus* infections to reduce the severity of infection and/or to enhance clearance of the infection as well as prophylactically to high-risk patient populations, such as patients on hemodialysis for renal failure, patients admitted to the hospital, or patients with a positive-screen for *S. aureus* or MRSA.

Example 62: Staphylococcal *Aureus* Vaccination Using Identified *S. aureus* Antigens to Confer Protective Immunity in Humans

*S. aureus* antigens that are targeted by anti-*S. aureus* antibodies that exhibit killing or binding activity in vivo, and when vaccinated against in a mouse model confer protection against *S. aureus* challenge, may be good candidates for a prophylactic vaccine in humans. Anti-*S. aureus* antibodies are derived from humans who control their *S. aureus* infections and are cloned, expressed and tested for in vivo killing, reduced growth or binding activity and as vaccine candidates in mice as in examples 55-58 and 59. Humans are then given the *S. aureus* vaccine containing *S. aureus* antigens that are the targets of anti-*S. aureus* antibodies with killing, reduced growth or binding activity, with a placebo being the control. The cohorts are tracked for their incidence or severity of *S. aureus* infections. The vaccine is deemed successful if it lowers the vaccinated cohort's incidence or severity of *S. aureus* infections compared to the placebo cohort.

Example 63: Monitoring of Immune Responses Induced by Candidate *Staphylococcus aureus* Vaccines as a Correlate of Protection After immunization of humans with a candidate *S. aureus* vaccine as in example 62, the vaccine response may be monitored by determining if robust clonal families against the target *S. aureus* antigens of interest is elicited. Blood is drawn between 7-14 days post-vaccination and plasmablasts are single cell sorted, barcoded and 454 sequenced as detailed in "non-touchdown PCR" and "preparing for 454 XLR70 sequencing" in the materials and methods. Evolutionary trees are drawn and 2-3 members of each clonal family are then cloned and expressed as in example 8 and tested for their binding to the staph antigens of interest in an ELISA. We expect that humans who have a strong vaccine-induced anti-*S. aureus* immune response will exhibit large clonal families against the *S. aureus* antigens targeted in effective human immune responses. Such an approach has the potential to provide a correlate of protection for a *S. aureus* vaccine and in doing so enable clinical trials and development to be streamlined. This antibody and/or TCR immune repertoire monitoring would enable rapid assessment of the likelihood that a candidate vaccine would provide efficacy.

Example 64: Treatment of Mice with Lung-Adenocarcinoma Using Recombinant Anti-Lung Adenocarcinoma Antibodies The anti-lung adenocarcinoma antibody that binds to a cell surface protein or other lung adenocarcinoma proteins may be useful as a carrier to target toxins to lung adenocarcinoma cells or to target other molecules expressed by lung adenocarcinoma cells. Anti-lung adenocarcinoma antibodies with cell surface binding activity or other lung adenocarcinoma antigens are isolated from a long-term non-progressor lung adenocarcinoma cancer patient(s) as in example 11. Nude mice are given a subcutaneous injection of H1650 lung adenocarcinoma cell line and the tumor allowed to grow for one week. Anti-lung adenocarcinoma antibody is then conjugated to a toxin, such as diphtheria toxin lacking the R-domain, which is the cell-binding domain and allows diphtheria toxin into the cell. Diphtheria toxin lacking R-domain therefore is lethal only to lung adenocarcinoma cells which the antibody binds to and delivers the diphtheria toxin payload. Control antibody conjugated to diphtheria toxin without R domain is used as the control. The lung-adenocarcinoma antibody is deemed to have successfully delivered its payload to kill adenocarcinoma cells if the tumor load decreases more than in the control. Alternatively, in certain cases the recombinant antibody itself may be able to mediate tumor cell killing or to prevent tumor cell growth (in the absence of a conjugated toxin).

Example 65: Treatment of Lung Adenocarcinoma Patients Using Expressed Anti-Lung Adenocarcinoma Antibody The anti-lung adenocarcinoma antibody that binds to cell surface antigen may be useful as a carrier to target toxins to lung adenocarcinoma cells. Anti-lung adenocarcinoma antibodies with cell surface binding activity are isolated from a long-term non-progressor lung adenocarcinoma cancer patient as in example 11. GMP monoclonal antibody or other anti-lung adenocarcinoma monoclonal antibodies may be given intravenously or subcutaneously to lung adenocarcinoma patients, especially to patients whose biopsied adenocarcinoma cells expressed high levels of the cell surface antigen targeted by the monoclonal antibody. The recombinant monoclonal antibody(ies) lung adenocarcinoma antigen (s), or other members of the clonal families from which they are derived, can be used to immunohistochemically stain a biopsy specimen of an individual patient's lung adenocarcinoma to gain information on tumor antigen expression levels, and this information can be used to determine whether an individual patient is likely to respond to therapy with this monoclonal antibody. Anti-lung adenocarcinoma antibodies can be conjugated to a toxin, such as diphtheria toxin lacking the R-domain, which is the cell-binding domain and allows diphtheria toxin into the cell. Diphtheria toxin lacking R-domain therefore is lethal only to lung adenocarcinoma cells which the antibody binds to and delivers the diphtheria toxin payload. Standard of care chemotherapy is used for treatment of the comparator group. The anti-adenocarcinoma antibodies are deemed to have delivered their payload and have therapeutic utility if patients survive longer or exhibit longer times prior to relapse or progression. Alternatively, in certain cases the recombinant antibody itself, against lung adenocarcinoma antigens, may be able to mediate tumor cell killing or prevent tumor cell growth (in the absence of a conjugated toxin).

Example 66: Lung Adenocarcinoma Therapeutic Vaccination Using Identified Antigens in Humans The cell surface antigens bound by the anti-lung adenocarcinoma antibodies may be used in a therapeutic vaccine to treat established, or to protect against development of, lung adenocarcinoma. Anti-lung adenocarcinoma antibodies with cell surface binding activity are isolated from a long-term non-progressor lung adenocarcinoma cancer patient(s) as in example 11, and the target antigen identified using immunoprecipitation or immunoblotting and mass spectrometry. Vaccinees are given either a vaccine containing the lung adenocarcinoma antigen(s) of interest or a control vaccine. Cohorts are then followed and their incidence or progression of lung adenocarcinoma tracked. The vaccine is deemed to be successful if humans vaccinated with the target antigen have prolonged survival or extended time to relapse compared to the standard-of-care comparator group.

Example 67: Immune Monitoring of Lung Adenocarcinoma Vaccination for Efficacy of Response After immunization of humans with lung adenocarcinoma vaccine as in example 66, the vaccine response may be monitored by determining if robust clonal families against adenocarcinoma antigen(s) of interest in the vaccine are elicited. Blood is drawn between 7-14 days post-vaccination and plasmablasts are single cell sorted and barcoded, and 454 sequencing is performed as detailed in "non-touchdown PCR" and "preparing for 454 XLR70 sequencing" in the materials and methods. Evolutionary trees are drawn and 2-3 members of each clonal family are then cloned and expressed as in example 8 and tested for their binding to the staph antigens of interest in an ELISA. We expect that humans who have a strong immune response will have large clonal families against lung adenocarcinoma antigen(s) of interest and/or many clonal families against the adenocarcinoma antigen(s) of interest. This immune monitoring allows us to rapidly predict the efficacy of a candidate vaccine.

Figure 42:
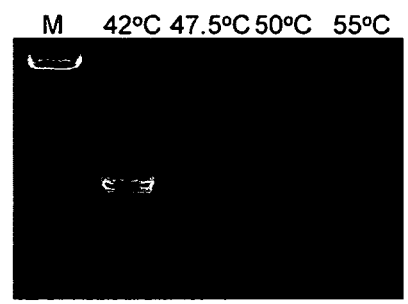
FIG. 42. Superscript III has template switching activity at temperatures at and below 50° C. Reverse transcription (RT) was performed for 90 minutes using the temperatures indicated above the lanes using an adaptor ending with rGrGrG, and 1 round of PCR was done using GAPDH as the 3' primer (sequence ATGGTTCACACCCATGACG (SEQ ID NO:796596)). As can be seen, no template switching activity to add on the adaptor could be seen at 55° C., and template switching activity increases from minimal at 50° C. to highest at 42° C., the lowest temperature tested, as indicated by the brightness of the band at ~450 bp. Marker is a 100 bp marker. Superscript III is an MMLV reverse transcriptase that has specific mutations that result in a loss of RNAse H activity, and also has mutations made to the polymerase domain to increase thermal stability and has a half-life of 220 minutes at an RT temperature of 50° C. Other MMLV H⁻ enzymes that have been engineered for higher thermal stability are expected to exhibit similar activity.

Example 68: Use of Superscript III for Template Switching During Reverse Transcription In our methods, the sample-identification region and adaptor regions are added on during reverse transcriptase. This utilizes the 3' tailing activity and template switching activity of RNase IF reverse transcriptases. Most frequently, a reverse transcriptase such as Superscript II (Invitrogen) is used at its working temperature of 42° C. MMLV IT reverse transcriptases that have also been engineered for thermal stability, such as Superscript III, with a recommended working temperature of 50° C., have been reported not to have this 3' tailing activity and therefore no template switching ability (http://tools.invitrogen.com/content/sfs/ProductNotes/F_Superscript %20III%20Enzyme %20RD-MKT-TL-HL0506021.pdf?ProductNoteId=36). However, in FIG. 42, we showed that Superscript III does have 3' tailing and template switching activity. This property is weak at 50° C., the recommended reverse transcription temperature for Superscript III, and may explain why the 3' tailing activity of Superscript III has not been reported before. However, 3' tailing activity and template switching increases significantly as the RT temperature was lowered from 50° C. to 45.5° C. to 42° C. We would expect all MMLV RNase H− reverse transcriptases that have been engineered for thermal stability to also have 3' tailing activity at lower working temperatures, i.e. between 42° C. to 50° C.

Example 69: Analysis of Co-Expressed Genes to Identify Antibodies Associated with Memory B Cell and Plasma Cell Responses as Well as Homing to Specific Tissues Barcoding of all the cDNA produced by B cells, T cells or other cells sorted into individual wells as described by the methods and compositions herein enables characterization of gene co-expression in plasmablasts, other B cells, T cells and other cells at the single cell level. This enables use of co-expressed genes to identify the specific antibodies and TCRs expressed by B and T cells that have been induced to differentiate into memory B cells, plasma cells, memory T cells, specific types of effector T cells (for example, Th1, Th2, Th17 or T-regulatory T cells) or induced to home to a specific tissue or site (for example, the gastrointestinal tract, skin, or brain). The barcoding of all cDNA produced by the individual cell or collection of cells in a specific sample enables use of additional 3' PCR primers for both $1^{st}$ and $2^{nd}$ PCR to characterize the co-expression of specific such genes. 5' primers remain the same as those used to amplify variable regions genes. Furthermore, analysis of co-expressed genes enables bioinformatic analysis of the relationships between the affinity maturation of clonal families and the co-expression of genes associated with the differentiation of B cells to memory B cells, short-lived plasmablasts, and long-lived plasma cells (Table 34), the differentiation of naïve or memory T cells to Tregs or Th1, Th2, Th17 cells (Table 35), or the homing of B or T cells to specific sites. Such analysis can further pinpoint the critical antibodies or TCRs mediating an effective immune response.

For example, PMBCs derived from individuals mounting immune response are used to single cell sort plasmablasts. The methods and compositions herein are used to analyze co-expression of genes associated with homing of plasmablasts into different tissues (see Table 36). Bioinformatic analysis of the datasets identifies antibodies associated with secretion at different bodily locations. These antibody genes are then recombinantly expressed for characterization in in vitro screening assays as in Example 8.

It will be understood by persons skilled in the relevant art that various changes in form and details can be made therein without departing from the spirit and scope of the various aspects of the invention.

It must be noted that, as used in the specification and the appended claims, the singular forms "a," "an" and "the" include plural referents unless the context clearly dictates otherwise.

All references, issued patents and patent applications cited within the body of the instant specification are hereby incorporated by reference in their entirety, for all purposes.

TABLES

TABLE 2

Sample-ID

| Well | SampleID | Sequence of Sample-ID | SEQ ID NO |
|---|---|---|---|
| A1 | 1 | ACGTCTCATCA | 796070 |
| A2 | 2 | ACTCATCTACA | 796071 |
| A3 | 3 | AGAGCGTCACA | 796072 |
| A4 | 4 | AGTAGTGATCA | 796073 |
| A5 | 5 | ATAGATAGACA | 796074 |
| A6 | 6 | ATCTACTGACA | 796075 |
| A7 | 7 | CACGTGTCGCA | 796076 |
| A8 | 8 | CATACTCTACA | 796077 |
| A9 | 9 | CGAGACGCGCA | 796078 |
| A10 | 10 | CGTCGATCTCA | 796079 |
| A11 | 11 | CTACGACTGCA | 796080 |
| B1 | 12 | TAGTGTAGATA | 796081 |
| B2 | 13 | TCTAGCGACTA | 796082 |

TABLE 1

Primers and adapter molecules

| seq id no | DESCRIPTION | sequence |
|---|---|---|
| 796583 | Sample-ID adaptor | CACGACCGGTGCTCGATTTAG(sample-ID)GGG |
| 796584 | FW long primer1 | GAGAGACTGACAGCGTATCGCCTCCCTCGCGCCATCAG(plate-ID)CACGACCGGTGCTCGATTTAG |
| 796061 | FW short primer1 | GAGAGACTGACAGCGTATCGCCTC |
| 796062 | kappa GSP1 | CGATTGGAGGGCGTTATCCAC |
| 796063 | lambda GSP1 | TYTGTGGGACTTCCACTGCTC |
| 796064 | gamma GSP1 | TCTTGTCCACCTTGGTGTTGCTG |
| 796065 | FW primer2 | CGTATCGCCTCCCTCGCG |
| 796585 | kappa GSP long primer2 | CTATGCGCCTTGCCAGCCCGCTCAG(plate-ID)TCAGATGGCGGGAAGATGAAGAC |
| 796586 | lambda GSP long primer2 | CTATGCGCCTTGCCAGCCCGCTCAG(plate-ID)GAGGAGGGYGGGAACAGAGTGAC |
| 796587 | gamma GSP long primer2 | CTATGCGCCTTGCCAGCCCGCTCAG(plate-ID)GGAAGTAGTCCTTGACCAGGCAG |
| 796066 | kappa GSP 2s | CTATGCGCCTTGCCAGCCCGCTCAGTCAGATGGCGGGAAGATGAAGAC |
| 796067 | lambda GSP 2s | CTATGCGCCTTGCCAGCCCGCTCAGGAGGAGGGYGGGAACAGAGTGAC |
| 796068 | gamma GSP 2s | CTATGCGCCTTGCCAGCCCGCTCAGGGAAGTAGTCCTTGACCAGGCAG |
| 796069 | RV primer2 | CTATGCGCCTTGCCAGCCC |

*For sample-ID sequences, see Table 2. For plate-ID sequences, see Table 3. Kappa GSP 2s, lambda GSP 2s and gamma GSP 2s are identical to the kappa, lambda and gamma GSP long primer 2 except that they do not have a plate-ID sequence. The plate-ID sequence is not necessary when doing XL+ runs, or when only forwards reads are desired when doing XLR70 runs with the Titanium LibA chemistry.
**primers sequences were designed to be able to amplify all different constant gene variants as found in IMGT database (http://imgt.cines.fr/).

TABLE 2 -continued

| Well | SampleID | Sequence of Sample-ID | SEQ ID NO |
|---|---|---|---|
| B3 | 14 | TGTGAGTAGTA | 796083 |
| B4 | 15 | ACAGTATATAA | 796084 |
| B5 | 16 | AGCTCACGTAA | 796085 |
| B6 | 17 | TCGATAGTGAA | 796086 |
| B7 | 18 | TCGCTGCGTAA | 796087 |
| B8 | 19 | TGAGTCAGTAA | 796088 |
| B9 | 20 | TGTAGTGTGAA | 796089 |
| B10 | 21 | TGTCGTCGCAA | 796090 |
| B11 | 22 | ACGACAGCTCA | 796091 |
| C1 | 23 | TACACGTGATTAGGGATT | 796092 |
| C2 | 24 | TACAGATCGTTAGGGAAA | 796093 |
| C3 | 25 | TAGTGTAGATTTGGGTTT | 796094 |
| C4 | 26 | TCTAGCGACTTTGGGTTT | 796095 |
| C5 | 27 | ACGCGATCGAAGGGTTT | 796096 |
| C6 | 28 | AGCTCACGTATTGGGTTT | 796097 |
| C7 | 29 | AGTGCTACGAAGGGAAA | 796098 |
| C8 | 30 | TCTGACGTCAAAGGGAAA | 796099 |
| C9 | 31 | ACGTCTCATCAAGGAAGGAA | 796100 |
| C10 | 32 | TATAGACATCAACACACAAA | 796101 |
| C11 | 33 | AGTGAGCTCGTTGGGTTT | 796102 |
| D1 | 34 | ATCGTCTGTGTTGGGTTT | 796103 |
| D2 | 35 | CACACGATAGTTGGGTTT | 796104 |
| D3 | 36 | CTGCGTCACGATCTCTCTT | 796105 |
| D4 | 37 | TAGCATACTGTTGGGTTT | 796106 |
| D5 | 38 | TATCTGATAGTTGGGTTT | 796107 |
| D6 | 39 | TGACATCTCGCAGTTCTTT | 796108 |
| D7 | 40 | TGATAGAGCGTAACAACAGA | 796109 |
| D8 | 41 | TCACGCGAGAAAGGGAAA | 796110 |
| D9 | 42 | ACACATACGCAGGGAAA | 796111 |
| D10 | 43 | ACTAGCAGTAA | 796112 |
| D11 | 44 | CGCAGTACGAA | 796113 |
| E1 | 45 | TGAGTCAGTAAGGGAAA | 796114 |
| E2 | 46 | ACTCATCTACAGGGAAA | 796115 |
| E3 | 47 | ACTCGCGCACAGAGAAA | 796116 |
| E4 | 48 | AGAGCGTCACAGAGAA | 796117 |
| E5 | 49 | AGCGACTAGCAACACACAAA | 796118 |
| E6 | 50 | ATCTACTGACAACACACAA | 796119 |
| E7 | 51 | CATACTCTACAACACACAAA | 796120 |
| E8 | 52 | TCGAGCTCTCAGAGAGAAA | 796121 |
| E9 | 53 | AGAGAGTGTGTTGGGTTT | 796122 |
| E10 | 54 | ATCGTAGCAGAACACACAAA | 796123 |
| E11 | 55 | CACTCGCACGTTGGGTTT | 796124 |
| F1 | 56 | CAGACGTCTGAACACACAAA | 796125 |
| F2 | 57 | CTCGATATAGTTGGGTTT | 796126 |
| F3 | 58 | TCTGATCGAGAAGGGAAA | 796127 |
| F4 | 59 | TACACACACTTAGGGATT | 796128 |
| F5 | 60 | TACGTCATCAGGGAAA | 796129 |
| F6 | 61 | CTACGCTCTAAGGGAAA | 796130 |
| F7 | 62 | TAGTCGCATAAAGGGAAA | 796131 |
| F8 | 63 | CGATCGTATAA | 796132 |
| F9 | 64 | CGCGTATACAA | 796133 |
| F10 | 65 | CTACGCTCTAA | 796134 |
| F11 | 66 | TCACGCGAGAA | 796135 |
| G1 | 67 | AGTATACATATTGGGTTT | 796136 |
| G2 | 68 | TCGATAGTGAAGGGAAA | 796137 |
| G3 | 69 | TCGCTGCGTAAAGGAGAAA | 796138 |
| G4 | 70 | TGTAGTGTGAAGGGAAA | 796139 |
| G5 | 71 | TGTCGTCGCAAGAGAGAG | 796140 |
| G6 | 72 | CTACGACTGCAAGGGAAA | 796141 |
| G7 | 73 | CTCTACGCTCA | 796142 |
| G8 | 74 | TAGCTCTATCA | 796143 |
| G9 | 75 | TATAGACATCA | 796144 |
| G10 | 76 | TCACTCATACA | 796145 |
| G11 | 77 | CTAGTCACTCAAGGGAAA | 796146 |
| H1 | 78 | TGTGAGTAGTTTGGGTTT | 796147 |
| H2 | 79 | TGTCACACGAAGGGAAA | 796148 |
| H3 | 80 | CTGTGCGTCGAAGGGAAA | 796149 |
| H4 | 81 | TAGTGTAGATTCGC | 796150 |
| H5 | 82 | TCGAGCTCTCTCGC | 796151 |
| H6 | 83 | ATCACGTGCGTCGC | 796152 |
| H7 | 84 | CAGACGTCTGTCGC | 796153 |
| H8 | 85 | TATCACTCAGTCGC | 796154 |
| H9 | 86 | TGCTATAGACTTGGGTTT | 796155 |
| H10 | 87 | CAGTACTGCGTTGGGTTT | 796156 |

TABLE 2 -continued

Sample-ID

| Well | SampleID | Sequence of Sample-ID | SEQ ID NO |
|---|---|---|---|
| H11 | 88 | CGACAGCGAGAACACACAAA | 796157 |
| A12-H12 | 89 | TATGCTAGTAA (negative control) | 796158 |

TABLE 3

Plate-ID

| Plate | Sequence of Plate-ID | SEQ ID NO |
|---|---|---|
| 1 | ACGAGTGCGT | 796159 |
| 2 | ACGCTCGACA | 796160 |
| 3 | AGACGCACTC | 796161 |
| 4 | AGCACTGTAG | 796162 |
| 5 | ATCAGACACG | 796163 |
| 6 | ATATCGCGAG | 796164 |
| 7 | CGTGTCTCTA | 796165 |
| 8 | CTCGCGTGTC | 796166 |
| 9 | TGATACGTCT | 796167 |
| 10 | CATAGTAGTG | 796168 |
| 11 | CGAGAGATAC | 796169 |
| 12 | ATACGACGTA | 796170 |
| 13 | TCACGTACTA | 796171 |
| 14 | CGTCTAGTAC | 796172 |
| 15 | TCTACGTAGC | 796173 |
| 16 | TGTACTACTC | 796174 |
| 17 | CGTAGACTAG | 796175 |
| 18 | TACGAGTATG | 796176 |
| 19 | TACTCTCGTG | 796177 |
| 20 | TAGAGACGAG | 796178 |
| 21 | TCGTCGCTCG | 796179 |
| 22 | ACATACGCGT | 796180 |
| 23 | ACGCGAGTAT | 796181 |
| 24 | ACTACTATGT | 796182 |
| 25 | ACTGTACAGT | 796183 |
| 26 | AGACTATACT | 796184 |
| 27 | AGCGTCGTCT | 796185 |
| 28 | AGTACGCTAT | 796186 |
| 29 | ATAGAGTACT | 796187 |
| 30 | CACGCTACGT | 796188 |
| 31 | CAGTAGACGT | 796189 |

TABLE 3 -continued

Plate-ID

| Plate | Sequence of Plate-ID | SEQ ID NO |
|---|---|---|
| 32 | CGACGTGACT | 796190 |
| 33 | TACACACACT | 796191 |
| 34 | TACACGTGAT | 796192 |
| 35 | TACAGATCGT | 796193 |
| 36 | TACGCTGTCT | 796194 |
| 37 | TAGTGTAGAT | 796195 |
| 38 | TCGATCACGT | 796196 |
| 39 | TCGCACTAGT | 796197 |
| 40 | TCTAGCGACT | 796198 |
| 41 | TCTATACTAT | 796199 |
| 42 | TGACGTATGT | 796200 |
| 43 | TGTGAGTAGT | 796201 |
| 44 | ACAGTATATA | 796202 |
| 45 | ACGCGATCGA | 796203 |
| 46 | ACTAGCAGTA | 796204 |
| 47 | AGCTCACGTA | 796205 |
| 48 | AGTATACATA | 796206 |
| 49 | AGTCGAGAGA | 796207 |
| 50 | AGTGCTACGA | 796208 |
| 51 | CGATCGTATA | 796209 |
| 52 | CGCAGTACGA | 796210 |
| 53 | CGCGTATACA | 796211 |
| 54 | CGTACAGTCA | 796212 |
| 55 | CGTACTCAGA | 796213 |
| 56 | CTACGCTCTA | 796214 |
| 57 | CTATAGCGTA | 796215 |
| 58 | TACGTCATCA | 796216 |
| 59 | TAGTCGCATA | 796217 |
| 60 | TATATATACA | 796218 |

TABLE 4

Cloning primers

| seq id no DESCRIPTION | sequence |
|---|---|
| Clon_PacI | ACTGTTAATTAA(sample-ID) (SEQ ID NO: 796588) |
| Clon_AscI | ATTAGGCGCGCC(sample-ID) (SEQ ID NO: 796589) |
| Clon_FseI | ATTAGGCCGGCC(sample-ID) (SEQ ID NO: 796590) |
| Clon_AsiSI | ATTAGCGATCGC(sample-ID) (SEQ ID NO: 796591) |
| K_NheIa_DHFR | ACGTGCTAGCAGTTCCAGATTTCAACTGCTCATCAGA (SEQ ID NO: 796374) |
| K_XhoId_DHFR | ACGTCTCGAGGATAGAAGTTATTCAGCAGGCACACAACA (SEQ ID NO: 796375) |
| L_XhoI_PspXI_DHFR | ACTTGCTCGAGTCTGCYTTCCARGCMACTGT (SEQ ID NO: 796376) |
| L_NheI_DHFR | AGTCGCTAGCCGCRTACTTGTTGTTGCTYTGTTTG (SEQ ID NO: 796377) |
| G_EcoRI_DHFR | AGTCGAATTCCACGACACCGTCACCGGTT (SEQ ID NO: 796378) |
| G_SacII_DHFR | ATTACCGCGGGGAAGGTGTGCACGCCG (SEQ ID NO: 796379) |
| G_XhoI_PspXI_Lonza | ACGTCTCGAGGGTGCCAGGGGAAGACCGATG (SEQ ID NO: 796380) |
| G_AgeI_Lonza | ACTGACCGGTTCGGGGAAGTAGTCCTTGACCAGGCA (SEQ ID NO: 796381) |
| G_EcoRI_Lonza | TGCAGAATTCCACGACACCGTCACCG (SEQ ID NO: 796382) |
| G_ApaI_Lonza | TGTAGGGCCCTGAGTTCCACGACACCGTC (SEQ ID NO: 796383) |
| L_XmaI_Lonza | TGATCCCGGGATAGAAGTCACTKATSAGRCACACYAGTGTGG (SEQ ID NO: 796384) |
| L_BstEII_Lonza | TGCAGGTCACCGCTCCCGGGTAGAAGTCACTKATSAGR (SEQ ID NO: 796385) |
| L_XhoI_PspXI_v2_Lonza | TGATGCTCGAGTCTGCYTTCCARGCMACTGTC (SEQ ID NO: 796386) |
| K_XmaI_Lonza | TAGTCCCGGGGATAGAAGTTATTCAGCAGGCACAC (SEQ ID NO: 796387) |

*Cloning forward primers start with a 5' flanking restriction site and end with sample-ID sequences on the 3' end. This enables cloning primers to discriminate between sequences with different well origins and selectively amplify amplicons with specific sample-ID sequences. Therefore, there are multiple cloning forward primers, each specific for particular sample-ID(s). The 3' sequences of the cloning forward primer are complementary to the well-ID and are provided in Table 5. Primers with names starting with "Clon" are the forward primers. Primers with names starting with "K", "L" or "G" are the reverse primers that are constant region specific for kappa, lambda and gamma chains respectively. The name of the reverse primers also denote the restriction site that the primer will incorporate. Finally, "DHFR" or "Lonza" denotes whether the constant region primers are for the vector set pcDNA3.3 and pOptivec or Lonza vectors pEE12.4 and pEE6.4 respectively, with constant region inserts added in.

TABLE 5

Cloning Primers Well-Specific Sequence

| Well | Sequence | SEQ ID NO |
|---|---|---|
| A1 | GGTGCTCGATTTAGACGTCTCATCAG | 796219 |
| A2 | CGGTGCTCGATTTAGACTCATCTACAG | 796220 |
| A3 | GTGCTCGATTTAGAGAGCGTCACAG | 796221 |
| A4 | CGGTGCTCGATTTAGAGTAGTGATCA | 796222 |
| A5 | ACCGGTGCTCGATTTAGATAGATAGACA | 796223 |
| A6 | CGGTGCTCGATTTAGATCTACTGACAG | 796224 |

TABLE 5 -continued

Cloning Primers Well-Specific Sequence

| Well | Sequence | SEQ ID NO |
|---|---|---|
| A7 | CTCGATTTAGCACGTGTCGCA | 796225 |
| A8 | CGGTGCTCGATTTAGCATACTCTACA | 796226 |
| A9 | CGATTTAGCGAGACGCGCA | 796227 |
| A10 | TGCTCGATTTAGCGTCGATCTCA | 796228 |
| A11 | GTGCTCGATTTAGCTACGACTGCA | 796229 |
| B1 | GACCGGTGCTCGATTTAGTAGTGTAGATAG | 796230 |
| B2 | CGGTGCTCGATTTAGTCTAGCGACTAG | 796231 |
| B3 | ACCGGTGCTCGATTTAGTGTGAGTAGTAG | 796232 |
| B4 | CGACCGGTGCTCGATTTAGACAGTATATAA | 796233 |
| B5 | GGTGCTCGATTTAGAGCTCACGTAAG | 796234 |
| B6 | CGGTGCTCGATTTAGTCGATAGTGAA | 796235 |
| B7 | TGCTCGATTTAGTCGCTGCGTAAG | 796236 |
| B8 | CGGTGCTCGATTTAGTGAGTCAGTAA | 796237 |
| B9 | CGGTGCTCGATTTAGTGTAGTGTGAA | 796238 |
| B10 | GCTCGATTTAGTGTCGTCGCAA | 796239 |
| B11 | GTGCTCGATTTAGACGACAGCTCA | 796240 |
| C1 | CGGTGCTCGATTTAGTACACGTGATT | 796241 |
| C2 | CGGTGCTCGATTTAGTACAGATCGTT | 796242 |
| C3 | GACCGGTGCTCGATTTAGTAGTGTAGATTT | 796243 |
| C4 | CGGTGCTCGATTTAGTCTAGCGACTTT | 796244 |
| C5 | GCTCGATTTAGACGCGATCGAA | 796245 |
| C6 | GGTGCTCGATTTAGAGCTCACGTATT | 796246 |
| C7 | GGTGCTCGATTTAGAGTGCTACGAA | 796247 |
| C8 | GGTGCTCGATTTAGTCTGACGTCAA | 796248 |
| C9 | GGTGCTCGATTTAGACGTCTCATCAA | 796249 |
| C10 | ACCGGTGCTCGATTTAGTATAGACATCAA | 796250 |
| C11 | GGTGCTCGATTTAGAGTGAGCTCGT | 796251 |
| D1 | GGTGCTCGATTTAGATCGTCTGTGT | 796252 |
| D2 | GGTGCTCGATTTAGCACACGATAGT | 796253 |
| D3 | GCTCGATTTAGCTGCGTCACGA | 796254 |
| D4 | CCGGTGCTCGATTTAGTAGCATACTGT | 796255 |
| D5 | GACCGGTGCTCGATTTAGTATCTGATAGT | 796256 |
| D6 | GTGCTCGATTTAGTGACATCTCGC | 796257 |
| D7 | CGGTGCTCGATTTAGTGATAGAGCGT | 796258 |
| D8 | GCTCGATTTAGTCACGCGAGAAA | 796259 |
| D9 | GGTGCTCGATTTAGACACATACGCA | 796260 |
| D10 | CCGGTGCTCGATTTAGACTAGCAGTAA | 796261 |
| D11 | TGCTCGATTTAGCGCAGTACGAA | 796262 |
| E1 | CGGTGCTCGATTTAGTGAGTCAGTAA | 796263 |
| E2 | CGGTGCTCGATTTAGACTCATCTACAG | 796264 |
| E3 | GCTCGATTTAGACTCGCGCACA | 796265 |
| E4 | GTGCTCGATTTAGAGAGCGTCACAG | 796266 |
| E5 | GGTGCTCGATTTAGAGCGACTAGCA | 796267 |
| E6 | CGGTGCTCGATTTAGATCTACTGACAA | 796268 |
| E7 | CGGTGCTCGATTTAGCATACTCTACA | 796269 |
| E8 | GTGCTCGATTTAGTCGAGCTCTCAG | 796270 |
| E9 | CGGTGCTCGATTTAGAGAGAGTGTGT | 796271 |
| E10 | GGTGCTCGATTTAGATCGTAGCAGA | 796272 |
| E11 | GCTCGATTTAGCACTCGCACGT | 796273 |
| F1 | TGCTCGATTTAGCAGACGTCTGAA | 796274 |
| F2 | CGGTGCTCGATTTAGCTCGATATAGT | 796275 |
| F3 | GGTGCTCGATTTAGTCTGATCGAGA | 796276 |
| F4 | CGGTGCTCGATTTAGTACACACACTT | 796277 |
| F5 | CGGTGCTCGATTTAGTACGTCATCA | 796278 |
| F6 | CGGTGCTCGATTTAGCTACGCTCTAA | 796279 |
| F7 | CGGTGCTCGATTTAGTAGTCGCATAA | 796280 |
| F8 | GGTGCTCGATTTAGCGATCGTATAA | 796281 |
| F9 | GGTGCTCGATTTAGCGCGTATACAA | 796282 |
| F10 | CGGTGCTCGATTTAGCTACGCTCTAA | 796283 |
| F11 | GCTCGATTTAGTCACGCGAGAAG | 796284 |
| G1 | ACGACCGGTGCTCGATTTAGAGTATACATAT | 796285 |
| G2 | CGGTGCTCGATTTAGTCGATAGTGAA | 796286 |
| G3 | GCTCGATTTAGTCGCTGCGTAAA | 796287 |
| G4 | CGGTGCTCGATTTAGTGTAGTGTGAA | 796288 |
| G5 | GCTCGATTTAGTGTCGTCGCAA | 796289 |
| G6 | GTGCTCGATTTAGCTACGACTGCA | 796290 |
| G7 | GGTGCTCGATTTAGCTCTACGCTCA | 796291 |
| G8 | CCGGTGCTCGATTTAGTAGCTCTATCA | 796292 |
| G9 | ACCGGTGCTCGATTTAGTATAGACATCAG | 796293 |
| G10 | CGGTGCTCGATTTAGTCACTCATACA | 796294 |
| G11 | CGGTGCTCGATTTAGCTAGTCACTCA | 796295 |
| H1 | CGGTGCTCGATTTAGTGTGAGTAGTTT | 796296 |
| H2 | GGTGCTCGATTTAGTGTCACACGAA | 796297 |
| H3 | GCTCGATTTAGCTGTGCGTCGA | 796298 |
| H4 | GACCGGTGCTCGATTTAGTAGTGTAGATTC | 796299 |
| H5 | GGTGCTCGATTTAGTCGAGCTCTCTC | 796300 |

TABLE 5 -continued

Cloning Primers Well-Specific Sequence

| Well | Sequence | SEQ ID NO |
|---|---|---|
| H6 | TGCTCGATTTAGATCACGTGCGT | 796301 |
| H7 | GTGCTCGATTTAGCAGACGTCTGTC | 796302 |
| H8 | CCGGTGCTCGATTTAGTATCACTCAGT | 796303 |
| H9 | ACCGGTGCTCGATTTAGTGCTATAGACT | 796304 |
| H10 | GGTGCTCGATTTAGCAGTACTGCGT | 796305 |
| H11 | GCTCGATTTAGCGACAGCGAGA | 796306 |

TABLE 6

| SEQ ID NO | DESCRIPTION | SEQUENCE |
|---|---|---|
| | For kappa | |
| 796307 | IgKC_v3 | CAGATGGCGGGAAGATGAAGAC |
| | For Lambda | |
| 796308 | IgLC_v5 | CTCCCGGGTAGAAGTCAC |
| 796309 | IgLC_v6 | TCCCGGGTAGAAGTCAC |
| 796310 | IgLC_v7 | GCTCCCGGGTAGAAGTC |
| 796311 | IgLC_v8 | AGTGTGGCCTTGTTGG |
| | For gamma | |
| 796312 | IgHGC_v10 | GCCAGGGGAAGACCGATG |
| 796313 | IgHGC_v11 | CAGGGGGAAGACCGATG |
| 796314 | IgHGC_v13 | AAGTAGTCCTTGACCAGGC |
| 796315 | IgHGC_v15 | GAAGACCGATGGGCCCTTGG |
| 796316 | IgHGC_v16 | AAGACCGATGGGCCCTTG |
| 796317 | Adaptor_v1 | G |
| 796318 | Adaptor_v2 | GGGGG |
| | Adaptor_v3 | rGrGrG |
| 796319 | Univ_seq_2 | AACGCGTGACGAGAGACTGACAG |
| 796320 | Univ_seq_4 | TTGTTGCGTTCCTAGCCGCTATAG |
| 796321 | Univ_seq_5 | CTCTACGACCGGTGCTCGATTTAG |
| 796322 | Univ_seq_e | CCGTCGGTCGGCAGTG |
| | Kappa light chain specific | |
| 796323 | IgKC_v4 | ATGGCGGGAAGATGAAGAC |
| 796324 | K_GSP1 | GTGCTGTCCTTGCTGTCCTGCT |
| 796325 | K_GSP1c | AGCAGGCACACAACAGAG |
| 796326 | K_GSP1e | TTGTGTTTCTCGTAGTCTGCTTTGC |
| 796327 | K_GSP1f | TCTCCCCTGTTGAAGCTCTTTGTG |
| 796328 | IgLC_v5 | CTCCCGGGTAGAAGTCAC |
| 796329 | L_GSP1 | ATCTGCCTTCCAGGCCACTGTC |
| 796330 | L_GSP1c | CTCCCGGGTAGAAGTCAC |
| 796331 | L_GSP1d | ACRGCTCCCGGGTAGAAGTCAC |
| 796332 | L_GSP1f | TCCACGGTGCTCCCTTCAT |
| 796333 | L_GSP1g | GGCCGCRTACTTGTTGTTGC |
| 796334 | L_GSP1h | GCCTTCCAGGCCACTGTCAC |
| 796335 | L_GSP1i | CTGCCTTCCAGGCCACTGTC |
| 796336 | L_GSP1j | CTCCACGGTGCTCCCTTCA |
| 796337 | L_GSP1k | GCTCCCTTCATGCGTGACC |
| 796338 | L_GSP1l | TCTGTGGGACTTCCACTGCTC |
| 796339 | L_GSP1m | GGGGCCACTGTCTTCTCCA |
| 796340 | L_GSP1n | CTTCTGTGGGACTTCCACTGCT |
| 796341 | L_GSP1o | ATCTGCCTTCCAGGCCACTGT |
| 796342 | L_GSP1x | CTTYTGTGGGACTTCCACTGCTC |
| 796343 | L_GSP1y | GCTTYTGTGGGACTTCCACTGCTC |
| 796344 | IgHGC_v13 | AAGTAGTCCTTGACCAGGC |
| 796345 | G_GSP1c | TTCCACGACACCGTCAC |
| 796346 | G_GSP1d | CACGCCGCTGGTCAG |
| 796347 | G_GSP1g | GCTGCTGAGGGAGTAGAGTCCTGA |
| 796348 | G_GSP1h | TCTTGTCCACCTTGGTGTTGCT |
| 796349 | G_GSP1k | GCTGGAGGGCACGGTCAC |

TABLE 6 -continued

| SEQ ID NO | DESCRIPTION | SEQUENCE |
|---|---|---|
| 796350 | G_GSP1 | TCTTGTCCACCTTGGTGTTGCTG |
| 796351 | G_GSP1m | TCTTGTCCACCTTGGTGTTGCT |
| 796352 | G_GSP1n | GACTGTAGGACAGCCGGGAAGG |
| 796353 | G_GSP1o | ACCACGCTGCTGAGGGAGTAG |
| 796354 | G_GSP1p | TTGTCCACCTTGGTGTTGCTG |
| 796355 | G_GSP1q | TGAGTTCCACGACACCGTCAC |
| 796356 | G_GSP1t | GAGTTCCACGACACCGTCACC |
| | Kappa specific | |
| 796358 | K_GSP2 | ATGGCGGGAAGATGAAGAC |
| 796359 | K_GSP2v2a | ATGGCGGGAAGATGAAGAC |
| 796360 | K_GSP2v2b | TGGCGGGAAGATGAAGAC |
| 796361 | K_GSP2v2d | CGGAAGATGAAGACAGATGGT |
| 796362 | K_GSP2v2e | GCAGTTCCAGATTTCAACTG |
| 796363 | K_GSP2v2f | ATGGTCAGCCACAGTT |
| 796364 | K_GSP2v2c | CAGATTTCAACTGCTCATCAGAT |
| 796365 | K_GSP2v2g | TCAGATGGCGGGAAGATGAAGAC |
| | Lambda specific | |
| 796366 | L_GSP2 | CTCCCGGGTAGAAGTCAC |
| 796367 | L_GSP2v2c | AGGGYGGGAACAGAGTGAC |
| 796368 | L_GSP2v2 | CTCCCGGGTAGAAGTCAC |
| 796369 | L_GSP2v2d | GAGGAGGGYGGGAACAGAGTGAC |
| | Gamma specific | |
| 796370 | G_GSP2v2c1 | GCCAGGGGAAGACCG |
| 796371 | G_GSP2v2c2 | GGAAGTAGTCCTTGACCAGG |
| 796372 | G_GSP2b | GGAAGTAGTCCTTGACCAGGCAG |
| 796373 | G_GSP2 | AAGTAGTCCTTGACCAGGC |

TABLE 7

| Plate-ID | SEQ ID NO |
|---|---|
| TATGCTAGTA | 796427 |
| TCACGCGAGA | 796428 |
| TCGATAGTGA | 796429 |
| TCGCTGCGTA | 796430 |
| TCTGACGTCA | 796431 |
| TGAGTCAGTA | 796432 |
| TGTAGTGTGA | 796433 |
| TGTCACACGA | 796434 |
| TGTCGTCGCA | 796435 |
| ACACATACGC | 796436 |
| ACAGTCGTGC | 796437 |
| ACATGACGAC | 796438 |
| ACGACAGCTC | 796439 |
| ACGTCTCATC | 796440 |
| ACTCATCTAC | 796441 |
| ACTCGCGCAC | 796442 |
| AGAGCGTCAC | 796443 |
| AGCGACTAGC | 796444 |

TABLE 7-continued

| Plate-ID | SEQ ID NO |
|---|---|
| AGTAGTGATC | 796445 |
| AGTGACACAC | 796446 |
| AGTGTATGTC | 796447 |
| ATAGATAGAC | 796448 |
| ATATAGTCGC | 796449 |
| ATCTACTGAC | 796450 |
| CACGTAGATC | 796451 |
| CACGTGTCGC | 796452 |
| CATACTCTAC | 796453 |
| CGACACTATC | 796454 |
| CGAGACGCGC | 796455 |
| CGTATGCGAC | 796456 |
| CGTCGATCTC | 796457 |
| CTACGACTGC | 796458 |
| CTAGTCACTC | 796459 |
| CTCTACGCTC | 796460 |
| CTGTACATAC | 796461 |
| TAGACTGCAC | 796462 |
| TAGCGCGCGC | 796463 |
| TAGCTCTATC | 796464 |
| TATAGACATC | 796465 |
| TATGATACGC | 796466 |
| TCACTCATAC | 796467 |
| TCATCGAGTC | 796468 |
| TCGAGCTCTC | 796469 |
| TCGCAGACAC | 796470 |
| TCTGTCTCGC | 796471 |
| TGAGTGACGC | 796472 |
| TGATGTGTAC | 796473 |
| TGCTATAGAC | 796474 |
| TGCTCGCTAC | 796475 |
| ACGTGCAGCG | 796476 |
| ACTCACAGAG | 796477 |
| AGACTCAGCG | 796478 |
| AGAGAGTGTG | 796479 |
| AGCTATCGCG | 796480 |
| AGTCTGACTG | 796481 |
| AGTGAGCTCG | 796482 |
| ATAGCTCTCG | 796483 |

TABLE 7-continued

| Plate-ID | SEQ ID NO |
|---|---|
| ATCACGTGCG | 796484 |
| ATCGTAGCAG | 796485 |
| ATCGTCTGTG | 796486 |
| ATGTACGATG | 796487 |
| ATGTGTCTAG | 796488 |
| CACACGATAG | 796489 |
| CACTCGCACG | 796490 |
| CAGACGTCTG | 796491 |
| CAGTACTGCG | 796492 |
| CGACAGCGAG | 796493 |
| CGATCTGTCG | 796494 |
| CGCGTGCTAG | 796495 |
| CGCTCGAGTG | 796496 |
| CGTGATGACG | 796497 |
| CTATGTACAG | 796498 |
| CTCGATATAG | 796499 |
| CTCGCACGCG | 796500 |
| CTGCGTCACG | 796501 |
| CTGTGCGTCG | 796502 |
| TAGCATACTG | 796503 |
| TATACATGTG | 796504 |
| TATCACTCAG | 796505 |
| TATCTGATAG | 796506 |
| TCGTGACATG | 796507 |
| TCTGATCGAG | 796508 |
| TGACATCTCG | 796509 |
| TGAGCTAGAG | 796510 |
| TGATAGAGCG | 796511 |
| TGCGTGTGCG | 796512 |
| TGCTAGTCAG | 796513 |
| TGTATCACAG | 796514 |
| TGTGCGCGTG | 796515 |

TABLE 8

| Sample-ID | SEQ ID NO |
|---|---|
| ACGAGTGCGT | 796516 |
| TAGACTGCAC | 796517 |
| TAGCGCGCGC | 796518 |

TABLE 8 -continued

| Sample-ID | SEQ ID NO |
|---|---|
| TCATCGAGTC | 796519 |
| TCGCAGACAC | 796520 |
| TCTGTCTCGC | 796521 |
| TGATACGTCT | 796522 |
| TGAGTGACGC | 796523 |
| TGCTCGCTAC | 796524 |
| ACGTGCAGCG | 796525 |
| ACTCACAGAG | 796526 |
| AGACTCAGCG | 796527 |
| AGCTATCGCG | 796528 |
| AGTCTGACTG | 796529 |
| ATAGCTCTCG | 796530 |
| CATAGTAGTG | 796531 |
| CGATCTGTCG | 796532 |
| CGCGTGCTAG | 796533 |
| CGCTCGAGTG | 796534 |
| CGAGAGATAC | 796535 |
| TGAGCTAGAG | 796536 |
| ATACGACGTA | 796537 |
| TGCGTGTGCG | 796538 |
| TGCTAGTCAG | 796539 |
| TGTATCACAG | 796540 |
| TGTGCGCGTG | 796541 |
| TCACGTACTA | 796542 |
| CGTCTAGTAC | 796543 |
| TCTACGTAGC | 796544 |
| TGTACTACTC | 796545 |
| ACGCTCGACA | 796546 |
| ACGACTACAG | 796547 |
| CGTAGACTAG | 796548 |
| TACTCTCGTG | 796549 |
| TAGAGACGAG | 796550 |
| TCGTCGCTCG | 796551 |
| ACATACGCGT | 796552 |
| ACGCGAGTAT | 796553 |
| ACTGTACAGT | 796554 |
| AGACGCACTC | 796555 |
| AGACTATACT | 796556 |

TABLE 8 -continued

| Sample-ID | SEQ ID NO |
|---|---|
| AGCGTCGTCT | 796557 |
| AGTACGCTAT | 796558 |
| ATAGAGTACT | 796559 |
| CACGCTACGT | 796560 |
| CAGTAGACGT | 796561 |
| CGACGTGACT | 796562 |
| AGCACTGTAG | 796563 |
| TACGCTGTCT | 796564 |
| TCGATCACGT | 796565 |
| TCGCACTAGT | 796566 |
| TCTATACTAT | 796567 |
| ATCAGACACG | 796568 |
| AGTCGAGAGA | 796569 |
| CGTACAGTCA | 796570 |
| CGTACTCAGA | 796571 |
| ATATCGCGAG | 796572 |
| CTATAGCGTA | 796573 |
| TATATATACA | 796574 |
| CGTGTCTCTA | 796575 |
| ACAGTCGTGC | 796576 |
| CTCGCGTGTC | 796577 |
| AGTGACACAC | 796578 |
| ATATAGTCGC | 796579 |
| CACGTAGATC | 796580 |
| CGACACTATC | 796581 |
| CTGTACATAC | 796582 |

TABLE 9

Primers to ligate on adaptors for XL+ sequencing

| seq id no | DESCRIPTION | sequence |
|---|---|---|
| 796388 | 5LIB-LA | CCATCTCATCCCTGCGTGTCTCCGACTCAGCGTATCGCCTCCCTCGCGCCAT |
| 796389 | 5LIB-LB | CCTATCCCCTGTGTGCCTTGGCAGTCTCAGCGTATCGCCTCCCTCGCGCCAT |
| 796390 | 3LIB-LA | CCATCTCATCCCTGCGTGTCTCCGACTCAGCTATGCGCCTTGCCAGCCCGCTCA |
| 796391 | 3LIB-LB | CCTATCCCCTGTGTGCCTTGGCAGTCTCAGCTATGCGCCTTGCCAGCCCGCTCA |

TABLE 10

3' primers for other human genes

| seq id no | DESCRIPTION | sequence |
|---|---|---|
| | mu constant region specific | |
| 796392 | mu GSP1 | CTCTCAGGACTGATGGGAAGCC |
| 796393 | mu GSP2 | CTATGCGCCTTGCCAGCCCGCTCAGGGGAATTCTCACAGGAGACGAGG |
| | alpha constant region specific | |
| 796394 | alpha GSP1 | ATTCGTGTAGTGCTTCACGTGGC |
| 796395 | alpha GSP2 | CTATGCGCCTTGCCAGCCCGCTCAGCTCAGCGGGAAGACCTTGGG |
| | TCR alpha constant region specific | |
| 796396 | TR alpha GSP1a | cgtttgcacatgcaaagtcagatt |
| 796397 | TR alpha GSP2b | CTATGCGCCTTGCCAGCCCGCTCAGtcggtgaataggcagacagacttg |
| | TRC beta constant region specific | |
| 796398 | TR beta GSP1 | CCTATCCTGGGTCCACTCGTCA |
| 796399 | TR beta GSP2 | CTATGCGCCTTGCCAGCCCGCTCAGCTGCTTCTGATGGCTCAAACACA |

TABLE 11

3' primers for mouse genes

| seq id no | DESCRIPTION | sequence |
|---|---|---|
| | mu constant region specific | |
| 796400 | mouse_mu_GSP1 | CTGAACCTTCAAGGATGCTCTTGG |
| 796401 | mouse_mu_GSP2 | CTATGCGCCTTGCCAGCCCGCTCAGGGAAGACATTTGGGAAGGACTGACTC |

TABLE 11 -continued

3' primers for mouse genes

| seq id no | DESCRIPTION | sequence |
|---|---|---|
| | alpha constant region specific | |
| 796402 | mouse_alpha_GSP1 | TCTCCTTCTGGGCACTCGACAG |
| 796403 | mouse_alpha_GSP2 | CTATGCGCCTTGCCAGCCCGCTCAGGGGAGTGTCAGTGGGTAGATGGTG |
| | gamma constant region specific | |
| 796404 | mo_g12b_GSP1d | AGGGGACAGTCACTGAGCTGCT |
| 796405 | mo_g2ac_GSP1d | TCGAGGTTACAGTCACTGAGCTGCT |
| 796406 | mo_g3_GSP1d | TGGAGGGTACAGTCACCAAGCTGCT |
| 796407 | mo_g12_GSP2d | CTATGCGCCTTGCCAGCCCGCTCAGGGGCCAGTGGATAGACHGATGG |
| 796408 | mo_g3_GSP2d | CTATGCGCCTTGCCAGCCCGCTCAGGGGACCAAGGGATAGACAGATGG |
| 796409 | mo_g12_GSP2e | CTATGCGCCTTGCCAGCCCGCTCAGCTGGACAGGGATCCAGAGTTCC |
| 796410 | mo_g3_GSP2e | CTATGCGCCTTGCCAGCCCGCTCAGCTGGACAGGGCTCCATAGTTCC |
| | kappa constant region specific | |
| 796411 | mouse_kappa_GSP1 | GAAGTTGATGTCTTGTGAGTGGCCT |
| 796412 | mouse_kappa_GSP2 | CTATGCGCCTTGCCAGCCCGCTCAGTGCTCACTGGATGGTGGGAA |
| | lambda constant region specific | |
| 796413 | mouse_lambda_GSP1a | ACTCTTCTCCACAGTGTCCCCTTCATG |
| 796414 | mouse_lambda_GSP1b | ACTCTTCTCCACAGTGTGACCTTCATG |
| 796415 | mouse_lambda_GSP2a | CTATGCGCCTTGCCAGCCCGCTCAGAGAGGAAGGTGGAAACASGGTGA |
| 796416 | mouse_lambda_GSP2b | CTATGCGCCTTGCCAGCCCGCTCAGAGGGGAAGGTGGAAACATGGTGA |
| | TCR alpha constant region specific | |
| 796417 | mo_TRA_GSP1b | TTGAAGATATCTTGGCAGGTGAAGCTT |
| 796418 | mouse_RA_GSP2 | CTATGCGCCTTGCCAGCCCGCTCAGCACAGCAGGTTCTGGGTTCTGG |
| | TRC beta constant region specific | |
| 796419 | mouse_TRE_GSP1 | GAAAGCCCATGGAACTGCACTTG |
| 796420 | mouse_TRE_GSP2 | CTATGCGCCTTGCCAGCCCGCTCAGGGGTGGAGTCACATTTCTCAGATCC |

*lambda GSP1a and GSP1b are to be mixed 50:50, lambda GSP2a and lambda GSP2b are also to be mixed 50:50 to amplify all lambda constant region alleles that are found in IMGT. All the gamma GSP1ds are also to be mixed equally to amplify all gamma 1, 2a, 2b, 2c and 3 constant region alleles. gamma GSP2ds are also to be mixed 50:50, and gamma GSP2es are also to be mixed 50:50 to amplify all gamma 1, 2a, 2b, 2c and 3 constant regions alleles that are found in IMGT database.

TABLE 12

Plate to patient referencing

| PlateID | Patient |
|---|---|
| 2 | B Staph |
| 3 | B Staph |
| 4 | B Staph |
| 5 | B Staph |
| 7 | Lung Adeno |
| 8 | Lung Adeno |
| 9 | Lung Adeno |
| 10 | Lung Adeno |
| 11 | 360 CCP + RA |
| 12 | 360 CCP + RA |
| 13 | 360 CCP + RA |
| 14 | 361 Staph |
| 15 | 361 Staph |
| 16 | 361 Staph |
| 17 | 361 Staph |
| 18 | 368 CCP + RF + RA |
| 19 | 368 CCP + RF + RA |
| 21 | 368 CCP + RF + RA |
| 22 | 368 CCP + RF + RA |
| 26 | 372 CCP + RF + RA |
| 27 | 372 CCP + RF + RA |
| 40 | 375 CCP + RF+ |
| 41 | 375 CCP + RF+ |
| 43 | 375 CCP + RF+ |
| 44 | 369 CCP + RF + RA |
| 46 | 372 CCP + RF + RA |
| 47 | 372 CCP + RF + RA |
| 48 | 375 CCP + RF+ |
| 49 | Flu |
| 51 | Flu |
| 52 | Flu |
| 53 | Flu |

TABLE 13

| Plate ID | Plate Identification Region Regular Expression | SEQ ID NO: |
|---|---|---|
| 1 | ACGAGTGCGT | 796159 |
| 2 | ACGCTCGACA | 796160 |
| 3 | AGACGCACTC | 796161 |
| 4 | AGCACTGTAG | 796162 |
| 5 | ATCAGACACG | 796163 |
| 6 | ATATCGCGAG | 796164 |
| 7 | CGTGTCTCTA | 796165 |
| 8 | CTCGCGTGTC | 796166 |
| 9 | TGATACGTCT | 796167 |
| 10 | CATAGTAGTG | 796168 |
| 11 | CGAGAGATAC | 796169 |
| 12 | ATACGACGTA | 796170 |
| 13 | TCACGTACTA | 796171 |
| 14 | CGTCTAGTAC | 796172 |
| 15 | TCTACGTAGC | 796173 |
| 16 | TGTACTACTC | 796174 |
| 17 | CGTAGACTAG | 796175 |
| 18 | TACGAGTATG | 796176 |
| 19 | TACTCTCGTG | 796177 |
| 20 | TAGAGACGAG | 796178 |
| 21 | TCGTCGCTCG | 796179 |
| 22 | ACATACGCGT | 796180 |
| 23 | ACGCGAGTAT | 796181 |
| 24 | ACTACTATGT | 796182 |
| 25 | ACTGTACAGT | 796183 |
| 26 | AGACTATACT | 796184 |
| 27 | AGCGTCGTCT | 796185 |
| 28 | AGTACGCTAT | 796186 |
| 29 | ATAGAGTACT | 796187 |
| 30 | CACGCTACGT | 796188 |
| 31 | CAGTAGACGT | 796189 |
| 32 | CGACGTGACT | 796190 |
| 33 | TACACACACT | 796191 |
| 34 | TACACGTGAT | 796192 |
| 35 | TACAGATCGT | 796193 |
| 36 | TACGCTGTCT | 796194 |
| 37 | TAGTGTAGAT | 796195 |
| 38 | TCGATCACGT | 796196 |
| 39 | TCGCACTAGT | 796197 |
| 40 | TCTAGCGACT | 796198 |
| 41 | TCTATACTAT | 796199 |
| 42 | TGACGTATGT | 796200 |
| 43 | TGTGAGTAGT | 796201 |
| 44 | ACAGTATATA | 796202 |
| 45 | ACGCGATCGA | 796203 |
| 46 | ACTAGCAGTA | 796204 |
| 47 | AGCTCACGTA | 796205 |
| 48 | AGTATACATA | 796206 |
| 49 | AGTCGAGAGA | 796207 |
| 50 | AGTGCTACGA | 796208 |
| 51 | CGATCGTATA | 796209 |
| 52 | CGCAGTACGA | 796210 |
| 53 | CGCGTATACA | 796211 |
| 54 | CGTACAGTCA | 796212 |
| 55 | CGTACTCAGA | 796213 |
| 56 | CTACGCTCTA | 796214 |
| 57 | CTATAGCGTA | 796215 |
| 58 | TACGTCATCA | 796216 |
| 59 | TAGTCGCATA | 796217 |
| 60 | TATATATACA | 796218 |

TABLE 14

| Sample ID | Sample Identification Region Regular Expression | SEQ ID NO: |
|---|---|---|
| 1, 31 | ACGTCTCATC | 796440 |
| 2, 46 | ACTCATCTAC | 796441 |
| 3, 48 | AGAGCGTCAC | 796443 |
| 4 | AGTAGTGATC | 796445 |
| 5 | ATAGATAGAC | 796448 |
| 6, 50 | ATCTACTGAC | 796450 |
| 7 | CACGTGTCGC | 796452 |
| 8, 51 | CATACTCTAC | 796453 |
| 9 | CGAGACGCGC | 796455 |
| 10 | CGTCGATCTC | 796457 |
| 11, 72 | CTACGACTGC | 796458 |
| 12, 81, 25 | TAGTGTAGAT | 796195 |
| 13, 26 | TCTAGCGACT | 796198 |

TABLE 14 -continued

| Sample ID | Sample Identification Region Regular Expression | SEQ ID NO: |
|---|---|---|
| 14, 78 | TGTGAGTAGT | 796201 |
| 15 | ACAGTATATA | 796202 |
| 16, 28 | AGCTCACGTA | 796205 |
| 17, 68 | TCGATAGTGA | 796429 |
| 18, 69 | TCGCTGCGTA | 796430 |
| 19, 45 | TGAGTCAGTA | 796432 |
| 20, 70 | TGTAGTGTGA | 796433 |
| 21, 71 | TGTCGTCGCA | 796435 |
| 22 | ACGACAGCTC | 796439 |
| 23 | TACACGTGAT | 796192 |
| 24 | TACAGATCGT | 796193 |
| 27 | ACGCGATCGA | 796203 |
| 29 | AGTGCTACGA | 796208 |
| 30 | TCTGACGTCA | 796431 |
| 75, 32 | TATAGACATC | 796465 |
| 33 | AGTGAGCTCG | 796482 |
| 34 | ATCGTCTGTG | 796486 |
| 35 | CACACGATAG | 796489 |
| 36 | CTGCGTCACG | 796501 |
| 37 | TAGCATACTG | 796503 |
| 38 | TATCTGATAG | 796506 |
| 39 | TGACATCTCG | 796509 |
| 40 | TGATAGAGCG | 796511 |
| 66, 41 | TCACGCGAGA | 796428 |
| 42 | ACACATACGC | 796436 |
| 43 | ACTAGCAGTA | 796204 |
| 44 | CGCAGTACGA | 796210 |
| 47 | ACTCGCGCAC | 796442 |
| 49 | AGCGACTAGC | 796444 |
| 52, 82 | TCGAGCTCTC | 796469 |
| 53 | AGAGAGTGTG | 796479 |
| 54 | ATCGTAGCAG | 796485 |
| 55 | CACTCGCACG | 796490 |
| 56, 84 | CAGACGTCTG | 796491 |
| 57 | CTCGATATAG | 796499 |
| 58 | TCTGATCGAG | 796508 |
| 59 | TACACACACT | 796191 |
| 60 | TACGTCATCA | 796216 |
| 65, 61 | CTACGCTCTA | 796214 |

TABLE 14 -continued

| Sample ID | Sample Identification Region Regular Expression | SEQ ID NO: |
|---|---|---|
| 62 | TAGTCGCATA | 796217 |
| 63 | CGATCGTATA | 796209 |
| 64 | CGCGTATACA | 796211 |
| 67 | AGTATACATA | 796206 |
| 73 | CTCTACGCTC | 796460 |
| 74 | TAGCTCTATC | 796464 |
| 76 | TCACTCATAC | 796467 |
| 77 | CTAGTCACTC | 796459 |
| 79 | TGTCACACGA | 796434 |
| 80 | CTGTGCGTCG | 796502 |
| 83 | ATCACGTGCG | 796484 |
| 85 | TATCACTCAG | 796505 |
| 86 | TGCTATAGAC | 796474 |
| 87 | CAGTACTGCG | 796492 |
| 88 | CGACAGCGAG | 796493 |
| 89 | TATGCTAGTA | 796427 |

TABLE 15

| Sample ID | Sample Identification Region Regular Expression | SEQ ID NO: |
|---|---|---|
| 1, 31 | ACGTCTCATCAAGGAAGGAAGG+ | 796598 |
| 2, 46 | ACTCATCTACAGG+AA+GG+ | 796599 |
| 3, 48 | AGAGCGTCACAGAGAGAAGG+ | 796600 |
| 6, 50 | ATCTACTGACAACACACAAGG+ | 796601 |
| 8, 51 | CATACTCTACAACACACAA+GG+ | 796602 |
| 11, 72 | CTACGACTGCAAGG+AA+GG+ | 796603 |
| 12, 81, 25 | TAGTGTAGATT+GG+TT+GG+ | 796604 |
| 12, 81 | TAGTGTAGATTCGCGG+ | 796605 |
| 13, 26 | TCTAGCGACTT+GG+TT+GG+ | 796606 |
| 14, 78 | TGTGAGTAGTT+GG+TT+GG+ | 796607 |
| 16, 28 | AGCTCACGTATT+GG+TT+GG+ | 796608 |
| 17, 68 | TCGATAGTGAAGG+AA+GG+ | 796609 |
| 18, 69 | TCGCTGCGTAA+GGAGAA+GG+ | 796610 |
| 19, 45 | TGAGTCAGTAAGG+AA+GG+ | 796611 |
| 20, 70 | TGTAGTGTGAAGG+AA+GG+ | 796612 |
| 21, 71 | TGTCGTCGCAAGAGAGAGG+ | 796613 |
| 75, 32 | TATAGACATCAACACACAA+GG+ | 796614 |

TABLE 15-continued

| Sample ID | Sample Identification Region Regular Expression | SEQ ID NO: |
|---|---|---|
| 66, 41 | TCACGCGAGAAAGG+AA+GG+ | 796615 |
| 52, 82 | TCGAGCTCTCTCGCGG+ | 796616 |
| 56, 84 | CAGACGTCTGTCGCGG+ | 796617 |
| 65, 61 | CTACGCTCTAAGG+AA+GG+ | 796618 |

TABLE 16

Constant region insert sequences for DHFR vectors pcDNA3.3 and pOptivec

| Seq ID no | Description | Sequence |
|---|---|---|
| 796424 | IGHG1-G1m3 constant region insert sequence (restriction sites BstBI, EcoRI, SacII BbvCI for splicing in variable region Introduced via silent mutations) | TAAGCTTACTGATAAGGCGCGCCGCGATCGCGCCTCCACCAAGGACCCCTC TGTCTTCCCCCTGGCACCCTCTTCGAAGAGCACCTCTGGGGACACAGCAGC CCTGGGCTGCCTGGTCAAGGACTACTTCCCCGAACCAGTGACAGTGAGTT GGAATTCAGGCGCCCTGACCAGCGGCGTGCACACCTTCCCcGgGGTCCTTC AGTCTTCAGGACTCTACTCCCTCAGCAGCGTGGTGACCGTGCCCTCCAGCA GCTTGGACACCCAGACCTACATCTGCAACGTGAATCACAAGCCCAGCAACA CCAAGGTGGACAAGAGAGTTGAGCCCAAATCTTGTGACAAAACTCACACA TGCCCACCGTGCCCAGCACCTGAACTCCTGGAGGGACCGTCAGTCTTCCTC TTCCTCCCAAAACCCAAGGACACCCTCATGATCTCCCGGACCCTAGAGGCC ACATGCGTGGTGGTGGACGTGAGCCACGAAGACCCCGAGGTCAAGTTCAA CTGGTACGTGGACGGCGTGGAGGTGCATAATGCCAAGACAAAGCCTCGG GAGGAGCAGTACAACAGCACTTACCGTGTGGTCAGCGTCCTCACCGTCCT GCACCAGGACTGGCTGAATGGCAAGGAGTACAAGTGCAAGGTCTCCAACA AAGCCCTCCCAGCCCCCATCGAGAAAACCATCTCCAAAGCCAAAGGGCAG CCCCGAGAACCACAGGTCTACACCCTGCCCCCATCCCGGGAGGAGATGAC CAAGAACCAGGTCAGCCTGACCTGCCTGGTCAAAGGCTTCTATCCCAGCGA CATCGCCGTGGAGTGGGAGAGCAATGGGCAGCCGGAGAACAACTACAAG ACCACGCCTCCCGTGCTGGACTCCGACGGCTCCTTCTTCCTCTATAGCAAGC TCACCGTGGACAAGAGCAGGTGGCAGCAGGGGAACGTCTTTTCATGCTCC GTGATGCATGAGGCTCTGCACAACCACTACACACAGAAGAGCCTCTCCCTG TCCCCAGGTAAATGATAATGTACAACTGACTGAGGATCCT |
| 796425 | IGKC-Km3 constant region insert sequence (restriction sites NheI, XhoI for splicing in variable region introduced via silent mutations) | TAAGCTTACTGACTAGGCCGGCCTTAATTAACGTACGGTGGCTGCACCATC TGTCTTCATCTTCCCTCCATCTGATGAGCAGTTGAAATCTGGAACTGCTAGC GTCGTGTGCCTGCTGAATAACTTTTATCCTCGAGAGGCCAAAGTGCAGTGG AAGGTGGATAACGCCCTCCAATCCGGTAACTCCCAGGAGTCCGTCACAGA GCAGGACAGCAAGGACAGCACCTACAGCCTGAGCAGCACCCTGACACTGA GCAAAGCAGACTACGAGAAACACAAAGTCTACGCCTGCGAAGTCACCCAT CAGGGCCTGAGCTCCCCCGTCACAAAGAGCTTCAACAGGGGAGAGTGTTG ATAAATCGATACTGACTGAGGATCCT |
| 796426 | IGLC-mcg⁻Ke⁻Oz⁻ constant region insert sequence (restriction sites Bsu36I, XhoI, PspXI, NheI for splicing in variable region introduced via silent mutations) | TAAGCTTACTGACTAGGCCGGCCTTAATTAAGGTCAGCCTAAGGCTGCCCC CAGCGTCACTCTGTTCCCTCCCTCCTCTGAGGAGCTTCAAGCCAACAAGGC CACACTGGTGTGTCTCATCAGTGACTTCTACCCCGGAGCCGTGACAGTGGC TTGGAAAGCAGACTCGAGCCCCGTCAAGGCTGGAGTGGAGACCACCACAC CTTCCAAACAAAGCAACAACAAGTACGCAGCTAGCAGCTACCGCAGCCTG ACCCCTGAGCAGTGGAAGTCCCACAGAAGCTACTCCTGCCAGGTCACACAT GAAGGGAGCACCGTGGAGAAGACAGTGGCCCCCACAGAATGTTCATGAT AAATCGATACTGACTGAGGATCCT |

TABLE 17

Constant region insert sequences for Lonza vectors

| seq id no | DESCRIPTION | sequence |
|---|---|---|
| 796421 | IGHG1-G1m3 constant region insert sequence (restriction sites EcoRI, ApaI, AgeI, KpnI, XhoI for splicing in variable region introduced via silent mutations) | AAGCTTGGCGCGCCTTAATTAAGCCAGCACAAAAGGCCCCAGTG TGTTTCCCTTGGCACCCTCGAGCAAGAGTACATCTGGAGGTACA GCTGCCTTGGGCTGTTTGGTGAAAGACTATTTCCCCGAACCGGT TACTGTCTCTTGGAATTCCGGGGCCCTCACCAGTGGTGTCCATA CCTTTCCCGCGGTGCTTCAGAGTTCCGGTTTGTATTCCCTGTCA AGTGTCGTGACGGTACCAAGTTCAAGTCTAGGCACCCAGACATA TATCTGTAACGTCAACCACAAGCCAAGCAACACCAAGGTTGACA AGCGGGTTGAACCTAAGTCCTGTGACAAGACCCATACCTGCCCC CCATGCCCCGCACCCGAGCTCCTCGGAGGGCCTTCCGTCTTTCT TTTCCCTCCCAAACCCAAGGACACTTTGATGATCTCAAGAACAC CAGAAGTCACTTGCGTCGTGGTTGACGTGTCTCACGAAGATCCC GAAGTGAAGTTCAACTGGTACGTGGATGGGGTAGAGGTTCATAA |

TABLE 17 -continued

Constant region insert sequences for Lonza vectors

| seq id no | DESCRIPTION | sequence |
|---|---|---|
| | | CGCCAAGACCAAACCCCGAGAGGAACAGTATAACTCCACCTATA<br>GGGTAGTGTCCGTGCTCACCGTGCTCCACCAAGACTGGCTGAAT<br>GGCAAGGAATACAAGTGCAAGGTGAGTAATAAGGCACTGCCTGC<br>ACCCATTGAGAAGACAATATCTAAAGCAAAGGGACAGCCCAGAG<br>AGCCCCAGGTTTATACTCTGCCACCTAGCAGAGAGGAAATGACT<br>AAAAACCAGGTCAGCCTTACTTGTCTCGTAAAAGGCTTTTATCC<br>AAGCGACATCGCTGTGGAGTGGGAATCAAATGGCCAACCTGAGA<br>ATAATTATAAGACTACACCTCCCGTCCTTGACTCAGACGGTTCC<br>TTCTTCCTGTATAGCAAGCTCACCGTCGATAAAAGTCGGTGGCA<br>ACAGGGAAACGTGTTCTCATGCAGCGTCATGCACGAGGCCTTGC<br>ACAATCATTACACCCAGAAGTCTCTGTCCCTGAGCCCTGGAAAG<br>TGATCA |
| 796422 | IGKC-Km3 constant region insert sequence (restriction sites XmaI, EcoRI, BstEII, DraIII for splicing in variable region introduced via silent mutations) | AAGCTTAATTAAGGCGCGCCGAACAGTGGCTGCTCCTTCCGTGT<br>TCATATTCCCCCCATCCGACGAGCAGCTTAAATCTGGGACTGCT<br>AGCGTCGTGTGCCTGTTGAATAATTTTTATCCCCGGGAGGCTAA<br>GGTACAGTGGAAGGTGGACAACGCCCTCCAATCAGGGAATTCCC<br>AGGAGTCGGTCACCGAACAGGACAGCAAGGACTCAACCTACTCT<br>CTGTCATCCACTCTCACACTCAGCAAAGCCGACTATGAAAAACA<br>CAAAGTGTATGCTTGCGAGGTGACTCATCAAGGGCTCTCCAGTC<br>CTGTGACTAAATCCTTCAACCGAGGCGAATGCTGATCA |
| 796423 | IGLC-Mcg⁻Ke⁻Oz⁻ constant region insert sequence (restriction sites DraIII, XmaI, BstEII, PspXI for splicing in variable region introduced via silent mutations) | AAGCTTGGCGCGCCTTAATTAAGGCCAGCCTAAAGCCGCACCCA<br>GTGTGACCCTGTTTCCTCCCTCCTCTGAAGAGCTCCAGGCAAAC<br>AAAAGCTACTCTGGTGTGTCTTATTAGCGATTTCTATCCCGGGGC<br>GGTGACCGTGGCTTGGAAGGCCGACTCGAGCCCAGTGAAGGCCG<br>GAGTGGAAACTACAACCCCTTCCAAACAGTCAAACAATAAATAC<br>GCCGCTAGCAGCTATCTCTCTCACCCCAGAACAGTGGAAATC<br>CCACAGGTCCTATTCTTGCCAGGTCACACACGAGGGGTCAACCG<br>TTGAGAAGACTGTTGCCCCAACAGAGTGCAGCTGATCA |

TABLE 18

All expressed antibodies

| SEQ ID NO | Antibody | Chain Type | Clone | V-GENE and allele | J-GENE and allele | D-GENE and allele |
|---|---|---|---|---|---|---|
| | LC1 | Light chain | K8B8 | IGKV3-11*01 F | IGKJ3*01 F | |
| | LC1 | Heavy chain | G8B8 | IGHV1-46*01 F, or IGHV1-46*03 F | IGHJ3*01 F, or IGHJ3*02 F | IGHD5-24*01 ORF |
| | LC2 | Light chain | K8C11 | IGKV3-11*01 F | IGKJ3*01 F, or IGKJ4*01 F | |
| | LC2 | Heavy chain | G8C11 | IGHV3-30*03 F, or IGHV3-30*18 F | IGHJ4*02 F | IGHD6-25*01 F |
| | LC3 | Light chain | K8D6 | IGKV3-20*01 F | IGKJ1*01 F | |
| | LC3 | Heavy chain | G8D6 | IGHV1-46*01 F, or IGHV1-46*03 F | IGHJ3*01 F, or IGHJ3*02 F | IGHD5-24*01 ORF |
| | LC5 | Light chain | K10G5 | IGKV3-11*01 F | IGKJ4*01 F | |
| | LC5 | Heavy chain | G10G5 | IGHV3-33*05 F | IGHJ4*02 F | IGHD6-13*01 F |
| | LC6 | Light chain | K8D6 | IGKV3-20*01 F | IGKJ1*01 F | |
| | LC6 | Heavy chain | G10H2 | IGHV3-11*01 F | IGHJ4*02 F | IGHD3-9*01 F |
| | LC7 | Light chain | L8D9 | IGLV2-8*01 F | IGLJ2*01 F, or IGLJ3*01 F or IGLJ3*02 F | |
| | LC7 | Heavy chain | G8D9 | IGHV3-53*02 F | IGHJ4*02 F | IGHD4-17*01 F |
| | LC9 | Light chain | L10A1 | IGLV10-54*01 F | IGLJ3*02 F | |
| | LC9 | Heavy chain | G10A1 | IGHV3-30*03 F, or IGHV3-30*18 F | IGHJ3*02 F | IGHD2-2*01 F |
| | LC10 | Light chain | K9C11 | IGKV3-11*01 F | IGKJ4*01 F | |
| | LC10 | Heavy chain | G9C11 | IGHV3-33*01 F, or IGHV3-33*06 F | IGHJ6*02 F | IGHD5-18*01 F |

TABLE 18-continued

All expressed antibodies

| SEQ ID NO | Antibody | Chain Type | Clone | V-GENE and allele | J-GENE and allele | D-GENE and allele |
|---|---|---|---|---|---|---|
| | LC11 | Light chain | L10A6 | IGLV2-14*01 F | IGLJ3*02 F | |
| | LC11 | Heavy chain | G10A6 | IGHV3-21*01 F, or IGHV3-21*04 F | IGHJ4*02 F | IGHD1-20*01 F |
| | LC12 | Light chain | L9C9 | IGLV2-14*01 F | IGLJ3*02 F | |
| | LC12 | Heavy chain | G9C9 | IGHV3-15*01 F | IGHJ4*02 F | IGHD1-26*01 F |
| | LC13 | Light chain | L9B1 | IGLV2-8*01 F | IGLJ1*01 F | |
| | LC13 | Heavy chain | G9B1 | IGHV3-66*01 F, or IGHV3-66*04 F | IGHJ3*02 F | IGHD2-8*01 F |
| | LC14 | Light chain | L9A1 | IGLV2-14*01 F | IGLJ3*02 F | |
| | LC14 | Heavy chain | G9A1 | IGHV3-15*01 F | IGHJ4*02 F | IGHD1-26*01 F |
| | LC15 | Light chain | K10A9 | IGKV3-11*01 F | IGKJ3*01 F | |
| | LC15 | Heavy chain | G10A9 | IGHV3-30*03 F, or IGHV3-30*18 F | IGHJ4*02 F | IGHD6-25*01 F |
| | LC16 | Light chain | K10D2 | IGKV3-20*01 F | IGKJ2*02 F | |
| | LC16 | Heavy chain | G10D2 | IGHV3-15*01 F | IGHJ4*02 F | IGHD4-23*01 ORF |
| | LC17 | Light chain | K8D5 | IGKV3-11*01 F | IGKJ3*01 F | |
| | LC17 | Heavy chain | G8D5 | IGHV3-30*03 F, or IGHV3-30*18 F | IGHJ4*02 F | IGHD4-23*01 ORF |
| | LC18 | Light chain | L10D5 | IGLV2-8*01 F | IGLJ3*02 F | |
| | LC18 | Heavy chain | G10D5 | IGHV3-53*02 F | IGHJ4*02 F | IGHD4-17*01 F |
| | Flu14 | Light chain | L51A6 | IGLV3-25*03 F | IGLJ1*01 F | |
| | Flu14 | Heavy chain | G51A6 | IGHV3-30-3*01 F | IGHJ3*01 F | IGHD1-14*01 ORF |
| | Flu15 | Light chain | L51C4 | IGLV3-1*01 F | IGLJ2*01 F, or IGLJ3*01 F or IGLJ3*02 F | |
| | Flu15 | Heavy chain | G51C4 | IGHV3-30*04 F | IGHJ6*02 F | IGHD3-10*01 F |
| | Flu16 | Light chain | K51G11 | IGKV1-33*01 F, or IGKV1D-33*01 F | IGKJ4*01 F | |
| | Flu16 | Heavy chain | G51G11 | IGHV3-30*03 F, or IGHV3-30*18 F | IGHJ6*02 F | IGHD4-17*01 F |
| | Flu17 | Light chain | K49F7 | IGKV1-33*01 F, or IGKV1D-33*01 F | IGKJ4*01 F | |
| | Flu17 | Heavy chain | G49F7 | IGHV1-69*02 F, or IGHV1-69*04 F | IGHJ3*02 F | IGHD3-22*01 F |
| | Flu18 | Light chain | K51D7 | IGKV1-33*01 F, or IGKV1D-33*01 F | IGKJ4*01 F | |
| | Flu18 | Heavy chain | G51D7 | IGHV3-30*03 F, or IGHV3-30*18 F | IGHJ6*02 F | IGHD4-11*01 ORF |
| | Flu19 | Light chain | K51D8 | IGKV1-39*01 F, or IGKV1D-39*01 F | IGKJ4*01 F | |
| | Flu19 | Heavy chain | G51D8 | IGHV3-49*04 F | IGHJ6*02 F | IGHD3-22*01 F |
| | Flu20 | Light chain | K51G10 | IGKV3-15*01 F | IGKJ2*01 F | |
| | Flu20 | Heavy chain | G51G10 | IGHV3-30*03 F, or IGHV3-30*18 F | IGHJ6*01 F | IGHD3-16*02 F |
| | Flu21 | Light chain | L49A9 | IGLV3-21*02 F | IGLJ3*02 F | |
| | Flu21 | Heavy chain | G49A9 | IGHV3-74*01 F | IGHJ2*01 F | IGHD2-21*01 F |
| | Flu22 | Light chain | L52A6 | IGLV2-14*01 F | IGLJ3*02 F | |
| | Flu22 | Heavy chain | G52A6 | IGHV3-30*03 F, or IGHV3-30*18 F | IGHJ6*02 F | IGHD4-23*01 ORF |
| | Flu23 | Light chain | K49F11 | IGKV3-11*01 F | IGKJ3*01 F | |
| | Flu23 | Heavy chain | G49F11 | IGHV3-30*04 F, or IGHV3-30*08 F or IGHV3-30-3*01 F | IGHJ4*02 F | IGHD3-16*01 F |

TABLE 18-continued

All expressed antibodies

| SEQ ID NO | Antibody | Chain Type | Clone | V-GENE and allele | J-GENE and allele | D-GENE and allele |
|---|---|---|---|---|---|---|
| | Flu24 | Light chain | K51C8 | IGKV3-15*01 F | IGKJ2*01 F | |
| | Flu24 | Heavy chain | G51C8 | IGHV3-30*14 F | IGHJ5*02 F | IGHD3-22*01 F |
| | Flu25 | Light chain | K51H1 | IGKV1-39*01 F, or IGKV1D-39*01 F | IGKJ4*01 F | |
| | Flu25 | Heavy chain | G51H1 | IGHV3-9*01 F | IGHJ4*02 F | IGHD6-13*01 F |
| | Flu26 | Light chain | K52A2 | IGKV1-33*01 F, or IGKV1D-33*01 F | IGKJ4*01 F | |
| | Flu26 | Heavy chain | G52A2 | IGHV3-30*03 F, or IGHV3-30*18 F | IGHJ6*02 F | IGHD4-23*01 ORF |
| | Flu27 | Light chain | L49A11 | IGLV2-14*01 F | IGLJ3*02 F | |
| | Flu27 | Heavy chain | G49A11 | IGHV3-7*03 F | IGHJ5*02 F | IGHD3-3*01 F |
| | Flu28 | Light chain | L49C4 | IGLV3-10*01 F | IGLJ2*01 F, or IGLJ3*01 F | |
| | Flu28 | Heavy chain | G49C4 | IGHV3-43*01 F | IGHJ4*02 F | IGHD4-17*01 F |
| | Flu29 | Light chain | L51H5 | IGLV3-27*01 F | IGLJ2*01 F, or IGLJ3*01 F | |
| | Flu29 | Heavy chain | G51H5 | IGHV1-2*04 F | IGHJ6*02 F | IGHD2-21*02 F |
| | Flu30 | Light chain | L52B8 | IGLV2-14*01 F | IGLJ3*02 F | |
| | Flu30 | Heavy chain | G52B8 | IGHV3-30*03 F, or IGHV3-30*18 F | IGHJ6*02 F | IGHD4-17*01 F |
| | Flu31 | Light chain | K49A5 | IGKV1-33*01 F, or IGKV1D-33*01 F | IGKJ4*01 F | |
| | Flu31 | Heavy chain | G49A5 | IGHV3-30-3*01 F | IGHJ4*02 F | IGHD5-12*01 F |
| | Flu32 | Light chain | K49C11 | IGKV1-33*01 F, or IGKV1D-33*01 F | IGKJ4*01 F | |
| | Flu32 | Heavy chain | G49C11 | IGHV3-66*01 F, or IGHV3-66*04 F | IGHJ4*02 F | IGHD6-19*01 F |
| | Flu33 | Light chain | L51E9 | IGLV2-14*01 F | IGLJ3*02 F | |
| | Flu33 | Heavy chain | G51E9 | IGHV3-23*01 F | IGHJ4*02 F | IGHD3-16*01 F |
| | Flu34 | Light chain | L52G10 | IGLV2-14*01 F | IGLJ3*02 F | |
| | Flu34 | Heavy chain | G52G10 | IGHV3-30-3*01 F | IGHJ3*01 F, or IGHJ3*02 F | IGHD6-19*01 F |
| | Flu35 | Light chain | L53F10 | IGLV3-21*02 F | IGLJ3*02 F | |
| | Flu35 | Heavy chain | G53F10 | IGHV3-30*03 F, or IGHV3-30*18 F | IGHJ6*02 F | IGHD3-3*01 F |
| | Flu36 | Light chain | L52G7 | IGLV2-8*01 F | IGLJ2*01 F, or IGLJ3*01 F or IGLJ3*02 F | |
| | Flu36 | Heavy chain | G52G7 | IGHV3-66*02 F | IGHJ4*02 F | IGHD2-15*01 F |
| | Flu37 | Light chain | K51E8 | IGKV3-15*01 F | IGKJ1*01 F | |
| | Flu37 | Heavy chain | G51E8 | IGHV1-2*04 F | IGHJ6*02 F | IGHD2-21*02 F |
| | Flu39 | Light chain | K53G7 | IGKV1-5*03 F | IGKJ1*01 F | |
| | Flu39 | Heavy chain | G53G7 | IGHV1-46*01 F, or IGHV1-46*03 F | IGHJ4*02 F | IGHD3-9*01 F |
| | Flu40 | Light chain | L51A5 | IGLV3-10*01 F | IGLJ2*01 F, or IGLJ3*01 F or IGLJ3*02 F | |
| | Flu40 | Heavy chain | G51A5 | IGHV4-34*01 F | IGHJ6*02 F | IGHD5-24*01 ORF |
| | Flu41 | Light chain | L51B1 | IGLV3-25*03 F | IGLJ1*01 F | |
| | Flu41 | Heavy chain | G51B1 | IGHV1-2*02 F | IGHJ4*02 F | IGHD3-10*01 F |
| | Flu43 | Light chain | L51D3 | IGLV3-22*01 F | IGLJ3*02 F | |
| | Flu43 | Heavy chain | G51D3 | IGHV4-39*01 F | IGHJ3*02 F | IGHD1-26*01 F |

TABLE 18-continued

All expressed antibodies

| SEQ ID NO | Antibody | Chain Type | Clone | V-GENE and allele | J-GENE and allele | D-GENE and allele |
|---|---|---|---|---|---|---|
| | Flu44 | Light chain | L51D4 | IGLV2-14*01 F | IGLJ3*02 F | |
| | Flu44 | Heavy chain | G51D4 | IGHV3-11*01 F | IGHJ6*02 F | IGHD4-17*01 F |
| | Flu45 | Light chain | L52D4 | IGLV2-14*01 F | IGLJ3*02 F | |
| | Flu45 | Heavy chain | G52D4 | IGHV3-30-3*01 F | IGHJ3*01 F, or IGHJ3*02 F | IGHD6-19*01 F |
| | Flu46 | Light chain | L52H4 | IGLV1-51*01 F | IGLJ3*02 F | |
| | Flu46 | Heavy chain | G52H4 | IGHV3-23*01 F, or IGHV3-23*04 F | IGHJ4*02 F | IGHD6-13*01 F |
| | S1 | Light chain | K3G4 | IGKV3-11*01 F | IGKJ3*01 F | |
| | S1 | Heavy chain | G3G4 | IGHV3-53*02 F | IGHJ4*02 F | IGHD2-21*01 F |
| | S2 | Light chain | K4C4 | IGKV2-28*01 F, or IGKV2D-28*01 F | IGKJ4*01 F | |
| | S2 | Heavy chain | G4C4 | IGHV3-23*04 F | IGHJ5*02 F | IGHD6-19*01 F |
| | S3 | Light chain | K15C6 | IGKV1-5*01 F | IGKJ4*01 F | |
| | S3 | Heavy chain | G15C6 | IGHV3-7*01 F | IGHJ1*01 F | IGHD2-2*01 F |
| | S4 | Light chain | K15G1 | IGKV1-6*01 F | IGKJ1*01 F | |
| | S4 | Heavy chain | G15G1 | IGHV3-7*03 F | IGHJ3*02 F | IGHD6-13*01 F |
| | S5 | Light chain | K17C3 | IGKV1-39*01 F, or IGKV1D-39*01 F | IGKJ2*02 F | |
| | S5 | Heavy chain | G17C3 | IGHV1-8*02 F | IGHJ4*02 F | IGHD3-16*01 F |
| | S6 | Light chain | K3E11 | IGKV3-15*01 F | IGKJ1*01 F | |
| | S6 | Heavy chain | G3E11 | IGHV3-30*04 F, or IGHV3-30-3*01 F | IGHJ4*02 F | IGHD4-23*01 ORF |
| | S7 | Light chain | L4B8 | IGLV2-8*01 F | IGLJ2*01 F, or IGLJ3*01 F | |
| | S7 | Heavy chain | G4B8 | IGHV3-30*04 F, or IGHV3-30*10 F | IGHJ4*01 F, or IGHJ4*02 F | IGHD5-18*01 F |
| | S8 | Light chain | L4D2 | IGLV2-23*01 F, or IGLV2-23*03 F | IGLJ3*02 F | |
| | S8 | Heavy chain | G4D2 | IGHV3-33*03 F | IGHJ6*02 F | IGHD3-10*01 F |
| | S9 | Light chain | L4D6 | IGLV2-8*01 F | IGLJ2*01 F, or IGLJ3*01 F | |
| | S9 | Heavy chain | G4D6 | IGHV3-20*01 F | IGHJ4*02 F | IGHD2-2*01 F |
| | S10 | Light chain | L4F4 | IGLV3-1*01 F | IGLJ3*02 F | |
| | S10 | Heavy chain | G4F4 | IGHV4-59*01 F, or IGHV4-59*08 F | IGHJ4*02 F | IGHD3-3*01 F |
| | S11 | Light chain | L15D1 | IGLV8-61*01 F | IGLJ3*02 F | |
| | S11 | Heavy chain | G15D1 | IGHV3-7*01 F | IGHJ4*02 F | IGHD3-10*01 F |
| | S12 | Light. chain | L17C6 | IGLV1-47*01 F, or IGLV1-47*02 F | IGLJ3*02 F | |
| | S12 | Heavy chain | G17C6 | IGHV3-7*03 F | IGHJ4*02 F | IGHD5-18*01 F |
| | S13 | Light chain | L17C9 | IGLV7-46*01 F | IGLJ*02 F | |
| | S13 | Heavy chain | G17C9 | IGHV5-a*03 F | IGHJ6*02 F | IGHD6-13*01 F |
| | RA1 | Light chain | K11G5 | IGKV3-11*01 F | IGKJ5*01 F | |
| | RA1 | Heavy chain | G11G5 | IGHV3-30*03 F, or IGHV3-30*18 F | IGHJ4*02 F | IGHD4-23*01 ORF |
| | RA2 | Light chain | K22C7 | IGKV3-15*01 F | IGKJ1*01 F | |
| | RA2 | Heavy chain | G22C7 | IGHV3-30*03 F, or IGHV3-30*18 F | IGHJ4*02 F | IGHD6-25*01 F |
| | RA3 | Light chain | K26B1 | IGKV3-15*01 F | IGKJ4*01 F | |

TABLE 18-continued

All expressed antibodies

| SEQ ID NO | Antibody | Chain Type | Clone | V-GENE and allele | J-GENE and allele | D-GENE and allele |
|---|---|---|---|---|---|---|
| | RA3 | Heavy chain | G26B1 | IGHV4-39*07 F | IGHJ4*02 F | IGHD4-23*01 ORF |
| | RA4 | Light chain | K26F5 | IGKV3-15*01 F | IGKJ5*01 F | |
| | RA4 | Heavy chain | G26F5 | IGHV3-23*01 F | IGHJ4*02 F | IGHD6-19*01 F |
| | RA5 | Light chain | K26H1 | IGKV3-11*01 F | IGKJ4*01 F | |
| | RA5 | Heavy chain | G26H1 | IGHV3-9*01 F | IGHJ4*02 F | IGHD6-13*01 F |
| | RA6 | Light chain | K40C5 | IGKV1-39*01 F, or IGKV1D-39*01 F | IGKJ3*01 F | |
| | RA6 | Heavy chain | G40C5 | IGHV3-30*04 F, or IGHV3-30*08 F or IGHV3-30-3*01 F | IGHJ4*02 F | IGHD3-16*01 F |
| | RA7 | Light chain | K40G1 | IGKV3-11*01 F | IGKJ1*01 F | |
| | RA7 | Heavy chain | G40G1 | IGHV4-39*01 F | IGHJ6*02 F | IGHD2-15*01 F |
| | RA8 | Light chain | K40H4 | IGKV1-33*01 F, or IGKV1D-33*01 F | IGKJ4*01 F | |
| | RA8 | Heavy chain | G40H4 | IGHV1-2*02 F | IGHJ5*02 F | IGHD2-21*02 F |
| | RA9 | Light chain | K41A2 | IGKV1-33*01 F, or IGKV1D-33*01 F | IGKJ4*01 F | |
| | RA9 | Heavy chain | G41A2 | IGHV1-2*02 F | IGHJ6*02 F | IGHD1-1*01 F |
| | RA10 | Light chain | K47A2 | IGKV3-15*01 F | IGKJ5*01 F | |
| | RA10 | Heavy chain | G47A2 | IGHV3-23*01 F | IGHJ4*02 F | IGHD6-19*01 F |
| | RA11 | Light chain | K47E2 | IGKV3-15*01 F | IGKJ5*01 F | |
| | RA11 | Heavy chain | G47E2 | IGHV3-23*01 F | IGHJ4*02 F | IGHD6-19*01 F |
| | RA12 | Light chain | K47F9 | IGKV3-11*01 F | IGKJ4*01 F | |
| | RA12 | Heavy chain | G47F9 | IGHV4-39*02 F | IGHJ3*02 F | IGHD3-3*02 F |
| | RA13 | Light chain | L13B10 | IGLV3-1*01 F | IGLJ1*01 F | |
| | RA13 | Heavy chain | G13B10 | IGHV5-51*01 F | IGHJ6*02 F | IGHD6-25*01 F |
| | RA14 | Light chain | L13G5 | IGLV3-1*01 F | IGLJ1*01 F | |
| | RA14 | Heavy chain | G13G5 | IGHV5-51*01 F | IGHJ6*02 F | IGHD6-25*01 F |
| | RA15 | Light chain | K40D6 | IGKV3-20*01 F | IGKJ5*01 F | |
| | RA15 | Heavy chain | G40D6 | IGHV4-39*07 F | IGHJ4*02 F | IGHD4-23*01 ORF |
| | RA16 | Light chain | K25D6 | IGKV3-11*01 F | IGKJ3*01 F | |
| | RA16 | Heavy chain | G26D6 | IGHV3-72*01 F | IGHJ6*03 F | IGHD4-17*01 F |
| | RA17 | Light chain | K25E9 | IGKV3-11*01 F | IGKJ3*01 F | |
| | RA17 | Heavy chain | G25E9 | IGHV3-30*03 F, or IGHV3-30*18 F or IGHV3-33*05 F | IGHJ5*02 F | IGHD3-22*01 F |
| | RA18 | Light chain | K25G4 | IGKV1-27*01 F | IGKJ2*03 F | |
| | RA18 | Heavy chain | G25G4 | IGHV3-30*09 F | IGHJ4*02 F | IGHD1-1*01 F |
| | RA19 | Light chain | K45D9 | IGKV3-15*01 F | IGKJ1*01 F | |
| | RA19 | Heavy chain | G45D9 | IGHV3-30*03 F, or IGHV3-30*18 F | IGHJ4*02 F | IGHD3-22*01 F |
| | RA21 | Light chain | L13E11 | IGLV2-23*02 F | IGLJ1*01 F | |
| | RA21 | Heavy chain | G13E11 | IGHV3-15*01 F | IGHJ4*02 F | IGHD6-13*01 F |
| | RA22 | Light chain | L13G5 | IGLV3-1*01 F | IGLJ1*01 F | |

TABLE 18-continued

All expressed antibodies

| SEQ ID NO | Antibody | Chain Type | Clone | V-GENE and allele | J-GENE and allele | D-GENE and allele |
|---|---|---|---|---|---|---|
| | RA22 | Heavy chain | G13G5 | IGHV3-7*01 F | IGHJ5*02 F | IGHD5-12*01 F |
| | RA23 | Light chain | L44C5 | IGLV2-23*01 F, or IGLV2-23*02 F or IGLV2-23*03 F | IGLJ1*01 F | |
| | RA23 | Heavy chain | G44C5 | IGHV3-30*14 F | IGHJ5*02 F | IGHD7-27*01 F |
| | RA24 | Light chain | L44D6 | IGLV2-23*01 F, or IGLV2-23*02 F or IGLV2-23*03 F | IGLJ1*01 F | |
| | RA24 | Heavy chain | G44D6 | IGHV3-30*04 F | IGHJ6*03 F | IGHD3-10*01 F |

*VDJ identity as given by V-QUEST.

TABLE 19 antibodies used in Fluzone ELISA

| Antibody | Chain Type | Clone |
|---|---|---|
| Flu14 | Light chain | L51A6 |
| Flu14 | Heavy chain | G51A6 |
| Flu15 | Light chain | L51C4 |
| Flu15 | Heavy chain | G51C4 |
| Flu16 | Light chain | K51G11 |
| Flu16 | Heavy chain | G51G11 |
| Flu17 | Light chain | K49F7 |
| Flu17 | Heavy chain | G49F7 |
| Flu18 | Light chain | K51D7 |
| Flu18 | Heavy chain | G51D7 |
| Flu19 | Light chain | K51D8 |
| Flu19 | Heavy chain | GS1D8 |
| Flu20 | Light chain | K51G10 |
| Flu20 | Heavy chain | G51G10 |
| Flu21 | Light chain | L49A9 |
| Flu21 | Heavy chain | G49A9 |
| Flu22 | Light chain | L52A6 |
| Flu22 | Heavy chain | G52A6 |
| Flu23 | Light chain | K49F11 |
| Flu23 | Heavy chain | G49F11 |
| Flu25 | Light chain | K51H1 |
| Flu25 | Heavy chain | G51H1 |
| Flu26 | Light chain | K52A2 |
| Flu26 | Heavy chain | G52A2 |
| Flu27 | Light chain | L49A11 |
| Flu27 | Heavy chain | G49A11 |
| Flu29 | Light chain | L51H5 |
| Flu29 | Heavy chain | G51H5 |
| Flu30 | Light chain | L52B8 |
| Flu30 | Heavy chain | G52B8 |
| Flu33 | Heavy chain | G51E9 |
| Flu34 | Light chain | L52G10 |
| Flu34 | Heavy chain | G52G10 |
| Flu35 | Light chain | L53F10 |
| Flu35 | Heavy chain | G53F10 |
| Flu37 | Light chain | K51E8 |
| Flu37 | Heavy chain | G51E8 |
| Flu39 | Light chain | K53G7 |
| Flu39 | Heavy chain | G53G7 |
| Flu40 | Light chain | L51A5 |
| Flu40 | Heavy chain | G51A5 |
| Flu41 | Light chain | L51B1 |
| Flu41 | Heavy chain | G51B1 |
| Flu43 | Light chain | L51D3 |
| Flu43 | Heavy chain | G51D3 |
| Flu44 | Light chain | L51D4 |
| Flu44 | Heavy chain | G51D4 |
| Flu45 | Light chain | L52D4 |
| Flu45 | Heavy chain | G52D4 |
| Flu46 | Light chain | L52H4 |
| Flu46 | Heavy chain | G52H4 |
| S1 | Light chain | K3G4 |
| S1 | Heavy chain | G3G4 |
| S2 | Light chain | K4C4 |
| S2 | Heavy chain | G4C4 |

TABLE 20

Antibodies used in surface plasmon resonance

| Antibody | Chain Type | Clone |
|---|---|---|
| Flu14 | Light chain | L51A6 |
| Flu14 | Heavy chain | G51A6 |
| Flu15 | Light chain | L51C4 |
| Flu15 | Heavy chain | G51C4 |
| Flu16 | Light chain | K51G11 |
| Flu16 | Heavy chain | G51G11 |
| Flu17 | Light chain | K49F7 |
| Flu17 | Heavy chain | G49F7 |
| Flu18 | Light chain | K51D7 |
| Flu18 | Heavy chain | G51D7 |
| Flu19 | Light chain | K51D8 |
| Flu19 | Heavy chain | G51D8 |
| Flu20 | Light chain | K51G10 |
| Flu20 | Heavy chain | G51G10 |
| Flu21 | Light chain | L49A9 |
| Flu21 | Heavy chain | G49A9 |
| Flu22 | Light chain | L52A6 |
| Flu22 | Heavy chain | G52A6 |
| Flu26 | Light chain | K52A2 |
| Flu26 | Heavy chain | G52A2 |
| Flu29 | Light chain | L51H5 |
| Flu29 | Heavy chain | G51H5 |
| Flu34 | Light chain | L52G10 |
| Flu34 | Heavy chain | G52G10 |
| Flu35 | Light chain | L53F10 |
| Flu35 | Heavy chain | G53F10 |
| Flu46 | Light chain | L52H4 |
| Flu46 | Heavy chain | G52H4 |

TABLE 21

Antibodies used in RA antigen array

| Antibody | Chain Type | Clone |
|---|---|---|
| RA1 | Light chain | K11G5 |
| RA1 | Heavy chain | G11G5 |
| RA2 | Light chain | K22C7 |
| RA2 | Heavy chain | G22C7 |
| RA4 | Light chain | K26F5 |
| RA4 | Heavy chain | G26F5 |
| RA5 | Light chain | K26H1 |
| RA5 | Heavy chain | G26H1 |
| RA8 | Light chain | K40H4 |
| RA8 | Heavy chain | G40H4 |
| RA9 | Light chain | K41A2 |
| RA9 | Heavy chain | G41A2 |
| RA10 | Light chain | K47A2 |
| RA10 | Heavy chain | G47A2 |
| RA11 | Light chain | K47E2 |
| RA11 | Heavy chain | G47E2 |
| RA12 | Light chain | K47F9 |
| RA12 | Heavy chain | G47F9 |
| RA13 | Light chain | L13B10 |
| RA13 | Heavy chain | G13B10 |
| RA16 | Light chain | K25D6 |
| RA16 | Heavy chain | G26D6 |
| RA19 | Light chain | K45D9 |
| RA19 | Heavy chain | G45D9 |
| RA22 | Light chain | L13G5 |
| RA22 | Heavy chain | G13G5 |
| RA23 | Light chain | L44C5 |
| RA23 | Heavy chain | G44C5 |
| Flu14 | Light chain | L51A6 |
| Flu14 | Heavy chain | G51A6 |
| Flu26 | Light chain | K52A2 |
| Flu26 | Heavy chain | G52A2 |

TABLE 22

Antibodies used in Histone 2A ELISA and CCP ELISA

| Antibody | Chain Type | Clone |
|---|---|---|
| RA1 | Light chain | K11G5 |
| RA1 | Heavy chain | G11G5 |
| RA2 | Light chain | K22C7 |
| RA2 | Heavy chain | G22C7 |
| RA4 | Light chain | K26F5 |
| RA4 | Heavy chain | G26F5 |
| RA5 | Light chain | K26H1 |
| RA5 | Heavy chain | G26H1 |
| RA6 | Light chain | K40C5 |
| RA6 | Heavy chain | G40C5 |
| RA7 | Light chain | K40G1 |
| RA7 | Heavy chain | G40G1 |
| RA8 | Light chain | K40H4 |
| RA8 | Heavy chain | G40H4 |
| RA9 | Light chain | K41A2 |
| RA9 | Heavy chain | G41A2 |
| RA10 | Light chain | K47A2 |
| RA10 | Heavy chain | G47A2 |
| RA11 | Light chain | K47E2 |
| RA11 | Heavy chain | G47E2 |
| RA12 | Light chain | K47F9 |
| RA12 | Heavy chain | G47F9 |
| RA13 | Light chain | L13B10 |
| RA13 | Heavy chain | G13B10 |
| RA16 | Light chain | K25D6 |
| RA16 | Heavy chain | G26D6 |
| RA17 | Light chain | K25E9 |
| RA17 | Heavy chain | G25E9 |
| RA18 | Light chain | K25G4 |
| RA18 | Heavy chain | G25G4 |
| RA19 | Light chain | K45D9 |
| RA19 | Heavy chain | G45D9 |
| RA22 | Light chain | L13G5 |
| RA22 | Heavy chain | G13G5 |
| RA23 | Light chain | L44C5 |
| RA23 | Heavy chain | G44C5 |
| RA24 | Light chain | L44D6 |
| RA24 | Heavy chain | G44D6 |

TABLE 23

Antibodies used in RF ELISA

| Antibody | Chain Type | Clone |
|---|---|---|
| RA1 | Light chain | K11G5 |
| RA1 | Heavy chain | G11G5 |
| RA2 | Light chain | K22C7 |
| RA2 | Heavy chain | G22C7 |
| RA4 | Light chain | K26F5 |
| RA4 | Heavy chain | G26F5 |
| RA5 | Light chain | K26H1 |
| RA5 | Heavy chain | G26H1 |
| RA6 | Light chain | K40C5 |
| RA6 | Heavy chain | G40C5 |
| RA8 | Light chain | K40H4 |
| RA8 | Heavy chain | G40H4 |
| RA9 | Light chain | K41A2 |
| RA9 | Heavy chain | G41A2 |
| RA10 | Light chain | K47A2 |
| RA10 | Heavy chain | G47A2 |
| RA11 | Light chain | K47E2 |
| RA11 | Heavy chain | G47E2 |
| RA12 | Light chain | K47F9 |
| RA12 | Heavy chain | G47F9 |
| RA14 | Light chain | L13G5 |
| RA14 | Heavy chain | G13G5 |

TABLE 24

Antibodies used in lung cancer Tissue IHC and flow cytometry of lung cancer cell lines

| Antibody | Chain Type | Clone |
|---|---|---|
| LC1 | Light chain | K8B8 |
| LC1 | Heavy chain | G8B8 |
| LC5 | Light chain | K10G5 |
| LC5 | Heavy chain | G10G5 |
| LC6 | Light chain | K8D6 |
| LC6 | Heavy chain | G10H2 |
| LC7 | Light chain | L8D9 |
| LC7 | Heavy chain | G8D9 |
| LC9 | Light chain | L10A1 |
| LC9 | Heavy chain | G10A1 |
| LC10 | Light chain | K9C11 |
| LC10 | Heavy chain | G9C11 |
| LC11 | Light chain | L10A6 |
| LC11 | Heavy chain | G10A6 |
| LC12 | Light chain | L9C9 |
| LC12 | Heavy chain | G9C9 |
| LC13 | Light chain | L9B1 |
| LC13 | Heavy chain | G9B1 |
| LC14 | Light chain | L9A1 |
| LC14 | Heavy chain | G9A1 |
| LC15 | Light chain | K10A9 |
| LC15 | Heavy chain | G10A9 |
| LC16 | Light chain | K10D2 |
| LC16 | Heavy chain | G10D2 |
| LC17 | Light chain | K8D5 |
| LC17 | Heavy chain | G8D5 |

TABLE 24-continued

Antibodies used in lung cancer Tissue IHC and flow cytometry of lung cancer cell lines

| Antibody | Chain Type | Clone |
|---|---|---|
| LC18 | Light chain | L10D5 |
| LC18 | Heavy chain | G10D5 |
| Flu14 | Light chain | L51A6 |
| Flu14 | Heavy chain | G51A6 |

TABLE 25

Antibodies used in S. aureus surface staining

| Antibody | Chain Type | Clone |
|---|---|---|
| S1 | Light chain | K3G4 |
| S1 | Heavy chain | G3G4 |
| S2 | Light chain | K4C4 |
| S2 | Heavy chain | G4C4 |
| S3 | Light chain | K15C6 |
| S3 | Heavy chain | G15C6 |
| S4 | Light chain | K15G1 |
| S4 | Heavy chain | G15G1 |
| S6 | Light chain | K3E11 |
| S6 | Heavy chain | G3E11 |
| S7 | Light chain | L4B8 |
| S7 | Heavy chain | G4B8 |
| S8 | Light chain | L4D2 |
| S8 | Heavy chain | G4D2 |
| S9 | Light chain | L4D6 |
| S9 | Heavy chain | G4D6 |
| S10 | Light chain | L4F4 |
| S10 | Heavy chain | G4F4 |
| S11 | Light chain | L15D1 |
| S11 | Heavy chain | G15D1 |
| S12 | Light chain | L17C6 |
| S12 | Heavy chain | G17C6 |
| S13 | Light chain | L17C9 |
| S13 | Heavy chain | G17C9 |
| Flu14 | Light chain | L51A6 |
| Flu14 | Heavy chain | G51A6 |
| Flu26 | Light chain | K52A2 |
| Flu26 | Heavy chain | G52A2 |

TABLE 26

Antibodies used in microneutralization assay

| Antibody | Chain Type | Clone |
|---|---|---|
| Flu15 | Light chain | L51C4 |
| Flu15 | Heavy chain | G51C4 |
| Flu16 | Light chain | K51G11 |
| Flu16 | Heavy chain | G51G11 |
| Flu18 | Light chain | K51D7 |
| Flu18 | Heavy chain | G51D7 |
| Flu19 | Light chain | K51D8 |
| Flu19 | Heavy chain | G51D8 |
| Flu20 | Light chain | K51G10 |
| Flu20 | Heavy chain | G51G10 |
| Flu21 | Light chain | L49A9 |
| Flu21 | Heavy chain | G49A9 |

TABLE 27 antibodies used in staph inhibition assay

| Antibody | Chain Type | Clone |
|---|---|---|
| S6 | Light chain | K3E11 |
| S6 | Heavy chain | G3E11 |
| S9 | Light chain | L4D6 |
| S9 | Heavy chain | G4D6 |
| LC1 | Light chain | K8B8 |
| LC1 | Heavy chain | G8B8 |

TABLE 28 antibodies used in staph IP

| Antibody | Chain Type | Clone |
|---|---|---|
| S1 | Light chain | K3G4 |
| S1 | Heavy chain | G3G4 |
| S2 | Light chain | K4C4 |
| S2 | Heavy chain | G4C4 |
| S3 | Light chain | K15C6 |
| S3 | Heavy chain | G15C6 |
| S4 | Light chain | K15G1 |
| S4 | Heavy chain | G15G1 |
| S5 | Light chain | K17C3 |
| S5 | Heavy chain | G17C3 |
| S6 | Light chain | K3E11 |
| S6 | Heavy chain | G3E11 |
| S7 | Light chain | L4B8 |
| S7 | Heavy chain | G4B8 |
| S8 | Light chain | L4D2 |
| S8 | Heavy chain | G4D2 |
| S9 | Light chain | L4D6 |
| S9 | Heavy chain | G4D6 |
| S10 | Light chain | L4F4 |
| S10 | Heavy chain | G4F4 |
| S11 | Light chain | L15D1 |
| S11 | Heavy chain | G15D1 |
| S12 | Light chain | L17C6 |
| S12 | Heavy chain | G17C6 |
| S13 | Light chain | L17C9 |
| S13 | Heavy chain | G17C9 |
| Flu14 | Light chain | L51A6 |
| Flu14 | Heavy chain | G51A6 |

TABLE 29

Antibody used in staph mass spec

| Antibody | Chain Type | Clone |
|---|---|---|
| S4 | Light chain | K15G1 |
| S4 | Heavy chain | G15G1 |

TABLE 30

| Name | Sequence |
|---|---|
| RT oligo | CACGACCGGTGCTCGATTTAGTTAATTAA[sampleID]AGCGATCGCTGGG (SEQ ID NO: 796619) |
| RT oligo' | CTAAATCGAGCACCGGTCGTGTGGG (SEQ ID NO: 796620) |
| Fwd Primer (forkappa chain) | CGATTGGAGGGCGTTATCCAC (SEQ ID NO: 796062) |

TABLE 30 -continued

| Name | Sequence |
| --- | --- |
| Fwd Primer (for lambda chain) | TYTGTGGGACTTCCACTGCTC (SEQ ID NO: 796063) |

TABLE 31

| Name | Sequence |
| --- | --- |
| RT oligo | CACGACCGGTGCTCGATTTAGTTAATTAA[sample-ID]AGCGATCGCTGGG (SEQ ID NO: 796619) |
| Overlap-extension primer | CGTATCGCTCCTAGGAGCGATACGCACGACCGGTGCTCGATTTAG |
| LC Primer (for kappa chain) | CGATTGGAGGGCGTTATCCAC (SEQ ID NO: 796062) |
| LC Primer (for lambda chain) | TYTGTGGGACTTCCACTGCTC (SEQ ID NO: 796063) |
| HC Primer | TCTTGTCCACCTTGGTGTTGCTG (SEQ ID NO: 796350) |

TABLE 32

| Name | Sequence |
| --- | --- |
| RT oligo | CGTATCGCTCCTAGGAGCGATACGTTAATTAA[sample-ID]AGCGATCGCTGGG (SEQ ID NO: 796621) |
| LC Primer (for kappa chain) | CGATTGGAGGGCGTTATCCAC (SEQ ID NO: 796062) |
| LC Primer (for lambda chain) | TYTGTGGGACTTCCACTGCTC (SEQ ID NO: 796063) |
| HC Primer | TCTTGTCCACCTTGGTGTTGCTG (SEQ ID NO: 796350) |

TABLE 33

| Name | Sequence |
| --- | --- |
| Univ_seq_2 | AACGCGTGACGAGAGACTGACAG (SEQ ID NO: 796319) |
| VK | ATGAGGSTCCCYGCTCAGCTGCTG G (SEQ ID NO: 796622) |
| VL | GGTCCTGGGCCCAGTCTGCCCTG (SEQ ID NO: 796623) |
| IgKC_v3_barcoded | AGGCCCTTACGACTGCGTCTTG AACAATACCAGATGGCGGGAAGATGAAGAC (SEQ ID NO: 796624) |
| IgLC_v5_barcoded | AGGCCCTTACGACTGCGTCTTGAACAATACCTCCCGGGTAGAAGTCAC (SEQ ID NO: 796625) |
| Fixed_PCR3 | AGGCCCTTACGACTGCGTCTTG (SEQ ID NO: 796626) |

TABLE 34

Co-expressed genes associated with B cell differentiation into memory B cells, short-lived plasma cell, long-lived plasma cells and antibody secreting cells.

| Generation of memory B cells | Generation of short-lived plasma cells | Generation of long-lived plasma cells | Antibody-secreting cells |
| --- | --- | --- | --- |
| PAX-5 Microphthalmia-assoc. transcription factor (MITF) | Blimp-1 X-box binding protein 1 (XBP-1) IRF-4 | Blimp-1 X-box binding protein 1 (XBP-1) IRF-4 BCMA | SLC7A7 CD36 IL6R BCL2L1 RPN2 IL21R PDIA4 IKZF1 IGHD BACH2 |

TABLE 35

Co-expressed genes associated with T cell differentiation into Treg, Th1, Th2, Th17 cells.

| Generation of Th1 | Generation of Th2 | Generation of Th17 | Generation of Tregs | |
| --- | --- | --- | --- | --- |
| T-bet | Gata-3 | RORγt | FoxP3 | GITR |

TABLE 36

Co-expressed genes associated with plasmablast homing to specific tissues.

| Homing of plasmablasts to the small intesting | Homing of plasmablasts to mucosal tissues | Homing of plasmablasts to skin |
| --- | --- | --- |
| CCR9 α4β7 | CCR10 | cutaneous lymphocyte-associated antigen (CLA) |

GENERAL REFERENCES

Burbelo, P. D., S. K. Browne, et al. (2010). "Anti-cytokine autoantibodies are associated with opportunistic infection in patients with thymic neoplasia." *Blood* 116(23):. 4848-4858.

Hua, J., K. Kirou, et al. (2006). "Functional assay of type I interferon in systemic lupus erythematosus plasma and association with anti-RNA binding protein autoantibodies." *Arthritis Rheum* 54(6): 1906-1916.

May, L. T., R. Neta, et al. (1993). "Antibodies chaperone circulating IL-6. Paradoxical effects of anti-IL-6 "neutralizing" antibodies in vivo." *J Immunol* 151(6): 3225-3236.

Mostbock, S. (2009). "Cytokine/Antibody complexes: an emerging class of immunostimulants." *Curr Pharm Des* 15(7): 809-825.

Robinson, W. H., C. DiGennaro, et al. (2002). "Autoantigen microarrays for multiplex characterization of autoantibody responses." *Nat Med* 8(3): 295-301.

Watanabe, M., K. Uchida, et al. (2007). "Anti-cytokine autoantibodies are ubiquitous in healthy individuals." *FEBS Lett* 581(10): 2017-2021.

Wildbaum, G., M. A. Nahir, et al. (2003). "Beneficial autoimmunity to proinflammatory mediators restrains the consequences of self-destructive immunity." *Immunity* 19(5): 679-688.

Wrammert, J., K. Smith, et al. (2008). "Rapid cloning of high-affinity human monoclonal antibodies against influenza virus." *Nature* 453(7195): 667-671.

SEQUENCE LISTING (796651 sequences)

SEQ ID NO: 1 - DNA, 532 bp, Homo sapiens
  misc_feature: GYAE6OF01C2IOX.14.21.B10.1.454.CMB.1.raw
  modified_base (335)..(335): a, c, t, g, unknown or other
  misc_feature (335)..(335): n is a, c, g, or t
  modified_base (344)..(344): a, c, t, g, unknown or other
  misc_feature (344)..(344): n is a, c, g, or t
  modified_base (426)..(426): a, c, t, g, unknown or other
  misc_feature (426)..(426): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggcttttcttgtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccgaggggaaggggctggaggtgggtctcgtgctattccnggcaggtgngatatcgaatacgtacgcagacctccggtgaacgggtccgttcacttgtttccagagacaattccaagaacacactgtatcngcagatgaccagcctagagacgccgaggaccgacggccgtatatacgtgtacgacgaaacgctaaagtgttttaggagttggttaattattaccgttgtcgttcgg

SEQ ID NO: 2 - DNA, 738 bp, Homo sapiens
  misc_feature: GYAE6OF01D42GV.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggcttattttaaaaggtgtgcagtgtgaggtgcagctgttggagtcgtgggggaggcttggtacagccgtggggggtccctgagactctcctgtgcagcctctggattcgtctttagcagctatgccatgagctgggctcgccaggctccgagggagggctggagtgggtctcgtgtctacgttccgtggcctagtggtagatactcgaatactacgacagacctccggtaggaacggggtcccggtttactaccgttcgtttcccgaaggaacgtaaacctaaactttacccgaaaagaaaccctaacctaacgttacgttaacgttccgttacgaccgtaaggtacgtaccgtaaccccgaaccggtacccgttagggaacgggaaccgggtacccgggaacgggaacccggtaacccgggtacccggttaaacgtttaaccgtttaccgttgggttacccggaaaccggtaaaaccccggtaccgttaaaaccgggtttaaaggttttttaggggtaacggttttacgggttttaaacttttaaccgtttaacccgtttttgggtaccccgttttacccggggg

SEQ ID NO: 3 - DNA, 215 bp, Homo sapiens
  misc_feature: GYAE6OF01ATW2P.14.21.B10.1.454.CMB.1.raw
  modified_base (173)..(176): a, c, t, g, unknown or other
  misc_feature (173)..(176): n is a, c, g, or t
  modified_base (178)..(215): a, c, t, g, unknown or other
  misc_feature (178)..(215): n is a, c, g, or t
tcagcgtctagtaccacgaccggtgctcgatttagtgtcgtcgcaggtaggtaggacggagcccagcccctgggattttcaggtcgttttcattcggtgatccaggacctgaacgagaggagaacgtcaccatggagtttggggctgagcgggctggcaaggccgcactaggnnnngnnnnnnnnnnnnnnnnnnnnnnnnnnnnnnnnnnnnnn

SEQ ID NO: 4 - DNA, 657 bp, Homo sapiens
  misc_feature: GYAE6OF01CG8FG.14.21.B10.1.454.CMB.1.raw
  modified_base (294)..(294): a, c, t, g, unknown or other
  misc_feature (294)..(294): n is a, c, g, or t
  modified_base (318)..(318): a, c, t, g, unknown or other
  misc_feature (318)..(318): n is a, c, g, or t
  modified_base (493)..(493): a, c, t, g, unknown or other
  misc_feature (493)..(493): n is a, c, g, or t
  modified_base (561)..(561): a, c, t, g, unknown or other
  misc_feature (561)..(561): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtggctttttcttgtggctaattttaaaaggtgtgcagtgtgaggtgcagctgttggagtcgtgggggagtctggtacagccgtgggggtccctgagactctcctgtgcagcctctggattcgtctttagcagctatgccatgagcgtggctcgccnggctccgagggaacgggcgtaggngtgggtctgtgtctacgttccgtggccaggttgtgtatacgttcgaaacttacgtaccgtacacggtaccgtaccggtagggaaacggggtcccgggtttaccacgtttcggtttaccaaggtaacggtaaacctaagttacccaaggaaacctactacgtagtacttctacggnaacgtataccgacaacgctcggaacgacggaccggacggaccgaccggtaaccgtattaacgttaccngggttacgaccggaaaacgtccctaaaggtttacggttttacggtaacgtttagggtttaactttacgtttaacctttggtaacgtttacccgggg

SEQ ID NO: 5 - DNA, 714 bp, Homo sapiens
  misc_feature: GYAE6OF01CPTOU.14.21.B10.1.454.CMB.1.raw
  modified_base (218)..(218): a, c, t, g, unknown or other
  misc_feature (218)..(218): n is a, c, g, or t
  modified_base (299)..(299): a, c, t, g, unknown or other
  misc_feature (299)..(299): n is a, c, g, or t
  modified_base (309)..(309): a, c, t, g, unknown or other
  misc_feature (309)..(309): n is a, c, g, or t
  modified_base (373)..(373): a, c, t, g, unknown or other
  misc_feature (373)..(373): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtggtcttttctgtggctatttaaaggtgtgcagtgtgaggtgcagtctggttggagtcggtgggggaggtcgttggtacnggccggtcgggggtccctggacgtcctctcctgtgcagcctcgtggtattccgttctttagcgtagctatcgaccagtcgngtcgtcggcnccgccgacggcgtccggaaggggacgggcgtagggtggtcgggtcttcgtgtcttcgttccggnggtacgtaggtggtagtaatacgtacgtaactaccgtacgactacgtaccggttaccggtagggtaaccgggtcccgttacgtacgtttacccggtttaacgaacggttaacgaaaccgttaaaacttaaccggaaaacgtaaaccctactaaccctttaggttaaacttccgtacgtaccgaaaggtacgttaccgaaccgttaccgacggtacgggaaacggtaccggaaccgggacggtaccgacggtaccttaagtacgtacgtcggaacgtaccgaaagttacgtaaagtttcggttaggtagttacgttacttacgttacgtcggtgttaccggg

SEQ ID NO: 6 - DNA, 705 bp, Homo sapiens
  misc_feature: GYAE6OF01ENYPU.14.21.B10.1.454.CMB.1.raw
  modified_base (171)..(171): a, c, t, g, unknown or other
  misc_feature (171)..(171): n is a, c, g, or t
  modified_base (191)..(191): a, c, t, g, unknown or other
  misc_feature (191)..(191): n is a, c, g, or t
  modified_base (339)..(339): a, c, t, g, unknown or other
  misc_feature (339)..(339): n is a, c, g, or t
  modified_base (359)..(359): a, c, t, g, unknown or other
  misc_feature (359)..(359): n is a, c, g, or t
  modified_base (413)..(413): a, c, t, g, unknown or other
  misc_feature (413)..(413): n is a, c, g, or t
  modified_base (441)..(441): a, c, t, g, unknown or other
  misc_feature (441)..(441): n is a, c, g, or t
  modified_base (480)..(480): a, c, t, g, unknown or other
  misc_feature (480)..(480): n is a, c, g, or t
  modified_base (485)..(485): a, c, t, g, unknown or other
  misc_feature (485)..(485): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcggtgtcgtttctaggtcggctaagttttaaaggngtgcagtgtgaggtgcgagngtgttggagtcggtagggggacggtcgtttaggtacgaacggtccggttggggggtccctaggacgaccgttctccttgtcgcgacgtccctcgtaggtacttccggttacttgctagctagtcgcatgacgtccgtggcctacgccnggccaccggaggggaacggngtggcggtgggtctctgtactcgtccgtggctagtgagtactgactagaccgtncacgtactcggtaggtcggtccgtactntcgttacagtactaacactacgaataaccatactgtacncgtanccgatacacgaacgtccgtaagcgaccggtacgaccgggacgttaaacccggccggttaacccgttaattaccgtttaaacccgggtaggttaaacccggtaacccggttaaaaccgtaacggttttaaacggtttacgggtttttaaacgggtaacggtttttacgttttaaaccggttttaaccgttacccggttttagggtaacccggtttcggggg

SEQ ID NO: 7 - DNA, 661 bp, Homo sapiens
  misc_feature: GYAE6OF01EREB3.14.21.B10.1.454.CMB.1.raw
  modified_base (503)..(503): a, c, t, g, unknown or other
  misc_feature (503)..(503): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtggtctttttcttgtggctattttaaaaggtgtgcagtgtgaggtgcagctgttggagtcgtgggggagcgttggtacagccgtgggggtccctgagactcctcctgtcgcagcctcgtggtactttcgttctttagcagtctagtgaccatgagcgtgggcctcgccgaggcctaccggaggggacggggcgtgggaggtcgggtctcgtcgtacttacgttccgtggacgtaggtggtagtattacgtacgaataacgtacgactaacggtaccgtaccggtagggaaccgggtccgttacgtacgttcgttacgaagtaccgtaactaacttaacgaaacgtaccactacgtagtactcgtnacagtacacgtacgaccgtactggaacgcggaccggacgtacggtacccgtacgttaattaccgttacacggttaacggaactaaccggacgttaagtttggtttaacggtagttaacggttttactaaccgtttcgtttacggacgtttacccgggg

SEQ ID NO: 8 - DNA, 769 bp, Homo sapiens
  misc_feature: GYAE6OF01AG3QH.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctgcttttcttgtggctattttaaaaggtgtgcagtgtgaggtgcagctgtggagtcgtgggggagtcgttggtacagtccggtcggggggtccctgagtactcgtcctgtgcacgcctcgtggtattcggttctttagcagtctatcgaccatggagtcgtcgggtctccggaccgacggtccgtccggaagggggaacggggtcggtagggtaggtcggggtccttcgtcggtacttacgtttccggtcgggtacgtagggttggttacggagtttaacgtaaccgtaaacgttaaccgtaaccggtacgtaacggtaaccccgtaccgggttacgggaaccggggttcccgtttacgtacccggtttcgttaccgaaggttaacaacttaacccttaacgaaacgaaacctaccgtataccgttataccgtagaaccaggtaatcccggaaaccgtaacgtccggaacgaacgggtacccggtaccggaacgggacccctacgggtaccttaaactacggttacctaggtaacccgaacggtaaaccgttcggttaaaaggtttaccggttttaaggtcggtttaaacgtttacgtttaagtttccccgtttagggttccttaccggggg

SEQ ID NO: 9 - DNA, 683 bp, Homo sapiens
  misc_feature: GYAE6OF01ASLGL.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggcttaattttaaaggtgtgcagtgtgaggtgcagctgttggagtcgtgggggagtcttggtacagccgtggggtccctgacgctctccgtgtgcacgtcctcgtggtacttcgttctttagcagtctatgaccagtgagcgtcgggctccggccgacggccgtaccggaggggacggggcgtagggagttcgggtctcgtgtctagttccgtggacgtaggtggtagattacgtacgtaaacttaccgtacgaccgaagtaccgttccggtacgggaacggggtcccggtttactaccgtttcggtttaccgaaggtaacgtaacctaaacgttaccgaaaacgtaaccacgtactagtactcgtcgacgagtactacgaccgacgcctaggacgacggaccgaacggtaccgtaccggaccgttagtacttacggtacggtaccggaacgtaaacccgacgttaaaggttacgttttacggtacggtttagttttacttacgttaccgttttacggtaccgttaccgggg

SEQ ID NO: 10 - DNA, 712 bp, Homo sapiens
  misc_feature: GYAE6OF01B1LIN.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggtctttttcttgtggcttattttaaaaggtgtgcagtgtgaggtgcagctggttggagtcgtgggggaggcgttggtacagccgtgggggtccctgagactctcctgtgcagcctcgtggattcgtctttagcagctatgccatgagtcgtgggctcgccgaggcctccggaggggaagggctgggaggtcgggtctcgtgtacttagttccgtggcgtaggttggtgtaatagtacgtaatacgtacgacgacgtaccgtcggtacggtaacgggtcccgttcgaactttggtttacccgaaggtacgtaacctaaacgttacccgaaaacgtaaccaacttaccgtaggttacgttaccgtgaccgaaggtaacttacccggaccctacggaccgttacggaacggtaaccggaccgggaacggaaccgaccgggttacccgtaagttaaccgttcgtacggttaacggaaacccggtaaacgacccggtttaaagtttaccggtttttagggtaacggtttacggttttaactttaaacccgtttccgtttacggtccggtttaccgggg

SEQ ID NO: 11 - DNA, 733 bp, Homo sapiens
  misc_feature: GYAE6OF01B9OOB.14.21.B10.1.454.CMB.1.raw
  modified_base (574)..(574): a, c, t, g, unknown or other
  misc_feature (574)..(574): n is a, c, g, or t
  modified_base (598)..(598): a, c, t, g, unknown or other
  misc_feature (598)..(598): n is a, c, g, or t
tcagcgtctagtaccacgaccggtgctcgatttagtgtcgtcgcaggagagaggagcccagccctgggattttcaggttgttttcattcggtgatcaggactgaacagagagaactcaccatggagttgggctgagctggtctttttcttgtggcttaattttaaaaggtgtgcagtgtgaggtgcagcttggttggagtcggtgggggagtcgttggtacgacggtccggttcggggggtccctggacgtaccgtccgttccgttggtcgaccacggtccttccgtgggtacttcgttacgtttagcctagtactagtcgccagttcgacggtcgtcgggcctccggaccgacggtccgtacggtaacgggggaaggggccgtagggacgggttcgggtcttcgtcgttacgttcgttccgtaggacggtaggtgggtactaagttacgtaacgaaacctacgtaaccgtcgaaccggtacgtacccggtaagggtaaccgggttcccgggtttacctaaccgtttccggttaaacccgaaggtaaccgttaagtaaacctaacccgtaaaanaaccgtactacgtgttaactcganaccgagactagaacccgttgcgtacgagaccgtaccgacgaaccgcgtacgtatacgttacgcgtaacgacggtaactaacgtggttacgtttaggtattaggtttacttacggttcgtacgttcggttaacggg

SEQ ID NO: 12 - DNA, 771 bp, Homo sapiens
  misc_feature: GYAE6OF01EBSJS.14.21.B10.1.454.CMB.1.raw
  modified_base (210)..(210): a, c, t, g, unknown or other
  misc_feature (210)..(210): n is a, c, g, or t
  modified_base (593)..(593): a, c, t, g, unknown or other
  misc_feature (593)..(593): n is a, c, g, or t
tcagcgtctagtaccacgaccggtgctcgattttagtgtcgtcgcaggagagaggagcccagccctggattttcaggtgtttttcattcggtgatcaggactgaacagagagaactcaccagtggagtttggctgagcgtgtcgtttttcgttgtggtcttaagttttaaaaggtgtgcgagtgtgagtgcagtctgttgagtcgtgggngtcgttggacgacgccgtcgggtcctgacgctctccgtgtcgcgacgtccgtcgtgtacgttcgttcgtttagcgtacgtcgttagtcgtacctagtcggacgtcgtcggtccgttaccggaccgtacggtcccgtaccgggaacggggtaacgggtccgtagggtcggtcggtttcgtcgtcgtacgtttacgttccgtggtacgtagttggtagtaacgtacgtaaccggtaaacttaccgtaccgtaacgtaccgaccgttcggtaaccgggtaacgggttcccgttaccgttaacgtttcccggttaaccgaaggtaaccgtaacttaaaccgttaaccgaaaacgtaacctaaccgttacgtagttactcgtacgaanacggttaccgcgtaaccgtgtaaccctaggacggccgaaaccggtacgaaccggtaccggttaaccttaagtaccgttaccggtaacgtaccgaagttaaacccgacggtttaatttacggtttaaggttacgtttaagtttacttaacccgtttcgttaacgtcggtttaacccggg

SEQ ID NO: 13 - DNA, 684 bp, Homo sapiens
  misc_feature: GYAE6OF01DBJIJ.14.21.B10.1.454.CMB.1.raw
  modified_base (245)..(245): a, c, t, g, unknown or other
  misc_feature (245)..(245): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (456)..(456): a, c, t, g, unknown or other
  misc_feature (456)..(456): n is a, c, g, or t
tcagcgtctagtaccacgaccggtgctcgatttagtgtcgtcgcaggagagaggagcccagccctgggatcttcaggtgttttcatttggtgatcaggactgaacagagagaactcaccatggagtttgggctgagttggctctttcttgtggcttaattttaaaagatgtccagtgtgaggtgcagctgttggaggtccgggggaggcgttggtaccgagggtcccgggggggtccctggaccnccttcctcctgtgcacgcctcgaggtatttctaatttttagcgtaaattactggccctaagttgacgtcgtcgggtcccgcacggcgtaccggaggggaagggcgtgggaggtgggtctgacgacgtaactcgaggttcgttacgttaaggtaggtaacgtactacgttcgaccgtccgtcgtccggtggacgggtcccgttcnctntccncgagacgaactacttacgaactaactcttacttacgtttactactaagtgacctagactaaggaaacgacgaagaccgtagggtacgttaggtttagttttcgaagtaagtaaagacgttaacgaagttatacgttagtaacccgttaacgttaaggttagggggtacgggtttacccttaggtacgttcgggttacggacggggtacccggagggtcggttacccgg

SEQ ID NO: 14 - DNA, 621 bp, Homo sapiens
  misc_feature: GYAE6OF01A3BY0.14.21.B10.1.454.CMB.1.raw
  modified_base (142)..(142): a, c, t, g, unknown or other
  misc_feature (142)..(142): n is a, c, g, or t
  modified_base (283)..(283): a, c, t, g, unknown or other
  misc_feature (283)..(283): n is a, c, g, or t
  modified_base (325)..(325): a, c, t, g, unknown or other
  misc_feature (325)..(325): n is a, c, g, or t
  modified_base (488)..(488): a, c, t, g, unknown or other
  misc_feature (488)..(488): n is a, c, g, or t
  modified_base (508)..(508): a, c, t, g, unknown or other
  misc_feature (508)..(508): n is a, c, g, or t
  modified_base (516)..(516): a, c, t, g, unknown or other
  misc_feature (516)..(516): n is a, c, g, or t
  modified_base (572)..(572): a, c, t, g, unknown or other
  misc_feature (572)..(572): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtgtnttttctagtggctaattttaaaggtgtgcagtgtgaggtgcagctgttggagtcgtgggggaggcgttggtacagccgtgggggtccctgagactctcctgtgcacgtcctctggattcgtcttagcagtctatgccatgngcgtcggctcgccgacggctccggaggggaacggcgtagggnggtggttctcgttgacgttacttccgtggcgtaggtggtgtactactacgaactacgtacgacagtcccgttacggaggtaaccggtccggttactacgtttcggttaccagaacggtactaaaccttaaccgaaactaaaccctacgaccttaaggtttccnctacggcaaatgacccgtanacccgttnaggacacggacgaacggacgtaccgggaccttaatacgtcgtgtacgaccgaaacncggttatttaggttgacgttttagttattacgttcttgcggttaccggg

SEQ ID NO: 15 - DNA, 748 bp, Homo sapiens
  misc_feature: GYAE6OF01DQWTW.14.21.B10.1.454.CMB.1.raw
tcagcgtctagtaccacgaccggtgctcgatttagtgtcgtcgcaaagagagaggggcccagccctgggattttcaggtgttttcattcggtgatcaggactgaacagagagaactcaccatggagtttgggctgagctggtctttttcttgtggcttaattttaaaaggtgtgcagtgtgaggtgcagctggttggaggttcgtggggggaggtcgtttgggtaccaggcccggttcgggggggtcccctggacgtaccttcctcctgtcgcacgcccttcgtggtactttccgttctttagcagtctatcgccagtgagtcgtgggcctccgccgaggccgtaccggagggggaagggcgtagggtaggtcgggtctcgtcgtcttacttccggtggcgtaggttggtataacgtacgtacgtaaactacgtacgacgacgtaccgtaccggtaggtaaccgggtccgttactacgtttcgttaccgaagtaacgtaacctaaacttacccgaaagaaaccctaactaccgttagttactacgtagacgtaggtactacggaacccgtacgtaccgtaggaacgacggacccggaagggaaccccgtaccggttacccgttaagttaaccttaacggtcggtaaaccggaacccgtaaacggtaccgtttaaaggtttggttttacgggtaagtttacgtttaactttacgttacccgttttcgaccggttttgggtaacccgggg

SEQ ID NO: 16 - DNA, 851 bp, Homo sapiens
  misc_feature: GYAE6OF01AU5MV.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggtctttttcttgtggcttaattttaaaaggtgtgcagtgtgaggtgcagctggttggagtcgtgggggaggtcgttggtacgacggtccggtcggggggtccctggacgtaccttcctccgtgtcgctacgcccttcgtcggtactttccgttcgtttagccgtagtctagtcgtcctagtcggaacgtcggtcgggcccgtccggaccgtaaggcccgtacccgggaagggggaacggggtcggtacgggtacgggttcggggttaccttcgtacgtaccttacgttccgtcgggtaccgtaggttgggtagtaaacgttacgtaacgtaaacgttaaccgtaccggtaaccgtaacggtaccgttaccggtacgggtaaccgggttcccgttaacgttccgttacggtttaacccaacggtaacgtaaaccgttaaccgttaaccgaaaacgtaacctaacgtacgttacggttaaactccgtagtaaccgtaagtacgtaaccgacccgtaacggaccttaacgggaacggttaaccggaaccgtaaaccgggacccgtaacccggttaacgttaaacttaaggtttaacccgtagggtaacccggtaaaccggaaaccggttacgtttaaacggtttaacggttttaggtaacggtttaacgttttaagttaaaccccttttggtacccggttcggtttaacccgggg

SEQ ID NO: 17 - DNA, 680 bp, Homo sapiens
  misc_feature: GYAE6OF01D6AFS.14.21.B10.1.454.CMB.1.raw
  modified_base (174)..(174): a, c, t, g, unknown or other
  misc_feature (174)..(174): n is a, c, g, or t
  modified_base (182)..(182): a, c, t, g, unknown or other
  misc_feature (182)..(182): n is a, c, g, or t
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (299)..(299): a, c, t, g, unknown or other
  misc_feature (299)..(299): n is a, c, g, or t
  modified_base (308)..(308): a, c, t, g, unknown or other
  misc_feature (308)..(308): n is a, c, g, or t
  modified_base (351)..(351): a, c, t, g, unknown or other
  misc_feature (351)..(351): n is a, c, g, or t
  modified_base (375)..(375): a, c, t, g, unknown or other
  misc_feature (375)..(375): n is a, c, g, or t
  modified_base (388)..(388): a, c, t, g, unknown or other
  misc_feature (388)..(388): n is a, c, g, or t
tcagcgtctagtaccacgaccggtgctcgatttagtgtcgtcgcaggagagaggagcccagccctgggattttcaggttgtttttcattcggtgatcaggactgaacagagagaactcaccatggagtttgggctggaggcggtgtcgtttcgtaggcggctaaatttaaaggntgcagtgngnggtncngcgtgttggngtcggtggggagtcgttggacgcggccggtcgggggtccctggacgtctcctccgtgtcgcacgtcctcgtggtacttcgttccttaggctcgtcttancgtcatggngtcggacggctacggcgtcgcgacgggagggacggtgtcgggnggtcggtctcgcggtctagttcgngagtaggtcagtntaccagtaactccgagcgtaaccggtcgtacggtacggggacggtttacccgtacgttcgttaccgttacgaacgtaactaacggttaacctaacgaacgtacaacggttcttaaggtacttacggtcgacgtaacgttacaccgaacgtcgacgtacggacgtacggacggacgtaccggtacgtacctagttacgtacgtacggacgtaccggaagttaccgggttaatttaccgggttaaggttaccgttagttaacgttacgtttacgtcggtttcggttacccgggg

SEQ ID NO: 18 - DNA, 814 bp, Homo sapiens
  misc_feature: GYAE6OF01DE7CR.14.21.B10.1.454.CMB.1.raw
  modified_base (585)..(585): a, c, t, g, unknown or other
  misc_feature (585)..(585): n is a, c, g, or t
tcagcgtctagtaccacgaccggtgctcgatttagtgtcgtcgcaggagagaggagcccagccctgggattttcaggttgttttcattcggtgatcaggactgaacagagagaactcaccagtggtagtttgggctggagtcgttggttcttttttcgttggtggtactttaaagtttttaaaagggtggtagtcgtaggttggtggaggtcgcgaggtcgttggttgggaggttcgggtggggggaggtcgttagggtacgcgggtccgggtcgggggtcccgtaggacgtcttctcgtgtcgcgcgtccgtcgtcgttacgttcgttcttagcacgtactatcgaccagtaggcggtcggtcggccgtccggaccggtacgggtccggtaaccggggaaggggtacgggtcgggtggggtacggttcggtctcggttacgtcgttacgttccggcggtggtagggtgtagtacgtagtacgtaacacggtcgacgtacgtcccggtacggtaccgggtacggttaccgttcgacttccggtaaccgataaccgaattaaccgaaccaagacctactacggttncgttacgagacgtacgtcgtaacgacgtaacgtggaacggaggtaccggtaaacgggaccgaccggtttaccggtacgtttacgttaacggttcccaaagggttaaacccgggtaacccgtaaccgggtttaaagtttgggttttacccgggttttaaaagggttcgttttaaaccgttttaacggtttaccctttaaccgggttaccggtttcggggttacccggggg

SEQ ID NO: 19 - DNA, 878 bp, Homo sapiens
  misc_feature: GYAE6OF01BT9VI.14.21.B10.1.454.CMB.1.raw
tcagcgtctagtaccacgaccggtgctcgatttagtgtcgtcgcaggagagaggagcccagccctgggtattttcaggttgttttcattcggtgatcaggactgaacagagagaactcaccagtggagtttgggctgagctggtctttttcttggtggtcttaagttttaaaggtgtgctagtgtggaggtgcgagtcgttggttgggaggttcgggtgggggtaggtcgttgggtaccgacggtccggttcggggggtccctggacgtaccttccgtcctggtcgcgtacgtcctcgtgtactttcgttctttacgcgtaacgtctagtccgacctaagtggacgtcggtcgggcccgtaccggccgacggtccgtaccgggaaggggaacggggtcggtagggtacgggttcgggtccgttacgtcgttcgttacgttcccggtaggtcggtaaggttcggtacgtaacgttacgtaacgtaacgtaccgtacggtaccgaacgtacccggtacggtaacgggtaccgggttaccgtttccgttaacgtttccggttaaccgtaaggaaccttaaccgtaaaccttaaaccggaaactaaaccgacccgtttacgtaacgttaaccgtcgtaacacgtaacggtacgaccgaacccgtcgtcccgtaaggaacccggaaccgggaacccgaacggggtaaccccgtaccgggtaactttaacgttacccggttacgtaccggggttaaacccaacccgggttaaaaccggtaaaccgtttagggttttaacgtttttacgggggtaaagttttttaaacggttttacctttaacccgggtttacttttaccgggggtacccgtttaacccgggggg

SEQ ID NO: 20 - DNA, 740 bp, Homo sapiens
  misc_feature: GYAE6OF01CZGQC.14.21.B10.1.454.CMB.1.raw
  modified_base (218)..(218): a, c, t, g, unknown or other
  misc_feature (218)..(218): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtggtcttttcttgtggctaattttaaaaggtgtgcagtgtgaggtgcagctggttggagtcgtgggggagtcttggtacnggccggtgggggtccctgacgtactctcctgtcgcacgtcctcgtcggtactttcgttacttttacgcgtaggtcttacgtcggaccctagttacggacggtccggtcggggtcccgttcccggaccggtacgggtccgtacccggggaaaggggggtaacggggtcggtaggggtacgggttcggggttcctttcggtcggttacttaccgttcccggtgggtacgtaggttgggtactacgtaacgttacgtaaacttaacgtacgactacggtcgtaccggtagggtaccgggtccgtttcgacgtttcgttaccgacgtaacgaaccttaaacgtaaccgaacgaacctacgtactagtactccgtagtaccgtaagtacgtaccgacgacgttccggaaggtacgggacggtaccggaaggacccgtacgttacgtattacgtcgtaggaccgaacggtactaacgtgtttacgtttgtacgttacggttactacgtttaccgttgtcgtaccgggg

SEQ ID NO: 21 - DNA, 718 bp, Homo sapiens
  misc_feature: GYAE6OF01CK70Z.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctaattttaaaaggtgtgcagtgtgaggtgcagctgttggagtcgtgggggaggcgttggtacagccgtggggggtccctggagactctcctgtgctagcctcgtggtattcgtctttagcagtctatgcctatgacgcgtgggacctcgccgacggctaccggaggggaacgggcgtagggacggtggtccttcgtcgtcttacgtccggtggccgtaggttggtacgtaattactacgtaaacttaccgtaacgtactacgtaaccggtccggtagggaaccggggtcccgtttaacgtaccgtttcgtttacccgaagtacgtaaacccgtaaactttacccgaaaaggtaaaccaccgtaacttggttaacttcgtgaaccgtaagtacgtacgaacctcgtaccgtaggaccgacggtaccggaacggacccgacggggtacccttaagttaacccgttagtacgggttacgaaaccgtaaacggaccgttaaaggtttcggttttaaagggtggttaacgtttaacttacgttttaaccggttgtaccgttaccggggg

SEQ ID NO: 22 - DNA, 841 bp, Homo sapiens
  misc_feature: GYAE6OF01ESQWE.14.21.B10.1.454.CMB.1.raw
  modified_base (221)..(221): a, c, t, g, unknown or other
  misc_feature (221)..(221): n is a, c, g, or t
tcagcgtctagtaccacgaccggtgctcgatttagtgtcgtcgcaggagagaggagcccagccctgggattttcaggttgtttttcattcggtgatcaggactgaacagagagaactcaccatggagtttgggctgagcgtgtcgttttctagtgtctaagtttaaaggtgtgcagtgtgaggtgcagctggttggagtcggtggggagtcgttaggtacngtccggtcggggtccctgacgtactcgtctgtcgcagtcctcgtaggtactttcgttactttagaccgtagtaaccgttgtccgaccgtagtcggacggtccggtcgggtacccgttacccggccgtacgggtaccgtaccggggaagggggtacggggtcggtagggtcgggttggttccttacgtcgtacttacgttcgcggtacgtaggttcggtagattaacgtacgtaaacgtaaccgtacgtaacgaacggttaccggtaccggttaaacgggtcccgggttaccgttaccggttaccggttttccgtttaaccggaaacggttaaccgtaaacgtttaaacccgtaaaccgtaaacgtaaacccgtaaactttacccggtaagttaccgtttacgtacgtaacgaacgtttaaccgaccggtaccgttacggaacgtacgggacgtacggaaccgggtaccgggtaacccgtaccggttacgttacgtttaacgtacgttacggtacggtaaaacccggtaacgttaaccggtttaaacgttttacggtttaggttaacggtttacgtttaacgtttaaccgttttacggttacggttaccggttacccgggg

SEQ ID NO: 23 - DNA, 878 bp, Homo sapiens
  misc_feature: GYAE6OF01D33GJ.14.21.B10.1.454.CMB.1.raw
  modified_base (603)..(603): a, c, t, g, unknown or other
  misc_feature (603)..(603): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggtctttttcttgtggtcttattttaaaaggtgtgcagtgtgaggtgcagctgttggagtcgtgggggagtcttggtacacggcccggttggggggtcccctggacgtactccgtccgtgtcgccacggtcctcgtggtacttcgttactttagctagtcctagtcgaccattggacgtccggtcggggtcccttccgggaccccgacggggaccccgttaccggggaaacggggggtaacgggggtccgttagggggacgggtttccgggggtttccctcgtttaccggtccgtttaaccgtttccggtagggtaccggtaaggttgggtagtaaccttacgtaacggtaaacttacccggttacgaccgtaggtacccggttcggtaagggtaaccggggtcccgttactacgtttcgtttaacccgaaggtaccaaacttaacgttaccaaaacgtaaaccnccttacgttagttaactcgtacgacgtagtacgtaacccgaccgtacggtcgaacggacggtaccgggaaccgggtaacggtacccgtaacccgggttactttaacgtttaaacggttccgtaacgggttaacccggaaaaccccggttaaaccgaccggtttaaaaagggttttttacgggttttaacgggtaaacggttttttaaccggttttaaactttttaacccggttttaaccgttttacggggttaacccgggtttaacccccggggg

SEQ ID NO: 24 - DNA, 835 bp, Homo sapiens
  misc_feature: GYAE6OF01EJPES.14.21.B10.1.454.CMB.1.raw
tcagcgtctagtaccacgaccggtgctcgatttagtgtcgtcgcaggagagaggagcccagccctgggattttcaggtgtttttcattcggtgatcaggactgaacagagagaactcaccatggtagtttgggctgagctggtctttttcttgtggcttaattttaaaaggtgtgcagtgtgaggtgcagctggttggagtcggtgggggaggtcgttgggtacacggtccggttcgggggggttccctggacgtacttccttccgtggtcgcgacgtccttcgtgtacttcgttctttacgctaggtcctatcgcctagtacggagtccggttgggcctccgggtaccgacgggtcccgtaccgggaacggggggaaggggtccgttagggggtacggtttcggggttcctccgttcggtacccgtttaacgtttcccggtgggaccgttaagggttcgggttaagtaacgttacgttaacggtaaaacttaaccgtaaccggacccgtaaacgggtacccgtttaccgggtaacggggtaaccggggtttacccggtttaccgttaaccgtttcgggttttaccccgaacgggttaaacgtaaacccgtttaaaaccgttaacccgaaaaacggtaaaccctaaccgttaaccgtttagttaaccgtcgttacgacgtaagtaccgtaccgacgtaccgtaccgtagggacgaccggaaccgacggaacccgacggtactagttactaccggtgtaccggactaaaccggccgttaaagttcggtttaaggagttttacgttactttaacgtttaccgttagtccgttcgggg

SEQ ID NO: 25 - DNA, 811 bp, Homo sapiens
  misc_feature: GYAE6OF01DLTBW.14.21.B10.1.454.CMB.1.raw
  modified_base (175)..(175): a, c, t, g, unknown or other
  misc_feature (175)..(175): n is a, c, g, or t
tcagcgtctagtaccacgaccggtgctcgatttagtgtcgtcgcaggagagaggagcccagccctgggtatttttcaggttgtttttcattcggtgatcaggactgaacagagagaactcaccatggtgttggctgagctggtcttttcttgtgtcttaagttttaaaggtgtgnagttgtggaggtgcagtcgttggttgggtaggttcgggtagggggtacggtcgtttagggtacgtacggtcccgggtcggggggtccctaggacgtacttctccgtgtcgcctacgtcctcgtggtacttcgttacgttacgctacgtctagtcgacctagtcggtacggtccggttcgggtcccgtcccggtaccggaacgggtcccggtaaccgggggaaggggggtacggggtcggtaggggtagggtttccgggtcttcggtcgttaccgttaccgttccggtaggtacgtagggttaggtacgtaagttacgtaacgttaaacttaccgtacgtaccgtacggtacccgttaccggtaacgggaccgggtttccgttaacgttacgttaccgttacgtaacgtaacgtaactaaaccgtaaccgtaaacgaacctaacgtacgttacgttactacgtacgtacgtacgacgtacgaccgtacgacgtacggacgacggaccgacggtacgaccgtacgtacgttactacggggggggggggtactacggtaaccgtaacgtacgttaagtttacggtttaggttaggttagttttacgtttaccgtttaccgttcggttccggttaccggg

SEQ ID NO: 26 - DNA, 511 bp, Homo sapiens
  misc_feature: GYAE6OF02IGO0B.14.21.B10.1.454.CMB.1.raw
  modified_base (381)..(381): a, c, t, g, unknown or other
  misc_feature (381)..(381): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtgcgttttctaggtggctattttaaaggtgtgcagtgtgaggtgcagctgttggagtctgggggaggcttggtacagcctggggggtccctgagactctcctgtgcagcctctggattcgtctttagcagctatgccatgagctgggctcgccaggctccgaggggaaggggctggagtgggtctctgctattcctggcagtggtgatatcgaatctacgcagactccgtgaagggcccgttnactgtttccagagacattccaagaacacactgtatctgcagatgacagcctgagagcgaggacacggccgtatattactgtgcgaacgccaaagtattttaggagttggtttattattactttgattcgg

SEQ ID NO: 27 - DNA, 533 bp, Homo sapiens
  misc_feature: GYAE6OF02FXNF0.14.21.B10.1.454.CMB.1.raw
  modified_base (331)..(331): a, c, t, g, unknown or other
  misc_feature (331)..(331): n is a, c, g, or t
  modified_base (436)..(436): a, c, t, g, unknown or other
  misc_feature (436)..(436): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcggtgtgtttctaggtggctaattttaaaggtgtgcagtgtgaggtgcagctgttggagtctgggggaggcttggtacagcctgggggtccctgagactctcctgtgcagcctctggattcgtctttagcagctatgccatgagctgggctcgccaggcctccgaggggaaggggctggagtggggtctctgctnttcctggcaggtggtgatactcgaatactacgcagactccgtagaacgggtccgtcactgtttcccagagacaattccaaagaacacacttgtaatctgcagatnacagcctgagacgccgacgacgacggcgtatattactgtgacgaacgacgaacgtagtttaggtagttaggttagttacttactttacgtacttcgg

SEQ ID NO: 28 - DNA, 565 bp, Homo sapiens
  misc_feature: GYAE6OF02G1O6J.14.21.B10.1.454.CMB.1.raw
  modified_base (141)..(141): a, c, t, g, unknown or other
  misc_feature (141)..(141): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtgngtttctaggtggctattttaaaaggtgtgcagtgtgaggtgcagctgttggagtctgggggaggcttggtacagcctggggggtccctgagactctcctgtgcagcctctggattcgtctttagcagctatgccatgagctgggctcgccaggctccgagggagggcctggagtgggtctctgctattccgtggcagtggtgatatacggaaattaccgtacggacagacctccggtaggaacgggtccggttacacgttcgtttccagtacgacaattaccaaagaacacactagtaactctgcagtatcggacagcctagagacgccgagacgacggtccgtatacttactggtacgacgaaccgtacgaacgttattttagggagtttggttaattacgttaaccgttttgaccttccggg

SEQ ID NO: 29 - DNA, 639 bp, Homo sapiens
  misc_feature: GYAE6OF02I0R6U.14.21.B10.1.454.CMB.1.raw
  modified_base (212)..(212): a, c, t, g, unknown or other
  misc_feature (212)..(212): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtgtgtttctaggtggctatttaaagatgtccagtgtgaggtgcagctgttggagtccgggggaggcttggtacngccggggggtccctgacactctcctgtgcagcctcaggtattcatttttagcgtaatatgccatgagctgggtccgccgaggctccgaggggaagggctgggagtgggtctcagcaatcgagttggttctagtggaagtactagtcgacgtccgtctccgtggtaacgggccggttctccattcctccagacgaactaataccaaagactactctactttctacaaatggaacagtacctagaaagacgaagaccgacgggacgttgttaattttggtagtacgtaaaagtagttaaacggtaaagttctaacgtacgtaaccttaacccgtaaagggtttttcggggacgggggttacccttttacgtaacgtttcggttacggttaccgggggacccgtaacgggggtaccgtccggttaccggg

SEQ ID NO: 30 - DNA, 594 bp, Homo sapiens
  misc_feature: GYAE6OF02HGSMA.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtctgggggaggcttggtacagccgtgggggtccctgagactctcctgtgcagcctctggattcgtctttagcagctatgccatgagctgggctcgccaggcctccgaggggaaggggctgggagtggggtctctgctattccgtggcaggtggtgatatcgaatactacgcagctccggtggaacgggccggttcacttcgtttccagagactaattccaaagaacacactgtatctgcagatcgaaccagcctaggacgacggacccggaaggacccgaacggaccgttaatacgttacgtaggttacggaaccgtaaaccggccgtaaaggtttacgtttttagggacggtttacgggtttaatttaacgtttacccgttttaggaccgtttaccggg

SEQ ID NO: 31 - DNA, 637 bp, Homo sapiens
  misc_feature: GYAE6OF02GMNJI.14.21.B10.1.454.CMB.1.raw
  modified_base (141)..(141): a, c, t, g, unknown or other
  misc_feature (141)..(141): n is a, c, g, or t
  modified_base (163)..(163): a, c, t, g, unknown or other
  misc_feature (163)..(163): n is a, c, g, or t
  modified_base (274)..(274): a, c, t, g, unknown or other
  misc_feature (274)..(274): n is a, c, g, or t
  modified_base (278)..(278): a, c, t, g, unknown or other
  misc_feature (278)..(278): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtgngtttctagtgctatttaaaggntgcagtgtgagtgcagctgttggagtctgggggaggcttggtacagcctgggggtccctgagactctcctgtgcagcctctggattcgtcttttagcagctatgccatggngcgnggcgcgcgcgcgtcgagggagggcgtggaggtcggtcgtcgtcgtcttcgttccgtcggtcgtggtggtagtatatacgtaacgtacgtacgacgtacgtaccgtaccggtacggtacgggtccggttcgtacgttacgtttaccgtaacgacgtaactaacttaaccgtaacgaaacctaacctacgtacgttactacgtcgacgacgacgtacgaccgacgtacgtacgagacggaccggacggaccgaccggtaccgtacgttacttacgtcgtacggtaacgtaaccgtaaccgtaacgttagtttaggttaggttaggtttaacgtttacgtttacgtttacgttacgttacgg

SEQ ID NO: 32 - DNA, 544 bp, Homo sapiens
  misc_feature: GYAE6OF02ILI8L.14.21.B10.1.454.CMB.1.raw
  modified_base (325)..(325): a, c, t, g, unknown or other
  misc_feature (325)..(325): n is a, c, g, or t
  modified_base (369)..(369): a, c, t, g, unknown or other
  misc_feature (369)..(369): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtggctttttcttgtggctattttaaaaggtgtgcagtgtgaggtgcagctgttggagtctgggggaggcttggtacagcctgggggtccctgagactctcctgtgcagcctctggattcgtctttagcagctatgccatgagctgggctcgccaggctccgaggggaaggggctggagtgggtctcngctatcctggcagtggtgatatcgaatactacgcagactccggnggaagggtccggttcacgttgtttaccagagaacaattaccaagaacaacactagtatctgaccagatgaccagccgtagagagaccgaggacgacggtacgtatacttactgtagcgaaacgcctaaagtacgtttttaggagttaggtttaattacgttacctttgacttcgg

SEQ ID NO: 33 - DNA, 557 bp, Homo sapiens
  misc_feature: GYAE6OF02GXPLY.14.21.B10.1.454.CMB.1.raw
  modified_base (251)..(251): a, c, t, g, unknown or other
  misc_feature (251)..(251): n is a, c, g, or t
  modified_base (341)..(341): a, c, t, g, unknown or other
  misc_feature (341)..(341): n is a, c, g, or t
  modified_base (490)..(490): a, c, t, g, unknown or other
  misc_feature (490)..(490): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtgcgtttctaggtggctattttaaaaggtgtgcagtgtgaggtgcagctgttggagtcgtgggggaggcttggtacagcctgggggtccctgagactctcctgtgccagcctntggattcgtctttagcagctatgccatgagctgggctcgccaggctccgagggagggctggagtgggtctctgctattcctggcagtggngatatcgaaatacgtacgcaacgactccggtagaacgggtccgtttcgacttcgtttaccagtagacaattccaaagaacacgactgtaactctagcagatcgaccaggacctgacgagaccgaggaccacgtccgtaatacgttacgngtacggaacaaaccgaccgtaagttagttttggacgtttaggttatacgttaccgtttgactttcgg

SEQ ID NO: 34 - DNA, 595 bp, Homo sapiens
  misc_feature: GYAE6OF02GJS1Y.14.21.B10.1.454.CMB.1.raw
tcagcgtctagtaccacgaccggtgctcgatttagtgtcgtcgcaggagagaggagcccagccctgggattttcaggtgttttcatttggtgatcaggactgaacagagagaactcaccatggagtttgggctgagttggctctttcttgtggctattttaaaagatgtccagtgtgaggtgcagctgttggagtccgggggaggcttggtacaggccggggggtccctgacactctcctgtgcagcctcaggattcattttagcgaatatgccatgagctgggtccgccaggctccgaggggaaggggctggaggtgggtctcgagcaatcagtggttctagtggaagtacattcgacgccgtcgtccgtggaacgggccgttctccatcctccagacgacaacttcccaaagaacactctatttcttacaaatgacagcctagaaacgacgaagacgacgggtcgtgttatttttagtgtagaaagtacgtaggacgtaagttctagtcgtaacgtaaccctaaggttttaggggaacggggttacctttcgagttcggtacgttcgggggaaccgtaggggtacctaccggg

SEQ ID NO: 35 - DNA, 681 bp, Homo sapiens
  misc_feature: GYAE6OF02IOXKK.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtgtcgttttcttaggtggctaattttaaaaggtgtgcagtgtgaggtgcagctgttggagtcgtgggggaggcttggtacagccgtgggggtccctgagactctcctgtgcagcctctggtattcgtctttagcagctatgccatgagcgtggctcgccaggcctccggaggggacgggctgggagtggtctgtgtctattccgtggctagtggtgatactacgaataccgtacgcgagtactccgtaggaacgggtcccgttactacgttcgtttacccgagtaacgtaacctaacttaaccgaaacgaaaccacctaacgttcgttaacgtcgtacgaccaagtagtaccgaacccgtaggacccgttaggaacggaccgggacccgggaacggaacccggtaacccgggaccgtttaacgttaacgtttaccgttagggtaaccgaaccggtaaacccggtaaccgtaaggtttaagtttttacgggaaggtttaggttttaactttaaccgtttaccgtttaggtacccgttttcgggg

SEQ ID NO: 36 - DNA, 530 bp, Homo sapiens
  misc_feature: GYAE6OF02IB8SE.14.21.B10.1.454.CMB.1.raw
  modified_base (424)..(424): a, c, t, g, unknown or other
  misc_feature (424)..(424): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtggctttttcttgtggctattttaaaaggtgtgcagtgtgaggtgcagctgttggagtctgggggagcttggtacagcctgggggtccctgagactctcctgtgcagcctctggattcgtctttagcagctatgccatgagctgggctcgcccaggctccgagggaaggggctggagtgggtctctgctatcctggcagtggtgatatcgaatctacgcagactccgtgaacgggccgttcactcgtttccagagacaattccaagaacacactgtactcagcagntacgaccagcctgagagccggagaccacgggacctatacttactgtagacgaaacgccaagttacgttttaggagttaggttattattaccgtttagacgtttcgg

SEQ ID NO: 37 - DNA, 588 bp, Homo sapiens
  misc_feature: GYAE6OF02F9UMF.14.21.B10.1.454.CMB.1.raw
tcagcgtctagtaccacgaccggtgctcgatttagtgtcgtcgcaggagagaggagcccagccctgggattttcaggtgttttcattcggtgatcaggactgaacagagagaactcaccatcggagtttgggctgagctggctttttcttgtggctattttaaaaggtgtgcagtgtgaggtgcagctgttggagtcgtgggggaggcttggtacagccgtgggggtccctgagactctcctgtgcagcctcgtggattcgtctttagcagctatgccatgagcgtgggctcgccaggctccgaggggagggctgggagtgggtctctgctattcctggcaggtggtgatatacgaatactacgcagacctccggtaggaacgggtccgttcacgtttcgtttccgaagacgaactaacttccaaagaaccacacttagtatctagcaagctacgacacgaccgtgacgacggaccgaaggaccgacggaccgtattacgttacgtggtacgaacggaaaccgtaccgtaaggtttacgttttggagtttacggtttaattacttacccgttttagacgtttaccggg

SEQ ID NO: 38 - DNA, 578 bp, Homo sapiens
  misc_feature: GYAE6OF02G3VMD.14.21.B10.1.454.CMB.1.raw
  modified_base (257)..(257): a, c, t, g, unknown or other
  misc_feature (257)..(257): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (399)..(399): a, c, t, g, unknown or other
  misc_feature (399)..(399): n is a, c, g, or t
  modified_base (432)..(432): a, c, t, g, unknown or other
  misc_feature (432)..(432): n is a, c, g, or t
  modified_base (457)..(457): a, c, t, g, unknown or other
  misc_feature (457)..(457): n is a, c, g, or t
tcagcgtctagtaccacgaccggtgctcgatttagtgtcgtcgcaagagaggagggagcccagccctgggattttccaggtgttttcattcggtgatcaggactgaacagagagaactcaccatggagtttgggctgagcgtgtcgttttctggtggctaattttaaaaggtgtgcagtgtgaggtgcagctgttggagtcgtgggggagcttggtacagccgtggggggtccctggacactctcctgtgcagcctntggattcgtcttagcagctatcgcatgagctgggctcgccaggctccgaggggagggctgggangggtctctgctatccgtggctaggtggtnactagtacgaatactacgacagacctccggtaggaacgggtccggttanacgttcgtttaccagtacgactaataccgaaanaacactactagtatctagacagtanacacgcggacctagagacggacgtacggacgacggtccgtaatagttactgaggaccgaaacgtccgaagttagttttgggaacgttggtttaacttattaaccgtttcgaacgttccggg

SEQ ID NO: 39 - DNA, 566 bp, Homo sapiens
  misc_feature: GYAE6OF02HK35I.14.21.B10.1.454.CMB.1.raw
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (373)..(373): a, c, t, g, unknown or other
  misc_feature (373)..(373): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtcgtgggggaggcttggtacagccgtgggggtccctgagactctcctgtgcagcctctggattcgtctttagcagctatgccatgagctgggctcgccaggctccgagggaggggctgggagtgggtctcgtgctattccgnggcaggtggtnatatcgaaatactacgcagactcggnggaacgggtccgttacacttgtttccagacgaactaacttaccaaagaacacactgtactcgtgacagatacgaccagcctgaacgcgaccggaggaccacggaccgttatacgttacgtgtacgaccgaaaccgacctaaagttacgttttaggagttaggtttaatttacttaccgtttgacctttacggg

SEQ ID NO: 40 - DNA, 612 bp, Homo sapiens
  misc_feature: GYAE6OF02F5G0C.14.21.B10.1.454.CMB.1.raw
  modified_base (350)..(350): a, c, t, g, unknown or other
  misc_feature (350)..(350): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtcgtgggggaggcttggtacagccgtgggggtccctgagactctcctgtgcagcctctggattcgtctttagcagctatgccatgagcgtgggctcgccaggctccgagggagggctgggaggtgggtctcgtgcttattccgtggctaggtggtnatatacgaaatacgtacgctaagacctccggtaggaaccgggtccgttacacgttcggtttccaaggtagactaattacccaaagaacacactcgttaatcgtgacagactcgacctacgcctaggacggacgccggaaggaaccgacgggtaccgttaattacgttacgtagtacggaaccggaaaccgtaccgtaaaggttacgtttttagggagtttacggtttaactttacgttaccgttttacggtaccgttccggg

SEQ ID NO: 41 - DNA, 625 bp, Homo sapiens
  misc_feature: GYAE6OF02IIBSC.14.21.B10.1.454.CMB.1.raw
  modified_base (287)..(287): a, c, t, g, unknown or other
  misc_feature (287)..(287): n is a, c, g, or t
  modified_base (562)..(562): a, c, t, g, unknown or other
  misc_feature (562)..(562): n is a, c, g, or t
  modified_base (595)..(595): a, c, t, g, unknown or other
  misc_feature (595)..(595): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagttgggctgagttggctctttcttgtggctattttaaaagatgtccagtgtgaggtgcagctgttggagtccggggaggcttggtacaggccggggggtccctgacactctcctgtgcagcctcaggattccattttagcgaatatgccatgagctgggtccncaggctcccagggaagggctggagtggtctcagacaagtcgagttggtactaggtggtaagtacattcggacgccgttcgccgttaggaaggggtcccgtttacacccattcctccgagggactaacgtacttaacccaaggtaaaccctagtacctttatttaccttacgaaacgttacgggaacaacggttaccctaaggaaaccgaacgtaaggaacaaggggtctagtttacgtttttagcgtagaaacggtataacggaaattcaagtanaacttacccgtaaggtttcgggagggtcctttnacgtggtcgtgggaccgtagggacctgtcg

SEQ ID NO: 42 - DNA, 644 bp, Homo sapiens
  misc_feature: GYAE6OF02IRE30.14.21.B10.1.454.CMB.1.raw
tcagcgtctagtaccacgaccggtgctcgatttagtgtcgtcgcaggagagaggagcccagtcctgggatcttcaggtgttttcatttggtgatcaggactgaacagagagaactcaccatggagtttgggctgagttggctctttcttgtggctattttaaaagatgtccagtgtgaggtgcagctgttggagtccggggaggcttggtacaggccggggggtcctgacactctcctgtgtagcctcaggattcatttttagcgtaaatatgccagtgagctgggtccgcaggctccgaggggaaggggctgggaggtgggtctcgaggcaaatcgagttggttacgtagtagggaatactagttcgaccggtccgtcgtacccggtgtaacggggtccgtttcgtccattccgtaccagaacgaactaacgttaccaaagtaaccaacttcttaacgtttcttactaaaacgttcggaacacgtactacggaaaacgaacgaaacggaccgaggggtcgttagttatttttaggtagttagaaagtataacgtaagtctatacgtaacttaccgtaagtttacggggagggtcctttacgagttacggttcgtacgggaccgtaaggggtccgtagtccggg

SEQ ID NO: 43 - DNA, 732 bp, Homo sapiens
  misc_feature: GYAE6OF02JP0Q5.14.21.B10.1.454.CMB.1.raw
  modified_base (189)..(189): a, c, t, g, unknown or other
  misc_feature (189)..(189): n is a, c, g, or t
  modified_base (196)..(196): a, c, t, g, unknown or other
  misc_feature (196)..(196): n is a, c, g, or t
  modified_base (201)..(201): a, c, t, g, unknown or other
  misc_feature (201)..(201): n is a, c, g, or t
  modified_base (543)..(543): a, c, t, g, unknown or other
  misc_feature (543)..(543): n is a, c, g, or t
  modified_base (550)..(550): a, c, t, g, unknown or other
  misc_feature (550)..(550): n is a, c, g, or t
tcagcgtctagtaccacgaccggtgctcgatttagtgtcgtcgcaggagagaggagcccagccctgggatttcaggtgttttcattcggtgatcaggactgaacagagagaactcaccatggagtttgggctgagctggtctttttcttggtggcttaattttaaaaggtgtgcagtgtgaggtgcagntgttggngtcgnggggagcttggacaggcccggttcgggggtcctagacgtaccttccgtccgtggtcgaccgtacggcccttgtaggtacttttccggttctttaggcctagtacttagtccgcctaggtgacggtcgtcggggccttccggaccgacgggacccgtacgggaacgggggtaacggggtcctttaggggcgggttccgggtcttcgtacggttccgtttacgtccggtggtacgtaggtgggttacgtaaattcggtactaagtaaccgtcgacgtaacggtaccgtcggtgggaaccggtcgttactacgttcggtacagacgtactacttacgaacgaacnctaagtntactcgagacgtaagaccgagtaacccgaggtccaggaacgtaccggacgtaacggaaccgtcggtaacgtacttaacggttcctaagggaccgaaaccggtaaacgtaccgtaaggttaacggttttagggaacgttttacggttatttaaacccggtttacttaccggttacgttacggg

SEQ ID NO: 44 - DNA, 782 bp, Homo sapiens
  misc_feature: GYAE6OF02IMBEW.14.21.B10.1.454.CMB.1.raw
  modified_base (256)..(256): a, c, t, g, unknown or other
  misc_feature (256)..(256): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtcgtgggggagcgttggtacaggccgtgggggtaccctggacgactctcctgtcgcagcctntggtacttcgtctttagctagctagtcgcctagtgacgcgtgggctcgccgtaggtccgtaccggaggggaacggggtctaggggtacgtcggggtctcgtcgtcttacgttccgtggtccgtaggttcgggtactaacgttacgtaccggtaaacttaccgtacggtaccgtaacggtacccgttacccgggtacggggtaaaccggggttccccggtttactaaccggtttccggttttaacccgaaggttaaaccggtaaccttaaaaccgtttaccgaaaacggtaaccctaacgtaccgttaggttaactaccgtcgaccgtaagtacgtacgaacccgtaggtaccgtggaaccgtcggaccggtaacggtaccgtaacgggtaccttaagttccgttacggtacggttaccggaacccggtaaaacccggtcgtttaaaggtttacgttttaaggggtaccgtttaacggttttaacttaacccggtttaccggtttacgtcccggttttaaccggggg

SEQ ID NO: 45 - DNA, 779 bp, Homo sapiens
  misc_feature: GYAE6OF02HWCAV.14.21.B10.1.454.CMB.1.raw
  modified_base (349)..(349): a, c, t, g, unknown or other
  misc_feature (349)..(349): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggctttttcttgtggctattttaaaaggtgtgcagtgtgaggtgcagctgttggagtcgtgggggaggcttggtacaggccgtcggggggtccctgagacctctccgtgtgcagcctctggtattcgttctttagcaagtctatcgccatgagcgtgggctcgccaggcctccgaaggggagggctggagtgggtctcgtgtctattccgnggctaggtgggtagactagtacgaaacttacgtaaccgacgaacgtaccgttccggtacggaacggggttcccggttaccgaaccgtttcggttttacccaagggtaaacgaaccttaaacgttaacccgaaaaggaaaccctaaacgtaaccttaggtttaaacgttccgttacggacctaaaagggtacgttaaccgggaacccccgttaaggtaccccgttaagggaaacggaaccgggaccccgggaaacggggaaaccccgttaaaccgggaccccgttttaacgtttaacgtttaccccgggtttagaccgggtaaaccggtaaaacccgggtaccgtaaaacggttttggtttttacgggaacggttttaaggttttaacttttaaaccgtttacccggtttttccggtaaccttttccgggg

SEQ ID NO: 46 - DNA, 941 bp, Homo sapiens
  misc_feature: GYAE6OF02G7OL8.14.21.B10.1.454.CMB.1.raw
tcagcgtctagtaccacgaccggtgctcgatttagtgtcgtcgcaggagaggaggagcccagccctgggattttcaggtgttttcattcggtgatcaggactgaacagagagaactcaccatggagtttgggctgagcgtggcttttctgtggctattttaaaaggtgtgcagtgtgaggtgcagctgttggacgtctggggagcttggtacaggcccgtgggggtccctgtacgaccttccgtcctgtcgcgacggtcctacgtggtacttcgttacttttacgacgtagtacttaagtcggaccctaagttcggaacgtcgtacggggtccgtaccggtacccggaacggtccgttacccgggaaaggggggtaaacggggtccggttaggggtaacggttcgggggttccgttcgttacggttaccgttaacgtttacccggtacggggtaccgtaacgggtttggggttacgtaaacgtttaaacgttaccggtaaaacgttacccgttaaacgggtacccgaaacgggttaacccggtttacccgggtaacggggtaaaccgggggtacccgggttttactaaacccggttttcggttttaccccgaaagggttaaccgaaacttaaaccgtttaacccgaaaagggttaaacccaaccgtacgttacgttaaaccgttacccgttacggaacgtacgttaaaccgtacgggaaaaccctcgggtaccccgttaagggtaccgggtaaaccgggacccggttaaaccgggacccgtaaccccggggtaaacctttaacgttaaccgtttaccgtaacggttacgggaaacccggttaaaaccgggaaccccgtaaaagggtttacgtttttaacgggtaacggtttacgggttttaacttaaccgggtttaccttttacggtaccgtttacccggg

SEQ ID NO: 47 - DNA, 732 bp, Homo sapiens
  misc_feature: GYAE6OF02GN3MW.14.21.B10.1.454.CMB.1.raw
tcagcgtctagtaccacgaccggtgctcgatttagtgtcgtcgcaggagagaggagcccagccccgggattttcaggtgttttcattcggtgatcaggactgaacagagagaactcaccatggagtttgggctgagcgtgtcgttttctaggtggctattttaaaaggtgtgcagtgtgaggtgcagctgttggagtcgtgggggaggcttggtacagccgtgggggtccctgacgctctctgcgcagcctctaggtattcgtctttagcagctatcgccatgagcgtgggcctcgccgaggcctccggagggaagggctagggtggtcgggtactcttcgacttacttccgtggcgtaggttggtagtatactacgtaaacttaccgtacggtaccgtaagtaccgttacggtagggaaccgggtttcccggttacctacgtttcgttacctaaggtaacgtaacctaacttacccgaaagaaccctaataccttagttaccttacgtcgaccgttaagaacttacgaccgtaccggtccgaacgggtaacgacccgggaaccggtaacggaacccgtaccggggtaacccgttaattttaaccgttaaccggtcgttaaccggaacccggtaaacgtaacccgttaagtttagggtttttaaccggtaaggttcgttttaaagttacccgtttaaccggtttacggttacccgtttcggggtacccgggg

SEQ ID NO: 48 - DNA, 770 bp, Homo sapiens
  misc_feature: GYAE6OF02F34B5.14.21.B10.1.454.CMB.1.raw
  modified_base (203)..(203): a, c, t, g, unknown or other
  misc_feature (203)..(203): n is a, c, g, or t
  modified_base (226)..(226): a, c, t, g, unknown or other
  misc_feature (226)..(226): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagcgtggtcgttttcttaggtggcttaattttaaaaggtgtgctagtgtgaggtgcaggtctggttggngttcgtgggggagtcttggtacngccgtgggggtccctgtagactctctcgtgcgcgtctcgtggactcgttcttagctagcttatgtaccagttgacgtcggtcgggtaccgtccgacccggagtcccgtaaccggagggggtaaggccggtgggtaggttgggttcctcggttacgtaccgtttaaccgttccgtacgggtaccgtaggttacgggtcgtaaagttaccggtacgtaaacgttaccggtaaccggtaaccgaacggttacccgttaccgggtaacgggtaacccgggtttcccgggttacccttaccggtttacggtttacccgagaaaccgtacgttaaacccgttaacaaaacgtaaaccctaacgtacgttaacgttcgttaacgtacggttacaaacgtcgttaccgaccttaacggacgtacgtacggaccgtaccggaaccgtacgaccggttacctaagttactcgtatacggaaccgtaacgaacttacggtttaagttacgggtaacgttagtttacgttaacttttacgtacgtcggttaccggg

SEQ ID NO: 49 - DNA, 772 bp, Homo sapiens
  misc_feature: GYAE6OF02GNYYF.14.21.B10.1.454.CMB.1.raw
  modified_base (419)..(419): a, c, t, g, unknown or other
  misc_feature (419)..(419): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggtctttttcttggtggtcttaagttttaaaaggtgtgcagtgtgaggtgcagctgttggtaggtcgtgggggaggtcgttggtacgacggccggtcgggggtccctgacgtaccttccgtccgtggtcgcacgtcctcgtaggtacttcgttactttacgcagtctagtcgcctatggacgtcgtcgggtcctccggtacccgacgggtaccgtaccgggaagggggaacgggtcggtagggtacggttcgggttctacggtcgtaccgttacttccggnggtcgtaggttggtataacttacgtaacgtaactacgtacgaccgtacgtaccgtccgggtaggtaaccgggtccgttctaccgttacgtttacgagaacgtacttaaacgtaccgaaacgaactacgtacttacgttatccgtagaacgtagtaacgtccgaccgtagtcccgtaggacggtaccgggaccgaacgggtaccgtaacccggttacgttaagttacccggttacgtacggttaacccggaacggttaaaccctaccgggtttaaggtttacgttttaaggggtacggttttaagttttacccggtttaattaccccgggttttagaaccccggttttcggggg

SEQ ID NO: 50 - DNA, 626 bp, Homo sapiens
  misc_feature: GYAE6OF02FYV02.14.21.B10.1.454.CMB.1.raw
  modified_base (343)..(343): a, c, t, g, unknown or other
  misc_feature (343)..(343): n is a, c, g, or t
  modified_base (460)..(460): a, c, t, g, unknown or other
  misc_feature (460)..(460): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggcttttcttgtggctaattttaaaaggtgtgcagtgtgaggtgcagctgttggagtcgtgggggaggcttggtacagccgtgggggtccctgagactctcctgtcgcacgcctcgtggtattcgtctttagcagctatgccatgagctggctcgcaggctccggaggggacggcgtgggagtcggtctcgtcgcttacttccgnggtccgtaggtggtcgtatacgtacgtaagtactacggactacgtaccgtccggtaggaacgggtccgttctacgttcgttaccagtagactactaccaagaaccacactgttaacnctcgacagactcgaaccagcctagagacgaccggtacgacctaccgggtacgtaacttacgtacgtcggttaacgacccggaaactaccggttaaagtttacggtttttagggaacgtttcggtttaaacttacggtttaacctttacggtaccgttttaccgggg

SEQ ID NO: 51 - DNA, 744 bp, Homo sapiens
  misc_feature: GYAE6OF02GDDTV.14.21.B10.1.454.CMB.1.raw
  modified_base (389)..(389): a, c, t, g, unknown or other
  misc_feature (389)..(389): n is a, c, g, or t
tcagcgtctagtaccacgaccggtgctcgatttagtgtcgtcgcaggagagaggagcccagccctgggattttcaggtgttttcattcggtgatcaggactgaacagagagaactcaccatggagtttgggctgagctggtctttttcttggtggtcttaagttttaaaaggtgtgcagtgtgaggtgcagctgttggagtcgtggggagtcgttggtacagccgtcgggggtccctggagactctcctgtgcagcctcgtggtattcgttctttagcagtctagtcgcctagtgagtcgtcggtctccgaccgtaggccgtaccggaaggggaacgggtccgtgggtaggtcgggtctcgtgtcttacgtccgtggcgtaggtcggtntaacgttacgtacgaaacgttaccgtaaccgacgtaacggtaccgttaccgggtacggggtaaaccggggtcccgtttacgacgtttaccgtttacgaacggtaacgtacctaaacgttacccgaaaacggtaactaccgtacgttaagttccgactacgggacctaagtactacgaacccgacggtacgtaggaacgtacggtaccggaacggtaacccttagggttaacgttaacttaacgtttaccggagtaacccgggtaaaccgtaaccgtaccggttaaagttttacggttttacggtaagggttttactttaaaccttcgtttaaccgttttagtacccggttacggg

SEQ ID NO: 52 - DNA, 586 bp, Homo sapiens
  misc_feature: GYAE6OF01EUR04.9.55.E11.1.454.CMB.1.raw
  modified_base (453)..(453): a, c, t, g, unknown or other
  misc_feature (453)..(453): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagccgaccggccctcagggactcccgtgagcgattctcaggctaccaactcgtagggaaaaccggccacccgtgaccatcacgcgagggtacgaaggccggggatggacggccgaactacttacgtgtcgagggtgtgggctggtagataangatcgagtgggtcgggggttgttcgggacgggacgggaccgaaggtcgtacggtacccggtaccgtaaggtccgaacggccccgaaaggcccgtaccgccccccgttacgggtccctaccgttccgttacccg

SEQ ID NO: 53 - DNA, 596 bp, Homo sapiens
  misc_feature: GYAE6OF01AV0IT.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagccgaccggccctcgagggactccccgtgacgcgattctcgaggctccaactcgtagggaaaaccggcccaccctgaccatcagcgagggtacgaacggccggggatggacggaccgactacttacgtgccgtaggtgtggactatattactccgtaccccggttggttccgggaccgggggtaccaacggcgtcggacccgtccgtacggtcaccggacccgaacggccgtccggcccccgttccggtcctaccgttccttccggttcccccacccctcctccgacgtacccg

SEQ ID NO: 54 - DNA, 534 bp, Homo sapiens
  misc_feature: GYAE6OF01B06KZ.9.55.E11.1.454.CMB.1.raw
  modified_base (480)..(480): a, c, t, g, unknown or other
  misc_feature (480)..(480): n is a, c, g, or t
  modified_base (506)..(506): a, c, t, g, unknown or other
  misc_feature (506)..(506): n is a, c, g, or t
  modified_base (526)..(526): a, c, t, g, unknown or other
  misc_feature (526)..(526): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaacatcattggaggtgttagtgtacactggtaccagcagaagccaggccaggcccctgtgctggtcctccatcatactagccgaccggccctcgagggactccccgtgacgcgattctcaggcctccaactcgtagggaaaaccggccacccgtgaccatcgagcgagggtcgaaggccggggatggacggccgactagttactgtcgaggtgtgggcgtgggtagataagtgatcgagtgggcggggttgtcgggnggaggacagcgtgaccgtctaagcgngcccaggcctcgcccctgcncgtctccg

SEQ ID NO: 55 - DNA, 751 bp, Homo sapiens
  misc_feature: GYAE6OF01DDM63.9.55.E11.1.454.CMB.1.raw
  modified_base (288)..(288): a, c, t, g, unknown or other
  misc_feature (288)..(288): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataactgtagaaagaaacatcagttggaggttgttagtgtacacgtggtaccaagcaagaagccaggccaggcccctgngcgtggtccctccatcatactagccgaccggccctagagggactccctagacgcgattcgtcgacggtctaccaactcgtaacgggaaaccgccacccgtgaacatacgacgcgagggtacgaacgggaccggggatacgggacggacccgtaacgttaacgtttaacccgtggtaccggtaaggggttcggtcggggtaccggttagggttacgtaagttaaacgttaggaacttacggtaagttggggtaccgggggggtttcggtttaccgggggacgggggaacgggggtaaacccgtaaacgggtaccgttaccggggaaccccgtttaaacccggtaaaaccgggtttcccgaaaaccgggttaccccccggaaaacgggtccccgttacccccggggttaccccccccgttccgggggttaaccccttaaccccgtttcccgtttacccccccggg

SEQ ID NO: 56 - DNA, 197 bp, Homo sapiens
  misc_feature: GYAE6OF01ARM8L.9.55.E11.1.454.CMB.1.raw
  modified_base (196)..(197): a, c, t, g, unknown or other
  misc_feature (196)..(197): n is a, c, g, or t
tcagtgatacgtctcacgaccggtgctcgatttagcactcgcacgttgggtttgggctggtgataatgatcatgcgggggtgttcggcggagggaccaagctgaccgtcctaagtcagcccaaggctgccccctcggtcactctgttccccaccctcctcagacgtatcactgagcgggctggcaaggcgcatagnn

SEQ ID NO: 57 - DNA, 564 bp, Homo sapiens
  misc_feature: GYAE6OF01ATDO7.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagccgacccggccctcgagggactcccgtgacgcgattctcaggctaccaactcgtagggaaaacgccaccctgaccatcagcgaggtacgaagccgggatggacggccgactattactgtcgaggtgtgggcgtggtgaataagtgatcgagtgggcggggttgttcgggacgggacgggaccaggcgtacggacccgtccgtaagtcgacgacccgaacggtccgtacccgcccccgttacggtcctaccgtccttacccg

SEQ ID NO: 58 - DNA, 684 bp, Homo sapiens
  misc_feature: GYAE6OF01DKYQC.9.55.E11.1.454.CMB.1.raw
  modified_base (669)..(669): a, c, t, g, unknown or other
  misc_feature (669)..(669): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtcgaccctcctatgtgctgactcacgcccacccgtcggtgtcaggtccggccccgaggagagaccggccaggaataacttgtagaaaagaaacatactagttgggaggttgttagtagtacacgttggtaccagcgaagaacgccgacggccgacggcccctgtcgcgtcggtcctccatcatactagccgaccggccctcgagggactcccgtagacgcgtacttctacgaggtcctaccaactcggtaacgggaaaccgcccacctcgaccatcagcgagggtacgaacgggccgggatacgggacggccgaacgttaacgtttaccgttggtaccggtaggggtttcgggtcggggtaccgttggggtaagtaattaacgtagtaactacgtaggttgggggtaccggggggtttggtttaccgggggacggggtaacggggaacccgtaaggccgtacggtacccggtacgtaagtccgaacgacccgtaaggccgtccccggcccccgtcggtacccncgttccgttccccgg

SEQ ID NO: 59 - DNA, 519 bp, Homo sapiens
  misc_feature: GYAE6OF01EEQCY.9.55.E11.1.454.CMB.1.raw
  modified_base (452)..(452): a, c, t, g, unknown or other
  misc_feature (452)..(452): n is a, c, g, or t
  modified_base (511)..(511): a, c, t, g, unknown or other
  misc_feature (511)..(511): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaacatcattggaggtgttagtgtacactggtaccagcagaagccaggccaggcccctgtgctggtcctccatcatactagcgaccggcctcagggactccctgacgcgattctcaggctccaactctacgggaaaacgccaccctgaccatcagcagggtcgaaggccggggatggaggccgatagttactgtcaggtgtgggctggtgatatgatcagtggcgggggtnttcgggcggagggaccaagctgaccggtctaagcacgccgaaggcctcgcccctggtcnctcgtccg

SEQ ID NO: 60 - DNA, 526 bp, Homo sapiens
  misc_feature: GYAE6OF01BODUJ.9.55.E11.1.454.CMB.1.raw
  modified_base (468)..(468): a, c, t, g, unknown or other
  misc_feature (468)..(468): n is a, c, g, or t
  modified_base (516)..(516): a, c, t, g, unknown or other
  misc_feature (516)..(516): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgatggtcctccatcatactagcgaccggccctcagggatccctgagcgattctcaggctccaactcgtacgggaaaacgcccaccctgaccatcagcgagggtcgaaggcggggatggacggccgactatactgtctaggtgtgggctggtgattaagtgatcgatgggtcgggggtgttccgggnggagggacagcgtacgccgtctaagcagcccgagcctcgcccctggcncgtcgtcccg

SEQ ID NO: 61 - DNA, 772 bp, Homo sapiens
  misc_feature: GYAE6OF01CC5RK.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcattggaggtgttagtgtacactggtaccagcagaagccaggccaggcccctgtcgctggtcctccatcatactagccgaccggccctcgacgggactcccgtgacgcgtattctcgaggcctccaacgtcgtacggggaaaaccgcccaacccgtcggaaccctactccaggaccgaacgggggtccgaaacggggcccgggggaatacgggacgggacccgtaacgttaacgtttaccgtggttaccgtaaggggttcgggtacggggtccttggggttacgaagtttaaaggtcggtaacgttccgtaaggggttcgggggtacccggggggggtttggtttacccggggggccggggtaaacgggggtaacccctaaaggggtcccggttaccggggtaaacccccgtttacccggttaaaccggttcccggtaaacccgggaccccccggtaaaaggggtcccccgttacccggggtaccccccccccggtttacggggttaccccctaacccggtttccccggtttcccccccggg

SEQ ID NO: 62 - DNA, 663 bp, Homo sapiens
  misc_feature: GYAE6OF01CX04C.9.55.E11.1.454.CMB.1.raw
  modified_base (482)..(482): a, c, t, g, unknown or other
  misc_feature (482)..(482): n is a, c, g, or t
tcagtgatacgtctcacgaccggtgctcgatttagcactcgcacgttgggtttggggcgtgggcctaaggaagcagcactggtggtgcctcagccatggcctggaccgttctcctcctcggcctcctctctcactgcacaggctctgtgacctcctatgtgctgactcagccacctcggtgtcagtcggccccaggagagacggccaggtataacttgtagaaagaacatcagttggaggtgttagtgtacagtggtaccagcagaacgccgaaggccacggcccctgcgcgtggtcctccatcatactagccgaccgcctagagggactcccgtgacgcgtattctcgaacggtctaccaactcggtaacgggaaaaccgcccaccgtacgaaccctagtacgagaccgtaacggggtaaccggacgggtaccggggtatacgggacggccggtaattacgttacgtgtacgagggttcgnggtcgtaggtcgtaataacgtgagttacgaggttcggggtagggggttcgttcggggacgggaacggaacccgaggttacccgtacggtaacccgtaccgtaacggtccgaaacggtaccccgtaacgggtccgttaccccggtacccccggttacgtaccacccgtttccggttaccccg

SEQ ID NO: 63 - DNA, 778 bp, Homo sapiens
  misc_feature: GYAE6OF01BAD0E.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctctatgtgctgactcagcctaccctcggtgtcaggtcggcccaggagagacggcaggatactgtagaaagaacatcagttggagtgttagtgtacacgtggtaccagacgaagaacgccgacggccgacggccccgtgtcgtcgtcggtccctaccactctactacgtacgcccggacccggtccctacgacgggtacctcccgaggacgtccgtacttccgtacgacggtccctaccgaacgtcggtaaacgggaaacccggcccctaacccgtacgaccacgtaccgacgtaccggtacgggtacggaaaccgggccggggtaacgtacggggaccggtacccgtaacgtttaagttaacccggttcggtaccggtagggtcgggtacgggtacgttgggtacgtaagttaaggtcgttaacggttaccggaagggtttccgggggtccggggggtttcgggttaccgggggaaccggggaaccggggtaaacccgtaacgggtccggtttaacccgggacccggttaacccgtaagggtaccccggaccggtaaccccggtaacgggtcccgtccccggttaccccccggtacgtacccgttacccggttcccgttaccccccg

SEQ ID NO: 64 - DNA, 788 bp, Homo sapiens
  misc_feature: GYAE6OF01DX9G8.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcacgccacccgtcggtgtcaggtcggcccgaggagagacggccaggataacttgtagaaaagaacatacagttggtaggttagttagtagtacacgtcggtaaccagacgaagaacggacccgaggacccgacggcccccgtggtcgccgttcggtccctcctaacttacctaagtaaccgtacggacccggacccggccctacgaacgggactcccgtggacgcgtacttcgtacgacgtcctaccgtaacgtacgtaacgggaaaccgaccctacccgacgtaaccacgtacgacggacggtacgggtaccggaacgggtaccggggtaacgtcgggtaacggtacccgttaacgtttaacgtttaccgggtacggttacgggtaggggttcgggtagggttcggtaagggttaagtaagttaacgtggttaacgtacggtaaggggttcgggggttacgggggtttacgggtaccgggggacgggtaacgggtaccggaacggtacccgtaaccgggttaacccggttacggtaacgacccggacccggacccggtaacggtccccggtacccggtcccccgttaccggttaccctacccgttcccggttaccccccgg

SEQ ID NO: 65 - DNA, 781 bp, Homo sapiens
  misc_feature: GYAE6OF01C91K8.9.55.E11.1.454.CMB.1.raw
  modified_base (238)..(238): a, c, t, g, unknown or other
  misc_feature (238)..(238): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtcgacctctatgtgctgactcacgcccacctcggtgtcaggtcggccccgaggagaaggaccggccaggataacgttgtagaaaagaaactntacagttggaggttgttagtgtacacgtaggtaccagacaggaacgccgtacggccacggcccctggtcgtccgtcggtccctctatctaataccgtaacggcccggaccggtccctagacgggtactccccgtaggacgtcgtactttccaccgacgtccctaaccgtaacgttacggtaaaccggggaaaccggcccctacccgtacggaaccctataccgaacggaccggtaacggggtaaccggaacgggtacccgggggtaagtacgggaccggtacccgtaagtttaaccgttacggtcgttacgggtagggttcgggtacgggttacggttaggtacgtaagttaagttagtacgttacggtaagggttcggggtacgggggtttacgggttaccggggacgggggtaaccgggtaaccggaaacggttcccggtaaccgggtacccgttaccggtaaggtacccgacggaccccgtaacgggttccctcccggttacccccgtagggtaccctcccgttcccgtttaccccccgg

SEQ ID NO: 66 - DNA, 614 bp, Homo sapiens
  misc_feature: GYAE6OF01EYMGK.9.55.E11.1.454.CMB.1.raw
  modified_base (348)..(348): a, c, t, g, unknown or other
  misc_feature (348)..(348): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagacgacggccaggataacttgtagaaagaacatcagttggaggtgttagtgtacactggtaccagcagaagccaggccacggcccctgtgctcggtcctccatcatactagccgacccggccctcgacgggactcccgtagacgcgattcncgaggcctaccaactcgtacgggaaaccgcccacctgaccatcgagcgagggtacgaacggccgggatcggacggccgtaactacttacgtgtcgagggttggtgggtcgttgggtatagtaagtgaagtcgaggtgggtcgggggttgttcggggacgggaacgggtaccgaaggtccgtacggtacccggttaccgtaagtccgacggaccccgacgggcccttcccgggaccccccgttggtccctccgttccgttcccccgg

SEQ ID NO: 67 - DNA, 779 bp, Homo sapiens
  misc_feature: GYAE6OF01DSTBT.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggccccaggagagacggccaggataacgttgtagaaagaaacatcagttggagtgttagtgtacatgtaccagcagaagccaggccacggcccctgtcgctcggtcctccatcatactacgccggacccggccctcgacgggactccccgtggacgtcggattccgtcgacggtctacccgaaacgtcgtaacggggaaaaccggcccaacccgtacgaacccactaccgacggtaccgtaacggggtaccggaaacgggtccgggggaattacggggaacgggtacccgtaacgttacgtttaaccgtacggtacggtaagggtttcgggtacggggtccgttaggggttagtaaagttaagttacggtaagttccggtaagggttcgggggtaccgggggggtttcgggtttaccggggggacggggtaaaccgggggtaacccgtaaacgggtacccggttaaccgggtaacccccgggttaccgttaaacgggtacccgtaaaccggacccccggtaaacgggtccccgttacccgggtacccccccgttaccgggtacccttaaccccgttcccgtttcccccggg

SEQ ID NO: 68 - DNA, 646 bp, Homo sapiens
  misc_feature: GYAE6OF01BLKZY.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaacatcattggaggtgttagtgtacactggtaccagcagaagccaggccaggccccctgtgctggtcctcatcatactagcgacccggccctcgagggactcccgtgacgcgtattcctcgacggcctaccgaactccggtacggggaaaacccggcccacccgtcgaccatcgagcgagggtcggaacggccggggatggacggccgacgttattacgtgtcgagggttgtgggctgggtagataagtgatcgagttaggggcgggggtttcggttccggggacgggaacggggacccgtaaagggccgttaaccgggtaccccggttaccgttaaacggtcccggaacggacccccggaaacgggtccgtccccgggtacccccccgttagggtcccctaccgtttcccgttaccccccgg

SEQ ID NO: 69 - DNA, 674 bp, Homo sapiens
  misc_feature: GYAE6OF01BQP0U.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaaagaaacatcagttggaggtgttagtgtacacgtggtaccagcgaagaagccaggccacggcccctgtcgctggtcctcgatcatactagccgaccggcctcgacgggctcccgtagacgcgtattcgacacggcctaccgaacttaccggtaacgggaaaaccgcccctacccgtacgaaccctataccgaaggaccgaacgggtaccggaaacgggcccggggtattacgggaaccggacccgtaattaacgttaccgttggtacgtaaggggttcgtacggggtcttagggtacgtaagtaagttcgaacgttacgagggtcggggtcgggggttcgttacggggacgggtaacggacgaacggtccgtacggtaacccgtcgtaacgtccggaacgacccgtaacggcccttacccggacccccgttaggtacctcgtccgttaccccg

SEQ ID NO: 70 - DNA, 666 bp, Homo sapiens
  misc_feature: GYAE6OF01B8OFO.9.55.E11.1.454.CMB.1.raw
  modified_base (351)..(351): a, c, t, g, unknown or other
  misc_feature (351)..(351): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcacgccaccctcggtgtcagtcgccccaggagagacggccaggataacttgtagaaagaaacatcagttggaggtgttaatgtacactggtaccagcagaagccaggccacggccccctgtcgctggtccctccatcatacgtagccgaccggccctcgagggacctcccgtgacgccgacttcncgaggtcctaccgaactccgaaggggaaaacccgcccacccgtcgaccctatcgagcgacgggtacgaaacgggcccggggatcgggacggaccgtaacttacttaccgtggtaccgtagggtcggtcgggtcttggggtataagtaacgtgacgttacgaggttcggggacgggggttcgggttacccggggacgggtaacgggaacccgaagggtccgtaacggtacccggttaccgtaacgttccaaccgggaccccgtaagggtcccctcccggccccccgttacggtccctaccgttcccgttcccccgg

SEQ ID NO: 71 - DNA, 712 bp, Homo sapiens
  misc_feature: GYAE6OF01C2V4D.9.55.E11.1.454.CMB.1.raw
  modified_base (225)..(225): a, c, t, g, unknown or other
  misc_feature (225)..(225): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctctatgtgctgactcagccaccctcggtgtcagtcggcccaggagagcggccaggataacttgtagaaagaacntcagttgggaggttgttagtgtacacgtaggtaccagacaaggaacgccgaacggccgacggtcccctggtcgtcgttcggtacctccattcatacgtacgccgaccgccgtacgacggtactcccgtagacgcgtacttcgctacggtccctaccgtaacgttacggaacgggaaaaccgtccctacccgtacgacctagtaccgaaggacggaagggtaccggacgggaccgggagtacggcggtacgtacttaactccgtgtacggtaggtggtcggtacgtgggtataacgttacgtagaaccttagtacgggtcggggtacgggggttgtaccggggacgggtaccggaaccgtaacggtccggtaccggtaacccgttaccggttaaggtacccgtaaccggaaacccgtaccgggtccccgttaacccggtcccccccggttaggtaaccccgtaccgtttcccggtttaacccccccgg

SEQ ID NO: 72 - DNA, 719 bp, Homo sapiens
  misc_feature: GYAE6OF01BMTEO.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaagaaacatacagttggaggtgttagtgtacactggtaccagcagaagccgaggccaggcccctgtcgctggtcctcatcatactagccgaccggccctcgaggactcccgtgagcgtattctcgaggcctaccgaactcgtaacgggaaaaccggcccacccgtacgaccactacgacgacggacgggtacgaacgggccggggagtaggacggaccgtacgttaacttacgtggtacgtacggggttggttacggggcgtttagggtacgtaagttaacgtggtaactaccggtaaggttccggggggttcggggggtttacgggtttccggggggaaccggggtaaccgggggaacccgtaaacgggtccggtttaaccggtaccccgggttaacccggttaaacggtaacccgaccggaacccccggaaacgggtcccgttccccggcccccccggtttacgtacccgtacccggtttcccgtttaccccccggg

SEQ ID NO: 73 - DNA, 748 bp, Homo sapiens
  misc_feature: GYAE6OF01BH73N.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctctatgtgctgactcacgccacccgtcggtgtcagtcggcccaggagagacggccagataacttgtagaaagaacatcagttggaggttgttagtagtacacgtggtaccagcagaacgccgacggccacggccccctggtcgccgttcggtccctaccgactacacttaccgacggccggtaccccgggccctacgacgggtaccttccccgtaggagcgtacttccgtacgacgtccctacccaacgtcggtaaacggggaaaccgccccacccgtacggaacctacgtaccacggtaccggacggggtaccggaacggggtaccggggtaagtacgggaccggtacccgtaacgttagttaccgttcggttacggtagggttggtcggggtcttggggtagtaagttaagtcggttagtaccggtggttagggggttccgggggttgggttacggggaccgggtaacgggaaccgacggttacgtacccggtaccgttaccgtaaccggtaccggtacccggaccgtaccggtacccgtccccggtacccccggttaccggttacccgtacccgttcccggtttaccccccggg

SEQ ID NO: 74 - DNA, 664 bp, Homo sapiens
  misc_feature: GYAE6OF01EWVUA.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgtgctggtcctccatcatactagccgacccggccctcgagggactccctggacgcgtacttcctacgacggtcctaccaacgtcgtaacggggaaaaccgcccacccgtgaccatcagcgagggtacgaacggccggggatacggacggaccgtactacgtttacgtggttacgagggtcggtcgggtcgtggtagtaataagtggaacttcgaagggttcgggtacggggggttggttaccggggacggggaacgggaaccgaacggtccgtaccgggtaccccggttaccgttaacggtaccgaaccggaccccgaaacgggtccccgttacccgggtaccccccgttaccgggtcccttaccgttcccgttaccccccgg

SEQ ID NO: 75 - DNA, 924 bp, Homo sapiens
  misc_feature: GYAE6OF01ESV0M.9.55.E11.1.454.CMB.1.raw
  modified_base (374)..(374): a, c, t, g, unknown or other
  misc_feature (374)..(374): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtcgaccttcctatgtgctgactcacgcccacccgtcggtgtcgaggtccggaccccgagggacggacggaccgggaccgtaagggtaacttaaacgtttaggtaagaaaaaggaacctagttacgtaaggtttagggaggtttaggtttaggttacgtaacgtacgttacggtaacccaggaccaaggaaccgccggacggccgacggtcccgtgcgtcgttcgtccncgatacatacgtacggccggtacccgcctggacgggacctccgagtacgcgtacttcgaccgacgtacccaccgtaacgtaccgggtaaacggggaaacccgacccctaacccggtacgaaaccccgtagtaccggtaacgggaccgggtaacggggtacccgggaacggggtacccggggtaacggttaccggggaaccgtacccggttaacggttaacgtttaccggtacgggttacggggttacgggttcgggtacggggtttaccgtagggggttaacctaaaggttaacgtacggttaaacgttccggggtaaggggtttccgggggtacgggggggttttccgggtaaccggggggtaccggggtaaaccggggtaaaccggttacccgggttaccggggttaacccgttaaacccggggtttacccggtaaagggtacccggaacccgggtaaccccggtaaacggttcccccccggttaccccggtcccccggttaaccgggttccccgttaaccccggtttccccgtttaaccccccccgg

SEQ ID NO: 76 - DNA, 889 bp, Homo sapiens
  misc_feature: GYAE6OF01AZ08R.9.55.E11.1.454.CMB.1.raw
tcagtgatacgtctcacgaccggtgctcgatttagcactcgcacgttgggtttggggctgggcctaaggaagcagcactgggtggtgcctcagccatggcctggaccgttctcctcctcggcctcctctctcactgcacaggctctgtcgacctcctatgtgctgactcacgcccaccctggtgtcgaggtcggccccgaggacgaggaccggccgaaggataacgttggagaaagaaacatactagttgggaggttgttaggtgtaacgtacgtacggtaccagcgaagaacgccgagggcccacgggcccccttaggtcgtaccgttcgggtcccctacctattccacttaaccgtacggacccggtacccggggccccttacgggaacggggtaccttaccccggtgaacggtccggtacttccgtccgacggtcccttacccgtaacgttacggtaaaccggggaaacccgccccgtaccccgtacggaaacccgtaagtaccgacgggtaccggtaacggggggttaccggaaaccggggtaccgggggtactaaccgggggaccggtaacccgtaagtttaacgtttaccgggtcggttacggtaaggggttcgggttcggggtacgttaggggttagaaacgtttacggtgtaaacgttcgggttaacggggtcggggggtttaccgggggggtttcgggtaccgggggaccggggtaaccggggtaaacccggtagttacccgggtaaccgggttaaccccggggttaccttaaaccgggggacccgttaaccccggggaccccgtaaaccggggttcccccgtaccccgggtcccccggtttacccgtcccgtaaccccgtttcccggtttacccccccg

SEQ ID NO: 77 - DNA, 839 bp, Homo sapiens
  misc_feature: GYAE6OF01CMMSV.9.55.E11.1.454.CMB.1.raw
  modified_base (429)..(429): a, c, t, g, unknown or other
  misc_feature (429)..(429): n is a, c, g, or t
  modified_base (817)..(817): a, c, t, g, unknown or other
  misc_feature (817)..(817): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctctatgtgctgactcgacgcccacccgtcggtgtcgtacggtccggacccccgagggacgacggaccgggacccgtaagggtaacttaaaccgtttaggtaaacggaaaaacgaaaaccgtagttaaccgtaggtttagggtagggtttaggtttaaggttcgtaacctaacgtcggttaacccaggacgaaggaacgaccggacggccgacggccccgttggtcgcgtcggtcccctcatccatacgacgccggaccgcctcgaacgggtctaccgngacgcgtacttcgacgaccggtacctacccgtaacgtacggtaaaccgggaaacccgtcccacccgtacgaacctacgtacgacggtacgggtacgggtaacgggaacgggacccgggggtagtccgggaaaccgggttacctaacgttaacgtttacgtcggggtacgtagggggttcggtacgggtcgtttaagggtactaacggtaaagttcggtaactaccggtagggttccgggggggtcggggtttacggtacgggggacccgggtaaacgggcccgtaaggtccgtcccggtaaacccggttcgttaaacggccgacccggttaccccggggaacttccccccggttaaccccggtccccccggtaaggtttaccccccgngttttccccccgtttacccccg

SEQ ID NO: 78 - DNA, 208 bp, Homo sapiens
  misc_feature: GYAE6OF01AZY0B.9.55.E11.1.454.CMB.1.raw
  modified_base (181)..(181): a, c, t, g, unknown or other
  misc_feature (181)..(181): n is a, c, g, or t
  modified_base (187)..(208): a, c, t, g, unknown or other
  misc_feature (187)..(208): n is a, c, g, or t
tcagtgatacgtctcacgaccggtgctcgatttagcactcgcacgttgggttgggctggtgataatgatcatgcggggtgttcggcgaggaccaagctgaccgtctaagtcagcccaaggctgcccctggtcactctcgttcccgcctcctcagacgtatcactgagcggctggcaaggcncatagnnnnnnnnnnnnnnnnnnnnnn

SEQ ID NO: 79 - DNA, 881 bp, Homo sapiens
  misc_feature: GYAE6OF01CM80Y.9.55.E11.1.454.CMB.1.raw
  modified_base (370)..(370): a, c, t, g, unknown or other
  misc_feature (370)..(370): n is a, c, g, or t
  modified_base (457)..(457): a, c, t, g, unknown or other
  misc_feature (457)..(457): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctctatgtgctgactcacgcccaccctcggtgtcagtcggcccaggagacggacggccaggataacgttgtagaaaacgaacatcaagttgggacggttagttagtgtacctagtcggtaccagccagaacgcctacggccacggtcccctgtcgcgtcggtccctccatcgtaactacgtacgaccggacccggtccctacgacgggtaccttcccggngacgtacgtacttccgtaccgacggtccctaaccgtaacgttcggtaaacgggggaaaaccctccccgaacccgttacggaacctanaccgtaacggacccggtacgggggttaaccgaaccggggacccgggggtaacgtccggggtaaacgggacccgtttaacgtttaacgtttaaccggtacgggtttacccggtaaggggttcgggttacggggtccggttacgggttagggttaaacgtttaaacggtcgtaacgttacggttaaccggggtggggggttacccggggggttttcggggttacccgggggaccgggggtaaaccggtaaaccccgggttaacggacccgggttacccggttaaaccccgggttacccgtttaaaaccggggacccgttaaacccgggaacccccggtttaaaccgggcccccgtttacccccggggttacccccccgggttaggtttaccccccttacccggtttccccgttttaacccccccgg

SEQ ID NO: 80 - DNA, 1012 bp, Homo sapiens
  misc_feature: GYAE6OF01ET1YG.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctctatgtgctgactcacgccacccgtcggtcgtcacggtcggccccgagggagacggaccggaccaaggtactaacgttagtaagaaaaagaaacctatctaagttagggagggttacgttaaggtagtaacgtacgttaggtaacccgaggacaaacgggaaacgtcccgaacgggacccgtaaccgggtcccccgtttgggtaccggtccgtttccggggttaccccctaccggtaactttacccgtaaacgttaaccgtacgggaccccggaaccccggggtcccctagggtaaaccggggtacccttaccccggttaagggaccggttaccgttaacgtttccgtaccggtaacgggtaccccttaacccgtaaacggtttaccgggaaaaccggggtaaaacccgcccctaaccccggtacgaaacccgtagtacccgaacgggtaccggtaccggggtaaccggtaaccggggaccgggtaaggtacgggaaaccgggtacccttaaacgtttacgtttaaccggtcggttaacgggtacggggtttaccgggtaacggggtcgtttaaggggtaaacgtaacgttaacggtacggttaaccgtacgggttaacggggttacggggggttaccggggggttttaacggtcccgggggaaacggggggtaaacggtaacccggtaacggggttacccggtaaaccgggtaaccccgggttaaaggttaacccgggtaacccggtaaccccgggtaaaccccggtaacgggggttaccccccgtttacccccgggtacccccgggtttaaccggggttacccctttaaccccggtttccccgggtttacccccccgg

SEQ ID NO: 81 - DNA, 196 bp, Homo sapiens
  misc_feature: GYAE6OF02JRY07.9.55.E11.1.454.CMB.1.raw
  modified_base (193)..(196): a, c, t, g, unknown or other
  misc_feature (193)..(196): n is a, c, g, or t
tcagtgatacgtctcacgaccggtgctcgatttagcactcgcacgttgggtttgggctggtgataatgatcatgcggggtgttcggcggagggaccaagctgaccgtcctaagtcagcccaaggctgcccctcggtcactctgttcccaccctcctcagacgtatcactgagcgggctggcaaggcgcatagnnnn

SEQ ID NO: 82 - DNA, 526 bp, Homo sapiens
  misc_feature: GYAE6OF02GGI7X.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtacctccatcatactagcgaccggccctcagggactccctgagcgattctcaggctccaactcgtagggaaaaccggccaaccctgacccatcagcagggtcgaaggccggggatggaggccgactattactgtcaggtgtgggctggtgataatgatcgagtggcggggttgttcgggcggagggaccaagcgtgaccgtctaagtccagcccaaggctcgcccctggccactctccg

SEQ ID NO: 83 - DNA, 520 bp, Homo sapiens
  misc_feature: GYAE6OF02HAJDP.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattctcaggctccaactctagggaaaacgccaccctgaccatcagcagggtcgaagccggggatggaggccgactattactgtcaggtgtgggctggtgataagtgatcgagtggcggggtgttcgggcggagggaccaagctggaccgtctaagtcagcccaaggcctcgccccctggtccactctccg

SEQ ID NO: 84 - DNA, 526 bp, Homo sapiens
  misc_feature: GYAE6OF02F8L5J.9.55.E11.1.454.CMB.1.raw
  modified_base (335)..(335): a, c, t, g, unknown or other
  misc_feature (335)..(335): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcagggatccctgagcgattcncaggctccaactcgtagggaaaaccgccaccctgaccatcagcagggtcgaaggccggggatggaggccgactagttactgtcaggtgtgggctggtgataagtgatcgagtggcggggttgttcgggcggagggaccagcgtgaccggtctaagtcacgccgaaggcctcgcccctggtccactctcccg

SEQ ID NO: 85 - DNA, 523 bp, Homo sapiens
  misc_feature: GYAE6OF02GFHBI.9.55.E11.1.454.CMB.1.raw
  modified_base (430)..(430): a, c, t, g, unknown or other
  misc_feature (430)..(430): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggccccctgtgctggtcctccatcatactagcgaccggccctcagggatccctgagcgattctcaggctccaactctgggaaaacgccaccctgaccatcagcagggtcgaagccggggatggaggccgactattactgtcaggtgtgggctgggtnataatgatcagtggcgggggttgttcgggcggagggaccagctgaccgtctaagtcacgcccaaggcctcggccccctcggtccactctcccg

SEQ ID NO: 86 - DNA, 603 bp, Homo sapiens
  misc_feature: GYAE6OF02JIGTI.9.55.E11.1.454.CMB.1.raw
tcagtgatacgtctcacgaccggtgctcgatttagcactcgcacgttgggtttggggcgtgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccagggataacttgtgaaagaaacatcattggaggtgttagtgtacactggtaccagcagaagccaggccaggccccctgtgctggtcctccatcatactagcgaccggccctcacggggatccccgtgagcgattcctcaacggctacccaactctaggggaaaaccggccaacccgtgacccatccagcagggtcgaaggccggggaatggaaggccgactattactgtcgaggtggtgggcgtggtgagtaagtgatcaagtggtcgggggttaggttcgggtacggggaacggggacgaaacggtcgtaggtacccggtcccgttaaaggccgtaaccggacccgaaagggccgttacggccccccgttcgggttacccacgttcccgttcccgg

SEQ ID NO: 87 - DNA, 566 bp, Homo sapiens
  misc_feature: GYAE6OF02GK92M.9.55.E11.1.454.CMB.1.raw
  modified_base (342)..(342): a, c, t, g, unknown or other
  misc_feature (342)..(342): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggccccctgtgctggtccctccatcatactagccgacccggccctcgagggactcccgtgagcgattcncaggctccaactctagggaaacgccacctgaccatcagcagggtcgacggcggggatggaggccgactattactgtcgtaggtgtgggcgtggtgatagtgatcagtgggtcggggtggttcgggcgggacgggaccgaggcgtacggtacccgtccgtaacggtccaacgcccgtaaggccgtccggtaccccccgtggtacccgtaccgttccgttccccgg

SEQ ID NO: 88 - DNA, 530 bp, Homo sapiens
  misc_feature: GYAE6OF02ITEX6.9.55.E11.1.454.CMB.1.raw
  modified_base (396)..(396): a, c, t, g, unknown or other
  misc_feature (396)..(396): n is a, c, g, or t
  modified_base (459)..(459): a, c, t, g, unknown or other
  misc_feature (459)..(459): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtgctggtcctccatcatactagcgaccggccctcgagggactccctgagcgattctcaggctccaactctagggaaaacgccacctgaccatcagcagggtcgaaggccgggganggaggccgactattactgtcaggtgtggctggtgataatgatcatgggtcggggtgttcgggnggagggacagctggaccgtctaaggtcacgacccgaaggcctcggcccccgtcggtaccaccgtctcccgg

SEQ ID NO: 89 - DNA, 585 bp, Homo sapiens
  misc_feature: GYAE6OF02IYSZG.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtgaaagaaacatcattggaggtgttagtgtacactggtaccagcagaagccaggccaggcccctgtgctggtcctccatcatactagcgaccggccctcgagggactccctgagcgattctcgtggcctccaactctacgggaaccaccgggcccaccctcgaacccacgtcgacggccggggtaccggaacgggccggggagtggacgggccgacgttatttccgtgtcagctggtgggtacttctctagtgtagttgggtaggtggggtaattcggttcgggcgggtacgggaccgagggcgtcggtaccgtcgtaacgtcgacgcccgaaggccgtccgccccgtcggtcctacgtccgttcccg

SEQ ID NO: 90 - DNA, 730 bp, Homo sapiens
  misc_feature: GYAE6OF02HZH88.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaacgccgaggccaggccccctgtgcctggtcctccatcatactagccgacccggccctcgacgggactccccgtgacgccgatttcctcaggcctaccaactcgtacgggaaaaaccggcccaacccgtagacccatccaggaccgaggggtaccggaacgggacccgggggagtacgggacgggacccgtaacgttaagttaccgtggttaccgagggttacgggtcggggtccgttagggtaggtaacgttaaagtaggtaacttacgtaaggttcggggtaccggggggtttcgggtttccgggggacggggtaacggggaacccgaacgggtccgttaccgggtaacccggtaacccgttaaacggttacccgtaaccgggtacccccgtaaacgggtcccgttccccggtacccccccggttcccgggttaacccgttaccccgttacccgtttacccccgg

SEQ ID NO: 91 - DNA, 571 bp, Homo sapiens
  misc_feature: GYAE6OF02FWBMQ.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatcattggaggtgttagtgtacactggtaccagcagaagccaggccaggcccctgtcgctggtcctccatcatactagccgaccggccctcgacggggactccccgtgacgcgtacttctcgaggcctaccaactcgtacgggaaaccggccacccgtgaccatccagcgagggtacgaacggccgggatggacggccgacttattacgtgtacgagggtggtgggcgtggtgataagtcgatcgagtcgggcggggttgtcgggacgggacggaccgaggtcgtacggaccgttcgtaacgtcgacgaccgaggcctccggcccctcggcctacctcgttcccg

SEQ ID NO: 92 - DNA, 724 bp, Homo sapiens
  misc_feature: GYAE6OF02GUM1R.9.55.E11.1.454.CMB.1.raw
  modified_base (337)..(337): a, c, t, g, unknown or other
  misc_feature (337)..(337): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacatacattggagtgttagtgtacactggtaccagcagagcaggccaggcccctgtgctggtccctccatcatactagcgaccggccctcgagggactcccgtgagcgattcncgaggctccaactctacgggaaaacggacccaccctacgaacccagtccacgacgacggggtaccgaaacgggcccgggggaatcgggaacgggcccgaacgttaacgtttacgtaggtaccgtaagggttggttaggggccgttagggtaggtaacgtttaaagtaggaacgtttaccgagtttacggggtacggggggtttacggtttcccgggggcggggaaagggtaaccccggtaaggtaccgggttaaccggtaaccccgggtttaacccttaaacgggttcccggtaaacggtacccccggtaaaacgggtccccgttacccggttacccccccggttacccgggttacccgttaaccccgttccggtttaaccccccgg

SEQ ID NO: 93 - DNA, 698 bp, Homo sapiens
  misc_feature: GYAE6OF02GNY8L.9.55.E11.1.454.CMB.1.raw
  modified_base (334)..(334): a, c, t, g, unknown or other
  misc_feature (334)..(334): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaagaaacatacattggaggttgttagtgtacactggtaccagcagaagccgaggccacggcccctgtcgctcggtccctcatcatactagccgaccggccctcgacggctccgngacgcgtattccgcgacgtcctaccaacgttcggtaaacggggaaaaccgccctaacccgtcgaaccactacgacggaccgtaggggtaccggaaacgggtccgggggaatcggggaaccgggtaccgtaacgttaccgtttaccgtacgggtaccggtaggggttcggtcggggtacgttggggtactaagtaacgtaggtataccgtaggtcgggggttcgggggttagggttcccgggggcgggtaaccggggacctagggtaccgtacggtaccccggttaacgttaaccggacgtaccgacccggaacggtcccgtacccggtccccggtaccggtccctacccgttccgttaccccgg

SEQ ID NO: 94 - DNA, 780 bp, Homo sapiens
  misc_feature: GYAE6OF02F7MKW.9.55.E11.1.454.CMB.1.raw
  modified_base (283)..(283): a, c, t, g, unknown or other
  misc_feature (283)..(283): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtagaaagaaacatcattggaggtgttagtgtacactggtaccagcagaagccaggccaggcccctgngctggtccctcatcatactagccgacccggccctcgacgggtactccccgtgacgccgtaacttcgtacgacggtcctacccaacgtccgtaacggggaaaacccggcccctaaccccgtaccggaacccaactaccgaacggtaccggtaacgggggtaccggaaacgggtcccggggggaaacgtacgggaacgggacccgtaaacgtttaacgttaccgtcgggttaccgtaaggggttcgggttacggggtccggttagggtaggtaaagttaacgttaggaacgttacgaaggttcgggggtcgggggggtttagggttcccggggacggggttaaccggggaaaccggtaacgggtccgttaaccgggtaacccggttacccggttaaacggtacccggtaacccgggtaaccccgtaaacggggtccccttacccgggtacccccccgtttaccgggtacccgttacccggttacccgttttccccccgg

SEQ ID NO: 95 - DNA, 794 bp, Homo sapiens
  misc_feature: GYAE6OF02IB6YF.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagcccaccctcggtgtcagtcggcccaggagacgacggccaggactaacttgtagaaagaaacatacagttggaggttgttagtgtacacgtcggtaccagacaagaagccgacggccgacggcccctggtcgcgtggtccctccaatctaatacgtacggaccgacccggccctacgacgggtactcccgtagacgcgtattccgtcgacggcctaccgtaacgtacgtaacggggaaaaccgtcccgtaacccgtacgtaacccactacgacggaccggaacggggtaccggaacggggacccgggggtaacgtacgggaaccgggacccgtaacgttaacgttttacgtcggttacggtacggggtttgggtacggggttccgttaggggttagtaaagttagttaggtaacgttacggtaacgggttcgggggttaccggggggtttacggttacccggggggaacggggtaaaccgggggtaaccgaacggggttccggttaccgggttaccccggttaaccggttaacggtacccgggaaccggtaacccccgtaagggttcccctacccgggtccccccgtttaccgggttacccttacccggttcccgtttacccccgg

SEQ ID NO: 96 - DNA, 771 bp, Homo sapiens
  misc_feature: GYAE6OF02ITJHF.9.55.E11.1.454.CMB.1.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcacgccaccctcggtgtcagtcggccccaggagaggacggccaggataacttgtagaaagaaacntcagttggaggttgttagtgtacacgtggtaccagcagaacgccgaggccacggccctgtgcgttcggtcctccntcactactaggccgacccggcccctagacgggtactccccgtaggacgaccgtactttacccgtcgaacgggtcctacccctaaacgtttccggtaaccgggggaaaaaccggccccgtaaccccgtacggaacccctaacgttcccgaacggtccggaacgggggttacccgggaaacggggtaccccggggggaatacggggaaccggggtacccgtaaacgtttacgtttaacccgttacggtaccggttaagggttcgggttacggggtcgttaggggtacgtaagttaacgtaggttacgtaccgtaggttcgggggtacggggggttacgggttaccggggacggggtaacgggaccgaacgggtccgtacggtaccggttacctaacggtaccgaacgacccggaaggtcccgtaccggttcccccggtacggtcctacccggttcccgttaccccgg

SEQ ID NO: 97 - DNA, 605 bp, Homo sapiens
  misc_feature: GYAE6OF02FTEZK.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcagttggaggtgttagtgtacactggtaccagcagaagccaggccacggccccctgtcgctggtccctccatcatactagcgaccggccctcgacgggactcccgtgacgcgtattcgtcgacggtcctccaaaccgtcgtaacggggaaaaccggcccaacccgtgaacccagtccaacgcgagggtaccggaagggccggggatgggacggccgtatacttacgtgtcgaggtggtggctgggtgagtaatgatcgagtgggcggggttgtcgggacggaggaccgagtccgacggacccggttactaacggtccgaaccgtacccggaggtcccgtccggtcccccgtcggtacctcccgttcgttaccccg

SEQ ID NO: 98 - DNA, 736 bp, Homo sapiens
  misc_feature: GYAE6OF02ISPMF.9.55.E11.1.454.CMB.1.raw
  modified_base (366)..(366): a, c, t, g, unknown or other
  misc_feature (366)..(366): n is a, c, g, or t
tcagtgatacgtctcacgaccggtgctcgatttagcactcgcacgtttgggtttggggctgggcctaaggaagcagcactggtggtgcctcaggccagtggcctggaccgttctcctcctcggcctcctctctcactgcacacggctctcgtgacctcctatgtgctgactcagcccacccgtcggtcgtcgagtcggccccaggagagacggccaggataacgtgtagaaagaacatcgagttgggaggttggttagtgtaacacgtggtaccagcaagaacgccaggccgacggcccctgtgctggtccctccatcatactacgccggacccgccctcgagggacctccgtgacgcgtattccncacggcctaccaacttcggtaacggggaaaaccgcccctaacccgtacgacccgtactaccgacggaccgaacgggggtaacgggaaccgggaccggggggtactacgggaccgggaccgtaacgttaacgtttacgtcggtaccggtaggggttgggtacggggtcggttagggtagtaagttaagttacgaagtacgtacggttggggtacgggggtttcgggttaccggggacggggtaaccgggaaccggtaacggtccgttaccggtacccggttacggttaaccggtaccggaccggaccccggtaacgggtcccgttcccggtacccccggttcggtacccttacccgtcccgtttcccccgg

SEQ ID NO: 99 - DNA, 730 bp, Homo sapiens
  misc_feature: GYAE6OF02IWLAP.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggcccaggagagacggccaggataacttgtagaaagaaacatcattgggagtgttagtgtacactggtaccagcagaacgccgagccgacggcccctgtcgctcggtccctccagtcatacgtacggccggacccggcctacgacggggactcccgtagacgcgtattccgtctaggtcctaccgtaaacgttccgtaacggggtaaaaacccggccctaacccgtacggaaccctaacgtaccgacggacggtaacgggtaccggaaacgggccggggtatagggaccgggtaccgtaacttagttacgtcggttacgtaggttggtcggggtcttacgggtagacgttaaagtcgtaacgtcgtaagggttcggggtcggggggttacggtttacgggggaccgggtaaggggaaccgtaacgggtcggttaccgggtaacccggttcccgttaaacggttccggaaccgttaaccccggaacggttcccgttacccggtaccccccgttgggtacccctaccggtttcccttaccccggg

SEQ ID NO: 100 - DNA, 573 bp, Homo sapiens
  misc_feature: GYAE6OF02I0DJO.9.55.E11.1.454.CMB.1.raw
  modified_base (227)..(227): a, c, t, g, unknown or other
  misc_feature (227)..(227): n is a, c, g, or t
  modified_base (446)..(446): a, c, t, g, unknown or other
  misc_feature (446)..(446): n is a, c, g, or t
  modified_base (453)..(453): a, c, t, g, unknown or other
  misc_feature (453)..(453): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtggccccaggagagacggccaggataacttgtgaaagaaacntcattggaggtgttagtgtacactggtaccagcagaagccagccacgcccctgtgctggtcctcatcatactagccgaccggccctcacgggatcccgtgagcgacttctcaggctccaactcgtacgggaaaaccgccacccgtcgaccactcacgcgaggggtacgaacggccgggagtggacggccgactattactgtcgaggtgtgggcttggtnaataagngtatgagtgggtcggggttgttcgggcggacgggacaaggcgtacgacccgttccgtacggtccgaaccgcccgaaggccgtcccgaccccgttccggtacctaccgttcgttcccccgg

SEQ ID NO: 101 - DNA, 639 bp, Homo sapiens
  misc_feature: GYAE6OF02IZ50Z.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcattggaggtgttagtgtacactggtaccagcagaagccaggccaggcccctgtgctggtcctccatcatactagccgacccggccctcgagggactccccgtgacgcgattcctcgaggcctacccaacttcgtaacggggaaaaccggcccaacccgtacgaacccataccgacgccgagggtaccgaaacggcccgggggaatgggacggcccgaacttattaccgtggtcgagggtggtgggcgttagggtagaagttaagtagtactcgtagttcggggtcgggggttcggttcggggacgggaacggggaaccaaggccgtacggacccgttaccgtaacggtcgaaccggacccgaaggtccgtacccggcccccgttcggaccctcccttccgttaccccg

SEQ ID NO: 102 - DNA, 639 bp, Homo sapiens
  misc_feature: GYAE6OF02GQJVW.9.55.E11.1.454.CMB.1.raw
  modified_base (255)..(255): a, c, t, g, unknown or other
  misc_feature (255)..(255): n is a, c, g, or t
  modified_base (265)..(265): a, c, t, g, unknown or other
  misc_feature (265)..(265): n is a, c, g, or t
  modified_base (332)..(332): a, c, t, g, unknown or other
  misc_feature (332)..(332): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggccccctctctcactgccacaggctctgtgacctcctatgtgctgactcagcccaccctcggtgtcaggtcggccccaggagagacggccaggataacttgtagaaagaaacatcagttggaggtgttagtgtacncgtggtaccngcagaacgccaggccacggcccctgtgctcggtcctcatcatactacgcgaccgccctgaggctccngacgcgtacttcctcgaggcctacctaatccgtaacgggaaaaccgccctaccctacgaccactcacgcgagggtcggaacggccggggagtcggacgggccgtaacgtacgttacgtcgtacgaggttggcgggtcgtggtagagtaagtgacgtacgtagtcggggtacgggggttcggttaccggggacggggacggaccgaacgtccgtacggtacccgtacggtaacggtacgaccggacccgtaaggtcccgtacccggtcccccgttaggtaccctaccgttccgtacccgttacccccg

SEQ ID NO: 103 - DNA, 802 bp, Homo sapiens
  misc_feature: GYAE6OF02J05TH.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcaggtcggccccaggagagacggccaggataacttgtagaaaagaaacatcattggagttgttagtgtacacgtaggtaccagcgaagagcgacggccacggcccctgtcgcgtcggtccctcactcactaactacgccggacccgggtcccctacgacgggactcccgtaggacgccgtacttccgtacacgggtcctacctaacgtccggttaaccggggaaaaaccggtcccctaaacccgtcgtaacccacgtaccgacggtacggaacgggggtacggaaaccggggccggggtaacggacgggaacgggtacccggtacgtttaacgttaaccgttcgggtaacggttacggggtttcgggtcggggtaccgtggggttacggaaacgtttacggagttaacggtacgtaacgggttcgggggtacggggggtttcggttccgggggtaaacccgggaacgggtaacccgggtaacgttacccgggttacgggtaacccggttaacccggttaacggtaacccggacccggtaacccggtaacccggtcccggttacccccggtacccccggtttcccgggaacccttccccggtttacccggtttccccccgg

SEQ ID NO: 104 - DNA, 718 bp, Homo sapiens
  misc_feature: GYAE6OF02FVQGW.9.55.E11.1.454.CMB.1.raw
  modified_base (233)..(233): a, c, t, g, unknown or other
  misc_feature (233)..(233): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagtcaccctcggtgtcagtcggcccaggagacgacggccaggacttaacgttgtagaaaagaaacntcagttgggaggttgttagtgtactacgtcggtaccagacgagaacgccgaggcccacggcccctggtcgctcggtccctccatcactacgagccggaccggccctagagggtcctccgtaggacgccgtagttccgacgacggtcctaccgaactcggtaacggggaaacccgcccgtacccgtacgaacccataccgaacggaccgacgggtaccgaacgggccggggaagtcggacggacccgtaacttaacgtttacgcgggttagtacgggttcgggtagggtccgttagggtagtaaacttaggttaacgacgttacgtacgggttacggggtcgggggggtttcgtttccggggaacggggtaacgggacccgaaggtcccgacgggtacccgttaacgtaacggtccgaccggtaacccggtacggtcccgttacccggccccccgttcggacccttaccgttcccgttcccccggg

SEQ ID NO: 105 - DNA, 640 bp, Homo sapiens
  misc_feature: GYAE6OF02HMDU5.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccaccctcggtgtcagtcggccccaggagagacggccaggataacttgtagaaagaaacatcattggaggtgttagtgtacacgttggtaccagcagaagcacggccaggcccctgtgctcggtcctccactcatactagccggacccggccctcgagggtactcccgtaggcgacgtattctacgacggtcctacccaacgtcgtacggggaaaaccgccaacccgtgaacccatacgacgacgtagggtaccggaacggccggggatggacggccgtaacttacgttacgtgtacggtaggtcggtagggtcgtggtagaagttaagagacgttacgagggttcgggtacgggggttcggttacgggacgggaacgggtaaccgaggtccgtacggtacccggttacgtacggtacgaaccgacccgaacggtccgtccggaccccttcggacctccgttccgttcccg

SEQ ID NO: 106 - DNA, 846 bp, Homo sapiens
  misc_feature: GYAE6OF02IGNB5.9.55.E11.1.454.CMB.1.raw
  modified_base (146)..(146): a, c, t, g, unknown or other
  misc_feature (146)..(146): n is a, c, g, or t
  modified_base (351)..(351): a, c, t, g, unknown or other
  misc_feature (351)..(351): n is a, c, g, or t
tcagtgatacgtctcacgaccggtgctcgatttagcactcgcacgttgggtttggggctgggcctaaggaagcagcactggtggtgcctcagccatggcctggaccgttctctcctcggcctcctctctcatgcacaggctctgtnacctcctatgtgctgactcacgcccacccgtcggtgtcagtccggccccgaggagacggaccggaccgagggtaacttaacgttggtaagaaacgaaaactagtacgtaagttagggtaggttaggtttaggtacgtaaccgtacggtacggtaccgaagtacgaacggaaacggccgaacggcccgaccggtccccgttggtcnccggttaccggtccctacactactacttaccgacggtacccggaccccggtccctacggaacggtaccttccccgagggacgtaccgttacgttaccgtaccgacggttacctaaccccggtaaccgttaccggggtaaaaccgggtaaaccccggtacccctaaccccggttaccgaaaccgacgttacccggaaacgggtccggggttaaaccgggttaacgggaaaccggggtaccccggggtagtaaaccgggtaccgggtacccgtttaacgtttaaacgtcggttaccggttagggttacgggttacgggttccgggttagtaccggttgtaacgtaagttccgtagtacggtgggtcggggttacggggttacgtacgggacgggacggtaacgaccgtcggacgtaccgtaaccggttaacaccgaccggtccggtaaccgtcccgtccccgtcccggtaccgtccgtaccgttcccgttaccccgg

SEQ ID NO: 107 - DNA, 650 bp, Homo sapiens
  misc_feature: GYAE6OF02HFV94.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcctatgtgctgactcagccacccgtcggtgtcagtcggccccaggagagacggccaggataacgttgtagaaagaaacatcattggaggtgttagtgtacactggtaccagcagaagccaggccaggcccctgtgctggtccctcatcatactaggcgaccggccctcgaggactccctgacgtcgattcacgacggcctaccaacctcgtacggggaaaaccgcccaacccgtagaaccataccgagcgaaggggtacgaacggccggggatgggaacggccgtaacttaagttaccgtgtacgtagggtggtacggggtcttaggggtagaagttaagtacggattcgaagttcggggtacgggggggttggttccggggacgggtaacgggaaccgtaaggtccgtacggtaacccggttcgtaaacggtcgaaccggtacccgaagggtcccgttcccgggaccccctccgggtcctaccgttcccgttacccg

SEQ ID NO: 108 - DNA, 839 bp, Homo sapiens
  misc_feature: GYAE6OF02JBN5S.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctcacatgtgctgactcagccacccgtcggtgtcaggtcggccccgagggacgggaccggccaacctacttacctggtggtggggagaaggacagttgacgaaagggaagagtcgtaccacgtcggtaaccaacgacgacggaccgaacggggccccgggcccctggtcggggtcggttccggtcgtagtcggaataacgacgtcggacccggtcccgtacggtcgacgtccccgtggacgtccgtcctttctcgtcggtaccctaccgtaaccgtccgttaacggggaacccacccggggtaccctaaccccgttacggacccctaggttaccgaacggccggacgggggtacccggaaacggggtaccggggggtaactcgggaacggggccccgtaaacgttaacgttaaccgtcggaaccggtacgggttacggtacgggtactaacgttaacgtttccgtaccccggttaacccccggggttgggtttacccgggggggaccggggggaaaccctaccggacggtttcccgggaaacccggttccggtaacggtccgggaaccgtacccggtaacggtcccgggttccccggtaccccccggttcggtaaccccgtacccgtttcccgttaccccggtttaccccgacccccgtttccgtaccccggtaggttaccccgtaacg

SEQ ID NO: 109 - DNA, 726 bp, Homo sapiens
  misc_feature: GYAE6OF02HAFGG.9.55.E11.1.454.CMB.1.raw
  modified_base (258)..(258): a, c, t, g, unknown or other
  misc_feature (258)..(258): n is a, c, g, or t
tcagtgatacgtctcacgaccggtgctcgatttagcactcgcacgttgggtttggggcgtgggccgtaaggaagcagcactggtggtggcctcagccatggcctggaccgttctcctcctcggcctcctctctcactgcacaggctctgtcgacctcctatgtgctgactcagccacccgtggtcgtcagtcggccccgaggacgagacggccaggactaacgttgtagaaagaacaatcagttggaggtggttacgnggtacacgtaggtaccagcgaagaagccacggaccacgggtacccccttggtccggcgttccggtacccctaccactttacacttacgacggtcccggaacccgggtcccctaggaacggggacttcccccgtaggaagtccggtaactttcgttacaccgggtctacccctaaggtaccggtaaaggggaaaacccggtccccaccgtacgtaaccacgtcgtacggcgacgggtacgaagggaccgggtagtgacggaccgaacgttactacgttcggacgtacggttgggtaggtccgttcgggtaggtaattagaggttactgaacgggtcgggttacggggttcgggttccggggacgggtacgggaacgtacggtacggtacggtcccggtaacgtaacggttccgaacgacccggtaacggccggtaccccgcccggttcgtcgaccgttcgttaccccgg

SEQ ID NO: 110 - DNA, 817 bp, Homo sapiens
  misc_feature: GYAE6OF02JGMEI.9.55.E11.1.454.CMB.1.raw
  modified_base (562)..(562): a, c, t, g, unknown or other
  misc_feature (562)..(562): n is a, c, g, or t
  modified_base (675)..(675): a, c, t, g, unknown or other
  misc_feature (675)..(675): n is a, c, g, or t
  modified_base (694)..(694): a, c, t, g, unknown or other
  misc_feature (694)..(694): n is a, c, g, or t
  modified_base (749)..(749): a, c, t, g, unknown or other
  misc_feature (749)..(749): n is a, c, g, or t
tcagtgatacgtctcacgaccggtgctcgatttagcactcgcacgttgggtttgggctgggcctaaggaagcagcactggtggtgcctcagccatggcctggaccgttctcctcctcggcctcctctctcactgcacaggctctgtcgacctcctatgtgctgactcgacgcccacccgtggtcgtacgaggtccggaccccgaagggacgtaacggacccggtacccaacccgtacttttaacccgttggttgggtacgggaaacgtaaacgtacgtattacgggacgtaaaagggaaaggtacgttccggtcccgaacggttccggttaaacccgaaaacgacggaaccgggaccgaaccgggggtcccccggcccccggttagggttaccgggttaccgggttcccccttaccgtaaacgtccgtaacgttaccgtaccgaccggacccggtccgtacgacgggtacctcccgtaggacgacgtacttccgtacgacggtccctaccgaacgtttcggaaaccggggaaacccgtaccctaccgaccgtaaccgaaccngaccggacgtaacggggttaccgggaacggcccgggaatacgggcccgtaccgtaactttacgtacgtcgggtacgttgggacggttcggacgttggtacgaagtttaaccgntacgtcgtaggttcggggnggggttcggaccggaggaaccgaccggagtccgtaccggtacttaccgggttaanccggaccgtaacgggtactcccggttaccgccccgtttcgccgttcgttacccgttctaaccccctcg

SEQ ID NO: 111 - DNA, 823 bp, Homo sapiens
  misc_feature: GYAE6OF02ID1V3.9.55.E11.1.454.CMB.1.raw
  modified_base (457)..(457): a, c, t, g, unknown or other
  misc_feature (457)..(457): n is a, c, g, or t
  modified_base (521)..(521): a, c, t, g, unknown or other
  misc_feature (521)..(521): n is a, c, g, or t
  modified_base (554)..(554): a, c, t, g, unknown or other
  misc_feature (554)..(554): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgcgacctctatgtgctgactcacgccctacccgtcggttcgtcacggtaccggccccgaagggaggaacggaccggaccgaaggtaacttaaacgtttggtaacgaaaaacgaaaactacgtactaagtttaagggaagggtttgtttaggttacgtactaaccggtcggtaaccacgactaacggaacgccgacggacccgaccggtccccgttggttccgccgttacggttcccctaccgtacttacctaagtacctacggcccggtacccggcccctaggacgggacctccgtacgacgtacgtcttcncgaccgtcctactacgtaccggtaaacggaaacccgtcccaacccgacgtaaccctagtacggngaccgggagggttacggaacccggggcgggtanacgggtaacgggtaccgtacgttaacgtcgtcgggtaccggttagggttgggtaggttcgggtaacgttaggaacttaaacggttgaaccgtttcggacggggttaacgggggttcgggggtttacggggtccgggtaacggggaccgggaaccagggttacccgtaccggtacccgttaacgtaaccggtcccgaaccggttacccgtaccgggccctttaccccgggtcccgtaccggtttacccgtcccgtacccgtttcccccgg

SEQ ID NO: 112 - DNA, 904 bp, Homo sapiens
  misc_feature: GYAE6OF02ID2UR.9.55.E11.1.454.CMB.1.raw
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgacctctatgtgctgactcacgccctacccgtcggtgtacacggtcggaccccgaggagacggaccggccgaagggtaacttaacgttggtaagaaaaacgaaactactacgtaagttaggggtagggttgtttaaggtacgtaacgtaccgttacggtaacccgagaccgaagtaccggaccgacggacccgtaccggcccccgttggtcggtccgttcggttccccttactacttacctaacgttaaccgtacgggtacccggtaccccggtcccggttacggaaaccggggtacctttaccccggacgggtacggtaccgttacctttaccggtaccgtacgggtaccctaacccgtaaccggtttacggtaaccggggaaacccgacccgggtaccccaacccgtaccgaaccctacggtacgacgggaccgaaccggggaccggaacggggccgggagtcgggaaccggaccgttaacgttaccgttaccgacggtaccgggtagggttagtcggtaacttaattaccgttaaccgttaccccggtaccccggggtttagggtacccgggggggacccggggttaacctaaccgggttcccggttaccggtacccggttaacccggttacgggtacccgaaccggtaacccggtccggggtacccccgttacccggtcccccgggttaacgtcccgtttacccgttccggtttacccccgttcccccgtcccttacccggtaccctacccgg

SEQ ID NO: 113 - DNA, 750 bp, Homo sapiens
  misc_feature: GYAE6OF02FSO3R.9.55.E11.1.454.CMB.1.raw
  modified_base (158)..(158): a, c, t, g, unknown or other
  misc_feature (158)..(158): n is a, c, g, or t
  modified_base (231)..(231): a, c, t, g, unknown or other
  misc_feature (231)..(231): n is a, c, g, or t
  modified_base (464)..(464): a, c, t, g, unknown or other
  misc_feature (464)..(464): n is a, c, g, or t
tcagtgatacgtctcacgaccggtgctcgatttagcactcgcacgttgggtttggggctgggcctaaggaagcagcactggtggtgcctcagccatggcctggaccgttctcctcctcggcctcctctctcactgcacaggctctgtgtacctcctangtgctgactcacgccaccctcggtgtcagtcgaccccgagagagacggccaggatacgttgtagaaacgaacngtcattgggagtcgttagtaggtactacgtacggtacccgagtacgaagaacggccgtacggcccgacggcccctggtcggtccgtacggttcccgacctagtcccattaaccgtacggccgtacccgccctcggacgggacttccccgtggaagtcgtaaccgttctacgaccggtccttaccgaacgttaccgggacgtaaaccggccctaccgtacgaccacgtacgacncgggacgacggacggcgggagtacggacgccgtaacttacgttacgtacgtcggtaggtcgggttgggcgttagtaggtacgtaacgttggtaacgtcggtacgggtcgggtcggggtttacgggtaccgggaccgggttaaaccggggaccgacgttaccgtaccgggtaccggttaaccgggtaccggttaacccggaacccgttaccggaacccggttacccgggttccccggtaccccccggttacgggtttacccttcccggttacccggtttacccccgg

SEQ ID NO: 114 - DNA, 806 bp, Homo sapiens
  misc_feature: GYAE6OF02FQI1W.9.55.E11.1.454.CMB.1.raw
tcagtgatacgtctcacgaccggtgctcgatttagcactcgcacgtttgggtttggggctggggcctaaggaagcagcactggtggtgcctcagccatggcctggaccgttctcctcctcggccgtcctctctcactgcacacggctctagtgacctcctatgtagctgacctcacgacctacccgtcggtgtacacgtacggcccagggagacgacggaccaggataacgttaggagtaaacaacactcattaggagttagttacgtagtactagtggaccaggtacaaggaacgcgtacggaccaccgggtccctagtcggtctcggtaccctactactacgtaactacgtaacggtaccgaccgggtcctaggtacggacctccgtagaacgtcgtaacgttcgacgtacgtcctaacgtaaccgtaccggtaacggggaaaaccctacccggtacctacggtaaccctcgttaaccgacgggtaaccgggacgggtaacgggaccgggacccggggtaaggttacgggaaacccgggcgtttaaaccttaaaggttaccttacgggtcggtaaacggggttgggttaaccgggtacgttggaagtacggtaattacggactttacggacgggttcggggttaccggggtaacggtttaccgggggaacgggtaccgggttaaacgaccgggttacgtacccggttaacccgggttactttaacgggaaccccggaaccgttaaccgaccggttacccggcccggttacccgttccgggtaaccttcccgttaccgttacccc

SEQ ID NO: 115 - DNA, 564 bp, Homo sapiens
  misc_feature: GYAE6OF01EE4EK.19.26.C04.1.454.CMB.1.raw
  modified_base (149)..(149): a, c, t, g, unknown or other
  misc_feature (149)..(149): n is a, c, g, or t
  modified_base (171)..(171): a, c, t, g, unknown or other
  misc_feature (171)..(171): n is a, c, g, or t
  modified_base (173)..(174): a, c, t, g, unknown or other
  misc_feature (173)..(174): n is a, c, g, or t
  modified_base (176)..(177): a, c, t, g, unknown or other
  misc_feature (176)..(177): n is a, c, g, or t
  modified_base (180)..(180): a, c, t, g, unknown or other
  misc_feature (180)..(180): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (190)..(191): a, c, t, g, unknown or other
  misc_feature (190)..(191): n is a, c, g, or t
  modified_base (195)..(195): a, c, t, g, unknown or other
  misc_feature (195)..(195): n is a, c, g, or t
  modified_base (197)..(197): a, c, t, g, unknown or other
  misc_feature (197)..(197): n is a, c, g, or t
  modified_base (199)..(199): a, c, t, g, unknown or other
  misc_feature (199)..(199): n is a, c, g, or t
  modified_base (202)..(203): a, c, t, g, unknown or other
  misc_feature (202)..(203): n is a, c, g, or t
  modified_base (205)..(205): a, c, t, g, unknown or other
  misc_feature (205)..(205): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
  modified_base (212)..(213): a, c, t, g, unknown or other
  misc_feature (212)..(213): n is a, c, g, or t
  modified_base (215)..(215): a, c, t, g, unknown or other
  misc_feature (215)..(215): n is a, c, g, or t
  modified_base (217)..(221): a, c, t, g, unknown or other
  misc_feature (217)..(221): n is a, c, g, or t
  modified_base (223)..(224): a, c, t, g, unknown or other
  misc_feature (223)..(224): n is a, c, g, or t
  modified_base (226)..(226): a, c, t, g, unknown or other
  misc_feature (226)..(226): n is a, c, g, or t
  modified_base (229)..(229): a, c, t, g, unknown or other
  misc_feature (229)..(229): n is a, c, g, or t
  modified_base (232)..(233): a, c, t, g, unknown or other
  misc_feature (232)..(233): n is a, c, g, or t
  modified_base (235)..(235): a, c, t, g, unknown or other
  misc_feature (235)..(235): n is a, c, g, or t
  modified_base (237)..(237): a, c, t, g, unknown or other
  misc_feature (237)..(237): n is a, c, g, or t
  modified_base (240)..(241): a, c, t, g, unknown or other
  misc_feature (240)..(241): n is a, c, g, or t
  modified_base (243)..(243): a, c, t, g, unknown or other
  misc_feature (243)..(243): n is a, c, g, or t
  modified_base (250)..(250): a, c, t, g, unknown or other
  misc_feature (250)..(250): n is a, c, g, or t
  modified_base (253)..(253): a, c, t, g, unknown or other
  misc_feature (253)..(253): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
  modified_base (264)..(264): a, c, t, g, unknown or other
  misc_feature (264)..(264): n is a, c, g, or t
  modified_base (266)..(266): a, c, t, g, unknown or other
  misc_feature (266)..(266): n is a, c, g, or t
  modified_base (268)..(268): a, c, t, g, unknown or other
  misc_feature (268)..(268): n is a, c, g, or t
  modified_base (271)..(271): a, c, t, g, unknown or other
  misc_feature (271)..(271): n is a, c, g, or t
  modified_base (273)..(273): a, c, t, g, unknown or other
  misc_feature (273)..(273): n is a, c, g, or t
  modified_base (278)..(279): a, c, t, g, unknown or other
  misc_feature (278)..(279): n is a, c, g, or t
  modified_base (284)..(284): a, c, t, g, unknown or other
  misc_feature (284)..(284): n is a, c, g, or t
tcagtactctcgtgcacgaccggtgctcgatttagtctagcgactttgggtttgggggagaggagcccagcactagaagtcggcggtgtttccattcggtgatcagcactgaacacagaggactcaccatggagtttgggctgagcggngttcgctaggcgcttaataggncnngnngtncactgngngnngggngngngcnncngngcngnncncnnnnncnngntcnctnntntntgnncnctgcgcngcncngngaggngngngnggngnatatnnatatnagtagagtaaatatattagtagagtacgtacgtacggacggtaccgtacgttactacctactactaccgacgaacgaactaactaacgtaaacgaaacgaacgtacgtagtacgtacgtacgtaacgtaactaacgaacgaacgtacgtacgagtacgtacggtacgggacggaccggtacgttacgttacgttagttacgttacggtacggtacggacggtacgggacggtcgtacggtaaccgtaacgtaaccgtacgttaccgttacggtttacggg

SEQ ID NO: 116 - DNA, 551 bp, Homo sapiens
  misc_feature: GYAE6OF01EM6XV.19.26.C04.1.454.CMB.1.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaaacagcctagagagcgtggggacacggctgtgtattactgtgcgagagcggctggcaactacatccagttacggtttgacgtcgtgggccaagggaccacgggtcagtcgtcctccccgagccctaccacccgaacgggccccaacgtccggtccttcccccgtggcccgccccgtgcctccacgggcgccgtaaccccg

SEQ ID NO: 117 - DNA, 504 bp, Homo sapiens
  misc_feature: GYAE6OF01C3S10.19.26.C04.1.454.CMB.1.raw
  modified_base (337)..(337): a, c, t, g, unknown or other
  misc_feature (337)..(337): n is a, c, g, or t
  modified_base (367)..(367): a, c, t, g, unknown or other
  misc_feature (367)..(367): n is a, c, g, or t
  modified_base (373)..(373): a, c, t, g, unknown or other
  misc_feature (373)..(373): n is a, c, g, or t
  modified_base (377)..(377): a, c, t, g, unknown or other
  misc_feature (377)..(377): n is a, c, g, or t
  modified_base (399)..(399): a, c, t, g, unknown or other
  misc_feature (399)..(399): n is a, c, g, or t
  modified_base (404)..(404): a, c, t, g, unknown or other
  misc_feature (404)..(404): n is a, c, g, or t
  modified_base (431)..(431): a, c, t, g, unknown or other
  misc_feature (431)..(431): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagcctgggagtccctgagactctcctgtgcagcctctggattcaccttcagtagctttggcatccacgtgggtcccgccaggcctccgaggcgaaggggctaggagtgggngcagttatatcatatgatggaagtaaaatntattangganactcgtagaggccatcacatcncaganacatacaagacacagtgatcagacaangaacagactgagagcgtgggacacggctagtgtagtacgtgtgcgagagcggtactaggacaactcagtaccg

SEQ ID NO: 118 - DNA, 548 bp, Homo sapiens
  misc_feature: GYAE6OF01EI9G6.19.26.C04.1.454.CMB.1.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggttggacgtcgtgggccaagggaccacgggtcagtcgtctccccagccctccaccaacgggcccacgttccggtccttccccccgtcgggcccgcccctcggccctacccacgggcgccgtaaccccg

SEQ ID NO: 119 - DNA, 580 bp, Homo sapiens
  misc_feature: GYAE6OF01DNM6W.19.26.C04.1.454.CMB.1.raw
tcagtactctcgtgcacgaccggtgctcgatttagtctagcgactttgggtttggggcgtgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacgggccaggattccctggtgggggagacaactttgatagtaaaagtgtgcactggtaccagcagaggccaggccaggcccctatactggtcatctattataataccgtccggccctcgagggactcccgtgagcgactctctggcctccaactcgtagggaacacggccaccgtgaccgtcacgcacgggtcgaacggccgggatcgaggccgactattactgtacgaggtgtgggagtagtagtagcgtcgatgtgtagtttcggcggagggtaccaagtcgtacgaccgtccgtaggtcgacgacccgaaggccgtacgcccccgtcggtccgaccgttccgtccgttccccgcccttcccgtcccgacgtaaccgg

SEQ ID NO: 120 - DNA, 551 bp, Homo sapiens
  misc_feature: GYAE6OF01DVLEX.19.26.C04.1.454.CMB.1.raw
  modified_base (367)..(367): a, c, t, g, unknown or other
  misc_feature (367)..(367): n is a, c, g, or t
  modified_base (409)..(409): a, c, t, g, unknown or other
  misc_feature (409)..(409): n is a, c, g, or t
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcgagggactccctgacgcgactctctggctccaactctgggaacacggccaccctgaccgtnagcagggtcgaagccggggatggacggccgatattactgtcnggtgtggatagtagtagcggtcatgtgagttttcggcggaggaccaagctacgaccgtcgtaggtcgagcccaaggcctcgcccctcgtcactcgtcgttccccgccctccgccacgacgtacgtactgacgcggtcgtggg

SEQ ID NO: 121 - DNA, 575 bp, Homo sapiens
  misc_feature: GYAE6OF01BGVNO.19.26.C04.1.454.CMB.1.raw
  modified_base (344)..(344): a, c, t, g, unknown or other
  misc_feature (344)..(344): n is a, c, g, or t
  modified_base (403)..(403): a, c, t, g, unknown or other
  misc_feature (403)..(403): n is a, c, g, or t
  modified_base (425)..(425): a, c, t, g, unknown or other
  misc_feature (425)..(425): n is a, c, g, or t
  modified_base (528)..(528): a, c, t, g, unknown or other
  misc_feature (528)..(528): n is a, c, g, or t
tcagtactctcgtgcacgaccggtgctcgatttagtctagcgactttgggtttgggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtcggccctcaggatccctgagcgactctctggctccaactctggaacnccggccaccctgacgtcagcgagggtcgaagccgggatggaggccgactatactgtacnggtgtggatagtagtagcggtntagtgtgtattttcgggcggtagggaccaaggccgtcggtaccgtccgtaggtcgacgcccgaaggctacggccccctcggtcctaccgtcgttcgttccccncccgttccctcccgaccgtagaccgtacctcgacggtcgggtaccgg

SEQ ID NO: 122 - DNA, 544 bp, Homo sapiens
  misc_feature: GYAE6OF01EC15Y.19.26.C04.1.454.CMB.1.raw
tcagtactctcgtgcacgaccggtgctcgatttagtctagcgactttgggtttgggctgagcgtggtttcgtcgttaggctcttttaagaggtgtccagtgtcaggtgcacctggtggagtctggggggaggcgtggtccagcctgggaggtccctgagactctcctgtgcagcctctggattcaccttcagtagctttggcatccactgggtccgccaggctccaggcaaggggctagagtgggtggcagttatatcatatgatggaaggtaaaatatattatggagactcgtgaagggccgattcaccatctccagagacaattccaagaacacagtggatctgacaaatgaacagctgagagcgtggggacacggctagtgtattactgtgcgagagcggctggcaactacatccagtttacggttggacgtcgtggggaccaacgggaccacgggtcacgtcgtctcccacgccctaccaccgaacgggcccagtccggtccttcccccgtggcccgcccgtcgcctcacggcgcacccg

SEQ ID NO: 123 - DNA, 580 bp, Homo sapiens
  misc_feature: GYAE6OF01C5WZB.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcacctgcacaggctctgtgacctcccatgtggtgactcagccaccctcagtgtcagtggccccaggagagacggccaggacttccctggtggggagacaactttgatagtaaaagtgtgcactggtaaccagcagaggccaggccaggcccctatactggtcatctattataataccgtccggccctcagggatcccgtgacgcgactctctgctccaactctgggaacacggccaccgtgaccgtcagcagggtcgaaggccgggatggacggccgaactagtactgtcgtaggtgtagggatacgtagtaggcggtcagtgtagtagtttcggcggagggaccaggcgtacggaccgtcgtaggtcgagcccgaaggcgtcgcccccgtcggtcaccgtcgtccgttcccctccctccctcccgacgtacgtacgtactcgacggtccggtaccgg

SEQ ID NO: 124 - DNA, 772 bp, Homo sapiens
  misc_feature: GYAE6OF01BK55O.19.26.C04.1.454.CMB.1.raw
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgcttcttttaagaggtgtccagtgtcaggtgcacctggtggagtcgtgggggagcgtggtccagcctgggaggtccctgagactctcctgtgcagcctctggattcaccttcagtagctttggctatcccacgtcgggtcccgccgaggcctccgaggccgaaggggctaggagtggggtgctagttatagtcaattatgaatagggaaaggttaaaaattagtaagtttagtagggaacgtaaccgtttacccggtaggaacggggtcccgtaacgtttaccgaaccctaacgttacccgttacccgaaggtaaacggtaacctaaaacctttacccgaaaacgtaaacccgtaacgtaaacgggttaggtaacgttaccgtaacggtaaaccctaaaagttaacggaaaaccgtaccggtaacccgtaaggaaacgggtaacggtaccgggtacggggggaaccgaccggggttaccgtacgggtttagtttaaaccgtttaaccggttagggttacgggaacgggtaacgggtaacggggcccggggttacccgtacgggggtaaccctaaaaccggttaacccgtaacggtttaaacccccgg

SEQ ID NO: 125 - DNA, 581 bp, Homo sapiens
  misc_feature: GYAE6OF01EP8XU.19.26.C04.1.454.CMB.1.raw
  modified_base (285)..(285): a, c, t, g, unknown or other
  misc_feature (285)..(285): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatgganactccgtgaagggccgattcacatctccagagacaattcaagaacacagtggatctagacaaatagaacaagcctagagagcgtggggacacggctgtagtattactgtgcgagagcggcgtggacaactacactcctagtttacgggtttcgacggtcgtcggggaccgaacgggacccgtacggtctacgtcgtccctaccccgacgccctacccgacccgaacgggccccgtacgtcccggttcccttcccccgacggcccgcccgtcgcctaccgacggcgccgtaccccgg

SEQ ID NO: 126 - DNA, 561 bp, Homo sapiens
  misc_feature: GYAE6OF01BNUZ6.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaaggccggggatggaggccgactattactgtcaggtgtgggatagtagtagcggtcagtgtgattttcggcggagggaccaagctcgaccgtccgtaggtccagcccgaaggcctcgccccctcggtccacctcgtcgttccccaccctccctcccacgacgtacgtactgacggccgggcgtcggg

SEQ ID NO: 127 - DNA, 551 bp, Homo sapiens
  misc_feature: GYAE6OF01ESEYO.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaagccggggatgaggccgactattactgtcaggtgtgggatagtagtagcggtcatgtgagttttcggcggagggaccaaggcgtggaccgtccgtaggtcacgcccaaggctcgcccctcggtccactctcgttcccaccctccctcccacgacgtacgtactgcgcgggcgtcgg

SEQ ID NO: 128 - DNA, 596 bp, Homo sapiens
  misc_feature: GYAE6OF01EAXXV.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccacactcagtgtcagtggccccaggagagacggccaggattccctgtgggggagacaactttgatagtaaaagtgtgcactggtaccagcagaggccaggccaggcccctatactggtcatctattataataccgtccggccctcagggatccctgacgcgactctctggctccaactctgggaacacggccaccctgacccgtcagcagggtcgaaggccggggatcggaggccgactattactgtcaggtgtgggatagtagtagcggtcagtgtgtagtttcggcggagggaccaaggctacggaccgtccgtaggtcacggcccgaaggcctcggccccccgttcggtacctaccgtccgttccgttcccccaccccgttccctaccccgaaccggtacgtaacggttacctcggacggccggggtaccg

SEQ ID NO: 129 - DNA, 571 bp, Homo sapiens
  misc_feature: GYAE6OF01DRB5O.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcagaggccaggccaggccctatactggtcatctattataataccgtccgccctcagggactccctgacgcgactctctggcctccaactcgtagggaaccacggcccaccctgaccgtcagcgagggtcgaaggccggggatcggaggccgactattactgtcgaggtgtgggatagtagtagcggtcagtgtgtagtttcgggcgggaggaccgaagcgtagaccgtcgtacggtcgacgcccgaaggcctccgcccccgtcggtcctacgttccgtccgttccccgccccttcccgtccgcggtaacgg

SEQ ID NO: 130 - DNA, 556 bp, Homo sapiens
  misc_feature: GYAE6OF01A7HQQ.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctagtgggggagacaactttgatagtaaaagtgtgcactggtaccagcagaggccaggccaggcccctatactggtcatctattataataccgtccggccctcagggatccctgagcgactctctggctccaactctgggaacacggcccacctgacccgtcacgcgagggtcgaaggccggggatgaggccgactatactgtcaggtgtgggagtagtagtagcggtcatgtgtagtttcgggcggagggtaccgaagcgtgaccgtccgtaggtcacgcccgaaggcctcgcccccgtcggtccacctcgtcgttccccgccctccctcccgacgtaacgg

SEQ ID NO: 131 - DNA, 597 bp, Homo sapiens
  misc_feature: GYAE6OF01BXXTG.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcaggatccctgagcgactctctggctccaactctgggaacacggccaccctgaccgtcagcacgggtcgaaggccggggatggacggccgactacttacgtgtcaggtgtgggataggtagtgcggtcagtgtgtagttttcgggcggagggaccgaagcgtacggaccgttccgtaggtacctacggaccccgtaaggccgtcggcccccgtcggtccctaccgttccgtccgttccccggtcccctccctcccgaccgtacggtacgtaccgtcgacggccgggtacgg

SEQ ID NO: 132 - DNA, 550 bp, Homo sapiens
  misc_feature: GYAE6OF01A3AKU.19.26.C04.1.454.CMB.1.raw
tcagtactctcgtgcacgaccggtgctcgatttagtctagcgactttgggtttgggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtggggagacaactttgatagtaaaagtgtgcactggtaccagcagaggccaggccaggcccctatactggtcatctattataataccgtccggccctcagggatccctgagcgactctctgctccaactctgggaacacggccacctgaccgtcagcagggtcgaagccgggatggaggccgactattactgtcgaggtgtgggataggtagtagcggtcagtgtgtagttttcgggcggtagggaccaaggctagaccgtctaggtcacgcccaaggctcgcccccgtcggtccacgtctcgtccccacccgtccctccgaccgagacgtactgcgcggtcg

SEQ ID NO: 133 - DNA, 540 bp, Homo sapiens
  misc_feature: GYAE6OF01B0FFG.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggccctatactggtcatctattataataccgtccggccctcagggatccctgagcgactctctggctccaactctgggaacacggccaccctgaccgtcagcagggtcgaagccggggatgaggccgactattactgtcaggtgtgggagtagtagtagcggtcatgtgagtttcggcggagggaccgaagctggaccgtcgtaggtcgacgcccgaaggcctcgccccgtcggtccactctcgtccccaccctccctccgcgtacg

SEQ ID NO: 134 - DNA, 645 bp, Homo sapiens
  misc_feature: GYAE6OF01BXO40.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggacttccctggtgggggagacaactttgataagtaaaagtgtgcactggtaccagcagaggccaggccaggccctatactggtcatctattataataccgtccgccctcagggactccctgacgcgactctctggctccaactcgtggaaccacggccacccgtgacccgtcacgcgacggggtcgaacgggccggggagtcggacgggaccgtacgtacgttacgtggtaccgtagggtggtaggggtaagtagggttagtacggtcggttcgtaagttggttagtacgtttttacggggacgggtacggggaaccgaaggtccgtacggacccggttccgtacgggtccgacgacccgaacggccgtaccgtcccccgtcggtcctacccgttcgttcccgttcccccgtaccccttcccctcccgacgtaaccgg

SEQ ID NO: 135 - DNA, 560 bp, Homo sapiens
  misc_feature: GYAE6OF01D5P4T.19.26.C04.1.454.CMB.1.raw
  modified_base (405)..(406): a, c, t, g, unknown or other
  misc_feature (405)..(406): n is a, c, g, or t
  modified_base (519)..(519): a, c, t, g, unknown or other
  misc_feature (519)..(519): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaaggtaaaatatattatggagactccgtgaagggccgattcaccatctccagagacaattccaaagaacacagtggatctgacaaatgaaacagcctgagagcgtggggacacggctgtgtattactgtgcgagagcggnnggcaactacatccattacggttggacgtcgtgggaccaagggaccacggtcacgtcgtcctccccgagccctaccgaccgaacgggccctaacgtccggtacccttcccccgngggacccgtccccgtcgccctaccgacggcgccgtaccccg

SEQ ID NO: 136 - DNA, 578 bp, Homo sapiens
  misc_feature: GYAE6OF01ED332.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggccctatactggtcatctattataataccgtccggcctcagggactccctgagcgactctctggctccaactctagggaacacggccaccctgaccgtcagcagggtcgaaggccggggatgaggccgactattactgtcaggtgtgggatagtagtagcggtcagtgtgtagttttcgggacggagggaccgaaggcgtcggacccggttccgtaaggtccacggccccgaagggccgtacgccccccgtcggtccctactccgttccgttaccccaccccttcccctcccgaccggtaacgg

SEQ ID NO: 137 - DNA, 866 bp, Homo sapiens
  misc_feature: GYAE6OF01D1BZZ.19.26.C04.1.454.CMB.1.raw
  modified_base (160)..(160): a, c, t, g, unknown or other
  misc_feature (160)..(160): n is a, c, g, or t
  modified_base (177)..(177): a, c, t, g, unknown or other
  misc_feature (177)..(177): n is a, c, g, or t
tcagtactctcgtgcacgaccggtgctcgatttagtctagcgactttgggttggggggagagggagcccagcactagaagtcggcggtgtttccattcggtcgatcagcactgaacacagaggactcaccagtggaggtttggctgagctgggttttccncgttgcttcttttaagnggtgtccagtgtcaggtgcacctggtcggagtcgtgggggagcgtggtcccagccgtggggacgttccctggagtacttctccgttggtcgccgacgcccttcgtacgggtaacctttccaaccctttccgaagttaccggtcttttcgggacctaacgtacccgtaacggtttccggggtaccccgcccgtaacgggtccttacccggaacggggtaccgaaacgggggggtcccttaagggtacggggttcggggtacggaccctaaggtttaactaacgttaccgtaattaacggtggtaacggttaggggtaaaacggtttaaaaaatcggttttaaacgtttaacgggtacgggtaaccgtaaccccgggttaccgggttaacggggaaaccggggtacccgttaacgtttaacccgtaaccgttacgtacccgttaccgtaacgggtaaacgtaaaccgtaaacctttacccgaaaacgtaacccgtaacggtacggtaggtaccgttacgtacgaactaaacgtcggaaacctcggtaccgagacggtaccgacggtaccgggaacgaccgggtcgttacggttacgttaacgttaccgtcgggtaccggacggtaacgggaccgtacggtcgtaacggtacctaaccgtacgtaccggtaccgttacgggtttaccggggg

SEQ ID NO: 138 - DNA, 622 bp, Homo sapiens
  misc_feature: GYAE6OF01AT3ZZ.19.26.C04.1.454.CMB.1.raw
  modified_base (327)..(327): a, c, t, g, unknown or other
  misc_feature (327)..(327): n is a, c, g, or t
  modified_base (329)..(329): a, c, t, g, unknown or other
  misc_feature (329)..(329): n is a, c, g, or t
  modified_base (362)..(362): a, c, t, g, unknown or other
  misc_feature (362)..(362): n is a, c, g, or t
  modified_base (452)..(452): a, c, t, g, unknown or other
  misc_feature (452)..(452): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattcccgtggtgggggagacaactttgataagtaaaagtgtgcactggtaccagcagaggccaggccaggccctatactggtcatctattataatacccgtccgccctcagggatcccngngcgactctcgtggcctccaactcgtcgggaacnccggccaccctgacccgtcagcgagggtcgaacggccggggatcggaggccgactattacgtgtcaggtggtgggatagtagtagcggtnagtgtgtagttttcgggacggtagggtaccgaaggtcgtacggtacccgtccgtacgggtccgaccggtacccgaacgggtccgtccggtccccccgttcgggtaccctaccgttcccgttccggttaccccccgtaacccccttccccttacccgtacccggtaaccgg

SEQ ID NO: 139 - DNA, 605 bp, Homo sapiens
  misc_feature: GYAE6OF01BCTBI.19.26.C04.1.454.CMB.1.raw
  modified_base (353)..(353): a, c, t, g, unknown or other
  misc_feature (353)..(353): n is a, c, g, or t
  modified_base (446)..(446): a, c, t, g, unknown or other
  misc_feature (446)..(446): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccagggattccctgtgggggagacaactttgatagtaaaagtgtgcactggtaccagcagaggccaggccaggcccctatacgtggtcatctattataataccgtccggccctcagggactccctgagccgactctctggctccaactctgggaaccncggccaccctgaccgtcagcagggtcgaaggccggggatcggacggccgactacttactgtcgaggtggtagggattaggtagtaggtcggtnagtgtagtgttttcggcggacgggaccagcgtcgtaccgtccgtaggtccacgtacccgaacggtccgtccgcccccgtccggttcctaccgtccgttccgttcccctacccctccctcccgaccgacgtacgtacctggacggccgggtcgtaccggg

SEQ ID NO: 140 - DNA, 595 bp, Homo sapiens
  misc_feature: GYAE6OF01DC9O6.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggacttcccgtggtgggggagacaactttgataagtaaaagtgtgcactggtaccagcagaggcaggccaggcccctatactggtcatctattataataccgtccggcctcagggactccctgacgcgactctctggctccaactcgtacgggaaccacggccaccgtgaccgtcagcgagggtcgaaggccggggatcggacggccgactagttacgtgtacgaggtgtgggtagtaggtagtaggcggtcagtgtgtagtttcggacggtaggacgagcgtcgaccgtacgtaggtacacgcccgaacggcgtccgcccgtcggtcctactccgtccgttccccgcccctcccgtacccgacgacgtacgtacgtaggacggtcggtcgtacggg

SEQ ID NO: 141 - DNA, 592 bp, Homo sapiens
  misc_feature: GYAE6OF01ENT8F.19.26.C04.1.454.CMB.1.raw
  modified_base (151)..(151): a, c, t, g, unknown or other
  misc_feature (151)..(151): n is a, c, g, or t
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (176)..(176): a, c, t, g, unknown or other
  misc_feature (176)..(176): n is a, c, g, or t
  modified_base (178)..(178): a, c, t, g, unknown or other
  misc_feature (178)..(178): n is a, c, g, or t
  modified_base (182)..(183): a, c, t, g, unknown or other
  misc_feature (182)..(183): n is a, c, g, or t
  modified_base (186)..(186): a, c, t, g, unknown or other
  misc_feature (186)..(186): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(192): a, c, t, g, unknown or other
  misc_feature (192)..(192): n is a, c, g, or t
  modified_base (210)..(210): a, c, t, g, unknown or other
  misc_feature (210)..(210): n is a, c, g, or t
  modified_base (232)..(232): a, c, t, g, unknown or other
  misc_feature (232)..(232): n is a, c, g, or t
  modified_base (238)..(238): a, c, t, g, unknown or other
  misc_feature (238)..(238): n is a, c, g, or t
  modified_base (255)..(255): a, c, t, g, unknown or other
  misc_feature (255)..(255): n is a, c, g, or t
  modified_base (259)..(259): a, c, t, g, unknown or other
  misc_feature (259)..(259): n is a, c, g, or t
  modified_base (267)..(267): a, c, t, g, unknown or other
  misc_feature (267)..(267): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagcggngttcgctaggcgctaanagncagtntnagtnnacngngntntgggagcgtgcagctggngtcctgagctctctgtgcagcnctggtntctctcagtagtctgcnctcncgtgcgcncgcncgcgcgaggngagnggtggtgngtagtatatanatatgtagtagtaagtaaataatatagtagtacgtacgtacgtaggacggtacgtacgtacacgtactaccgtacgacgaacgtaacctaacgtaacgtaaacgaaccaacgtacggtacgtagtacgtacgaacgtaacgtaacgaacgtaacgtacgtagtacggtacggacgggtacgggacgacggtacgtagttagttacgttacgttaggtacggtaggacggacggacggtcggtaccggtaaccgtaacgttaaccgtaccgttacgttacggttacggg

SEQ ID NO: 142 - DNA, 592 bp, Homo sapiens
  misc_feature: GYAE6OF01EL2JT.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcagaggccaggccaggcccctatactggtcatctattataataccgtccggccctcgagggactccctgacgcgactctctgctccaactctagggaacacggccaccctgaccgtcagcgagggtacgaacggccggggatggacggccgacttattacgtgtcgaggtggtgggagtagtagtaggcggtcagtgtgtagttttcgggcggacgggaccagcgtcgaccgtcgtaggtcacgcccgaaggcctccgccccgtcggtcctaccgttccgtccgttccccaccccttccctacccgacgacgtacgtacgtaggcggccgggtgtacggg

SEQ ID NO: 143 - DNA, 693 bp, Homo sapiens
  misc_feature: GYAE6OF01B8CGS.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtacagcagaggcaggccaggccctatactggtcatctattataataccgtccggcctcagggactccctgacgcgactctcgtcggcctaccaactcgtacgggaaccaccggccacccgtgacccgtcgagcgacgggtacgaacggccggggaatcggaacggcccgtaacttacgttacgtcgtacgtaggttggtagggaattaggttaaggtaggcggttacgagttggtaggtagttttcgggacgggtaacgggtaaccgaaacggtcgttacggaacccggttaccggtagggttaccaaccggaccccgtaagggcccgtacccggtcccccggtacgggtaccctaccgttcccgtccggtttacccccaccccgttcccgttaccccgaacgggttaccgaacggttacccgtagggcggtcccggggcgtacgggg

SEQ ID NO: 144 - DNA, 543 bp, Homo sapiens
  misc_feature: GYAE6OF01E1MTF.19.26.C04.1.454.CMB.1.raw
  modified_base (530)..(530): a, c, t, g, unknown or other
  misc_feature (530)..(530): n is a, c, g, or t
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaagcggggatgaggccgactattactgcaggtgtggatagtagtagcggtcatgtgagttttcggcggaggaccaagcgtgaccgtcctaggtcacgcccaaggctcgcccctcgtcactccgtcgttccccgccctccctccacgacgacgtacngacgcggcgtcgg

SEQ ID NO: 145 - DNA, 800 bp, Homo sapiens
  misc_feature: GYAE6OF01DXNC3.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgaccctccatggtggtgactcacgcccaccctcagtgtcaggtcggccccgaggagaggaccggcgaggtacttccgtgggtggggagactacgttgataagtaaagtgtgctacgtcggtacagacgaggacgccgacggccgacggacccctagtacgtcggtacacttacttattaataacgtaccgtcccggcctacgacggtactccgtgacgccgtactctacgtcggcctacacgtcggtacggaaccgaccgccgacccgtcggacccgtacgacgacggacggggtacgaacggggacgggtagtacggaccgggaccgtacgtttaacgttacgtcggtacggtaggggttcgggtaagggtaaggttaagttacgggtacgggtccgttaacgtaggttagggttacggtttacgggtttacggggaccgggtaacgggtaaccgtaacggtcgtaaccggtacccggttaccgtacgggtaccgaaccgtacccggaacgggtcccgtaccccggtcccccggttacgtaccccgttaccggttcccgtttaccccggtcccccgttaccccgttcccccggtacccggaaccggttaaccggtaccgtttacgggaccggtacccggggtcgggtccggtaaccgggg

SEQ ID NO: 146 - DNA, 636 bp, Homo sapiens
  misc_feature: GYAE6OF01AM6K7.19.26.C04.1.454.CMB.1.raw
tcagtactctcgtgcacgaccggtgctcgatttagtctagcgactttgggtttgggggtgaggttgagaacctatgaacattctgtagggccaccgttctcctcctcggcctccctctctcactcgcacaggtctctgtgacctcccatgtggtgactcagccaccctcagtgtcagtcggccccaggagaggacggcccaggattccccgtggtgggggagacaactttgatagtaaaagtgtgcactggtaccagcaagaggccaggccaggcccctatactggtcatcctattataatacccgtccggccctcgagggacttccctagagtcgactctctcggctcccaactcgtgggaacctccgggccacccgtgacccgtcgagcgacggggtccgaaagcccgggggatcggacggcccgtacgttacttacgtggtcgacgggtcggtgggtagtacggtaggtagtcggtcagtgtgtagttttcggcggtagggacgaagcgtgaccgtcgtacggtacgtacgcccgtaaggtcgtcggccccgtcggtcctaccgtccgtcgttccccgcccgttcccgtcccgaccgacggacgttaccgtggaccggtcgggtccgtccggg

SEQ ID NO: 147 - DNA, 572 bp, Homo sapiens
  misc_feature: GYAE6OF01AFVHX.19.26.C04.1.454.CMB.1.raw
  modified_base (435)..(435): a, c, t, g, unknown or other
  misc_feature (435)..(435): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggccccctatactggtcatctattataataccgtccggccctcagggatccctgagcgactctctggctccaactctgggaacacggccaccctgacccgtcacgcagggtcgaagccggggatggaggccgacgtattacgtgtcaggtgtgggatagtagtagcggtnagtgtgagttttcggcggagggaccaaggctggacccgtccgtagggtcaggcccaaggcctcgcccccgtggtccacgtcgtcgttccccacccgttcctccccacgaacgtacctgagccgggtcgtgggacccg

SEQ ID NO: 148 - DNA, 715 bp, Homo sapiens
  misc_feature: GYAE6OF01DAS1Z.19.26.C04.1.454.CMB.1.raw
  modified_base (370)..(370): a, c, t, g, unknown or other
  misc_feature (370)..(370): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggacttcccgtggtgggggagactaactttgataagtaaaagtgtgcacgtggtaccagcaggaggccaggccacggcccctatacgtggtcatctattataactaccgtccggccctacgaggactcccgtgacgcgtactctcgtcgcctaccgaactcgtacggaaccnccggacctacccgtacgacccgtcgacggcgtacgggtacgaacgggccgggagtacggacggacccgtaacttacgttacgtaggtccggtagggtggtagggtattaagggtacggtacggtcggttacaggttcggtaggtttacgtttccggggcgggtaacgggaccgtaacggtccgtacggaccccgttcggtacggtaccgacgtaccccgaacggccgtacccggtccccgtacgggtaccctaaccgtttcccgtacccggtttaccccccaccccgttccccgtacccgaacggtaccgtaacgttaccggtacggcgggtcccgggtaccggg

SEQ ID NO: 149 - DNA, 559 bp, Homo sapiens
  misc_feature: GYAE6OF01BMAAR.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagtcaccctcagtgtcagtggccccaggagagacggccaggattccctggtgggggagacaactttgatagtaaaagtgtgcactggtaccagcagaggccaggccaggccctatactggtcatctattataataccgtccggccctcagggatccctgacgcgactctctggctccaactctgggaacacggccacctgacccgtcagcagggtcgaaggccggggatgaggccgactagttacgtgtgaggtgtgggataggtagtagcggtcatgtgtagtttcggcgggagggtaccaaggctaggaccgtccgtaggtcacgcccgaaggccgtacgcccccgtcggtccacctccgtcgttccccaccctccctccgccgtaacgg

SEQ ID NO: 150 - DNA, 521 bp, Homo sapiens
  misc_feature: GYAE6OF01BZUFU.19.26.C04.1.454.CMB.1.raw
  modified_base (205)..(205): a, c, t, g, unknown or other
  misc_feature (205)..(205): n is a, c, g, or t
  modified_base (231)..(231): a, c, t, g, unknown or other
  misc_feature (231)..(231): n is a, c, g, or t
  modified_base (259)..(259): a, c, t, g, unknown or other
  misc_feature (259)..(259): n is a, c, g, or t
  modified_base (271)..(271): a, c, t, g, unknown or other
  misc_feature (271)..(271): n is a, c, g, or t
  modified_base (281)..(281): a, c, t, g, unknown or other
  misc_feature (281)..(281): n is a, c, g, or t
  modified_base (330)..(330): a, c, t, g, unknown or other
  misc_feature (330)..(330): n is a, c, g, or t
  modified_base (352)..(352): a, c, t, g, unknown or other
  misc_feature (352)..(352): n is a, c, g, or t
  modified_base (359)..(359): a, c, t, g, unknown or other
  misc_feature (359)..(359): n is a, c, g, or t
  modified_base (431)..(431): a, c, t, g, unknown or other
  misc_feature (431)..(431): n is a, c, g, or t
  modified_base (456)..(456): a, c, t, g, unknown or other
  misc_feature (456)..(456): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
  modified_base (491)..(491): a, c, t, g, unknown or other
  misc_feature (491)..(491): n is a, c, g, or t
  modified_base (495)..(495): a, c, t, g, unknown or other
  misc_feature (495)..(495): n is a, c, g, or t
  modified_base (497)..(497): a, c, t, g, unknown or other
  misc_feature (497)..(497): n is a, c, g, or t
  modified_base (506)..(506): a, c, t, g, unknown or other
  misc_feature (506)..(506): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagcgtggtttcgcgtagctctttaagaggtgtcagtgtcaggtgcacgtggtggagtcgngggggagcgtggtccaggcctggggngtccctgagactctccgtgtgcagcctnggattcaccttnagtgcttgcntcatggtccgcagctcaggctagggctagagtgggtagcagtttacatnaatagtgagtggaagtaaaatntagtagngacgtacgtcgaggaacggtctataccgacatacacgagaacactaactaacaaagaacagagtagataganaacaagtacgaacgagacgtagagngacggaggacacggntgtatgtacgtgtgagnggngcgngngacacgtanacgtacgtagttcgg

SEQ ID NO: 151 - DNA, 551 bp, Homo sapiens
  misc_feature: GYAE6OF01B0T0T.19.26.C04.1.454.CMB.1.raw
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggcctcagggatccctgagcgactctctcggctccaactctggaacacggccaccctgaccgtcacgcgagggtcgaagccggggatggacggccgatatacgtgtcgaggtgtgggatagtagtagcggtcagtgtgtagttttcgggcggagggaccagctgaccgtcgtaggtcgacgccgaagctcgccctcggtcacgtcgtcgtcccaccctcctccgacgacgcgtactgacgcggcgtacgg

SEQ ID NO: 152 - DNA, 618 bp, Homo sapiens
  misc_feature: GYAE6OF01ANRV8.19.26.C04.1.454.CMB.1.raw
  modified_base (265)..(265): a, c, t, g, unknown or other
  misc_feature (265)..(265): n is a, c, g, or t
  modified_base (270)..(270): a, c, t, g, unknown or other
  misc_feature (270)..(270): n is a, c, g, or t
  modified_base (311)..(311): a, c, t, g, unknown or other
  misc_feature (311)..(311): n is a, c, g, or t
  modified_base (341)..(341): a, c, t, g, unknown or other
  misc_feature (341)..(341): n is a, c, g, or t
  modified_base (394)..(394): a, c, t, g, unknown or other
  misc_feature (394)..(394): n is a, c, g, or t
  modified_base (571)..(571): a, c, t, g, unknown or other
  misc_feature (571)..(571): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagttttgggctgagcggtggtttcgcgtaggcgtctttaaagaggtgtcagtgtcaggtgcaccgtggtggagtcgtgggggagcgtggtccagccgtgggacgtccctgagctctcctgtgcagcctntggtnttccaccttcagttgctttggacacttccacgttcgggccnccgaggcctaccgaggcgaaggggctaggnggtgggtcgctagttatactcgtatatgaagtgggaaataaatagtaattagnggaagtcgttccggagggtaacggccgttaacttcaacctacgttacgacaaggtaacgactaaacttacccgaaagtaaccgtagtagtagtactcgacaacgtaactaacgaacgtacgtacgtagtaggacggacggtagggaccgtacggtacgtagttacgttacgttaggnggtacggcggagtacggcggtccgtaacgaactactcgtagtaccgg

SEQ ID NO: 153 - DNA, 630 bp, Homo sapiens
  misc_feature: GYAE6OF01D6J7Q.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtacagcagaggccaggccaggccctatactggtcatctattataataccgtccgcctcagggactccctgacgcgactctctcggcctccaactcgtacgggaaccaccgggacccacccgtcgacccgtcgacggcgagggtccgaacgggccggggagtcggacggaccgacgtagttacgtgtcgtaggtcggtagggagtaggtagtaggtcggtactagttgtgtacggttttcgggacgggtacgggtaccgacggtcgtacggtacccgtccgtacggtacgaccgaccgaacggtccgtccggtcccccgtcggtacctaccttccgttaccgttacccccaccccttccccgtcccgacgtaaccgg

SEQ ID NO: 154 - DNA, 560 bp, Homo sapiens
  misc_feature: GYAE6OF01BGT6V.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaagccggggatcgaggccgactatactgtcgaggtgtggatagtagtagcggtcatgtgtagttttcggcggtagggaccaagcgtgacccgtccgtaggtcacgcccgaaggctcgccccgtcgtccaccgtcgtcgttcccgccctccctacccgacgacgtacgtacgtgacgcggcgtcgg

SEQ ID NO: 155 - DNA, 618 bp, Homo sapiens
  misc_feature: GYAE6OF01A5B2D.19.26.C04.1.454.CMB.1.raw
  modified_base (439)..(439): a, c, t, g, unknown or other
  misc_feature (439)..(439): n is a, c, g, or t
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggccctatactggtcatctattataataccgtccggcctcaggctccctgacgcgactctcgtcggctccaactcgtgggaacaccggccacccgtgaccgtcacgcgagggtcgaaggccggggatggacggccgactattactgtcgaggtgtgggagtaggtagtagcgtanagtgtagtagttttcgggacggtagggaccgaacggtcgtacggtacccgtccgtacgggtcgacgacccgaaggcctaccggtcccccgtccggtcctaccgttccgtccgttccccctaccccttccccgtacccgaccgtacgtaccgtaccgtaggacggtcgggtccgtacggg

SEQ ID NO: 156 - DNA, 586 bp, Homo sapiens
  misc_feature: GYAE6OF01AWAV0.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggccctatactggtcatctattactaataccgtccggccctcgagggactcccgtgacgcgactctctggctccaactcgtagggaaccacgccacccgtgaccgtcagcgagggtcgaaggccggggagtcggacggccgacgtacttacgtgtcgaggtgtgggatagtagtagcgtcatgtgtagtttcgggacggagggaccaagcgtggacccgtcgtacggtacacggacccgaacggccgtacgcccccgttcggtccctaccgttccgttccgttaccccacccctccctcccgacggtaaccgg

SEQ ID NO: 157 - DNA, 572 bp, Homo sapiens
  misc_feature: GYAE6OF01D2OXU.19.26.C04.1.454.CMB.1.raw
  modified_base (349)..(349): a, c, t, g, unknown or other
  misc_feature (349)..(349): n is a, c, g, or t
  modified_base (559)..(559): a, c, t, g, unknown or other
  misc_feature (559)..(559): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccacactcagtgtcagtggccccaggagagacggccaggattccctgtgggggagacaactttgatagtaaaagtgtgcactggtaccagcagaggccaggccaggcccctatactggtcatctattataataccgtacgccctcagggactccctgagcgactctctggctccaactcgtgggaacncggccaccctgacccgtcagcgagggtcgaaggccggggatggacggccgactattactgtcgaggtgtagggatagtagtagcggtcagtgtgtagttttcggcggtagggaccagcgtgtaccgtcgtaggtcacgccgaggcgtaccgccccgtcggtccacgttccgtccgttccccgtccctcccgtccacgtacgtacgtacgngcggcgggtccgg

SEQ ID NO: 158 - DNA, 588 bp, Homo sapiens
  misc_feature: GYAE6OF01AGNNF.19.26.C04.1.454.CMB.1.raw
  modified_base (449)..(449): a, c, t, g, unknown or other
  misc_feature (449)..(449): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcagaggccaggccaggccctatactggtcatctattataactaccgtccggccctcacgggactccctgagcgactctctggctccaactctagggaacacggccaccctgacccgtcagcgagggtcgaacggccggggatggacggccgactacttactgtcagggtgtgggatagtagtagcggtnagtgtgtagttttcggcgggagggaccgaagcgtacggacccgtcgtacggtcacggacccaagggtcctccggtcccccgtcggtccacccttccgttccggttacccccaccccttcccctacccgccggtaaccgg

SEQ ID NO: 159 - DNA, 599 bp, Homo sapiens
  misc_feature: GYAE6OF01CGEJ3.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcgagggactcccgtgacgcgactctctggctccaactcgtgggaaccacggccaccctgacctcgagcagggtcgaacggccggggatggacggccgacttagttactgtcgaggtggtggagtaggtagtaggcggtcagtgtgtagttttcggcggagggaccaagcgtcgaccgtacgtacggtcgacgacccgaaggccgtcgacccccgtcggtccaccgttccgttccgttccccgcccctcccgtcccgaccggtacgtacgtaccgtgacggccgggcgtacggg

SEQ ID NO: 160 - DNA, 635 bp, Homo sapiens
  misc_feature: GYAE6OF01D8HU4.19.26.C04.1.454.CMB.1.raw
  modified_base (340)..(340): a, c, t, g, unknown or other
  misc_feature (340)..(340): n is a, c, g, or t
  modified_base (362)..(362): a, c, t, g, unknown or other
  misc_feature (362)..(362): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtcggccccaggatagacggccaggattccctggtgggggagacaactttgatagtaaaagtgtgcactggtaccagcagaggccaggccaggccctatactggtcatctattataactaccgtccggcctcgagggactccctgagcgactctcnggctccaactcgtagggaaccncgaccaccctgaccgtcagcgagggtcgaacggccggggatcggacgggccgtaacttacgttacgtgtacgagggtcggtagggtattaaggtaggtaggtcggtactagttggtggttagttttcggggacgggagggtaccaaggcgtcggaccgttaccgtagggtccacggtaccccgaaggcccgttaccggccccccgttcgggtacccctaccgttcccgtttcccggtaccccctacccccgttcccgtcccgaacggtaacgg

SEQ ID NO: 161 - DNA, 640 bp, Homo sapiens
  misc_feature: GYAE6OF01D0UBY.19.26.C04.1.454.CMB.1.raw
  modified_base (321)..(321): a, c, t, g, unknown or other
  misc_feature (321)..(321): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgataagtaaaagtgtgcactggtaccagcagaggccaggccacggcccctatactggtcatctattataataccgtccggccctcgaggactcccngacgcgactctctggctccaactctacgggaaccacggcccaccctcgacccgtcacgccgagggtacgaacggcccggggatcggaggtcgacgttattacgtgtcgaggtgtagggaataggtagtaggtcggtcgagtggtagtacgtttcgggacgggtaacggtaccgaagtcgtacgtaccgtaccgtacggtccgacggaccgaacggtccgtccggtcccccgtcggtcctaccgttcccgtcccggttcccccgtccccttccccgtacccgacgaccgtacgtaccgtggaccggccgggtcgtaccgg

SEQ ID NO: 162 - DNA, 539 bp, Homo sapiens
  misc_feature: GYAE6OF01AXZFK.19.26.C04.1.454.CMB.1.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggctggcaactacatccattacggtttggacgtctggggccaagggaccacggtcatcgtctccccagcctccaccaacgggccccagtccggtcttcccccccgtcggccgccccgtcgcccaccgacggcgccctacccg

SEQ ID NO: 163 - DNA, 658 bp, Homo sapiens
  misc_feature: GYAE6OF01A0HL4.19.26.C04.1.454.CMB.1.raw
  modified_base (419)..(419): a, c, t, g, unknown or other
  misc_feature (419)..(419): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctggggaggtccctgagactctcctgtgcagcctctggattccaccttcagtagtctttggccactccacgtcgggtcccgccgaggcctccgaggccgaaggggctaggaggtgggtggctagttatatacatatgagtaggaagtaaatatagttatggagtaccgtcgtaggaacgggtccgtattanacccccccccccccctatcctaccgaacgaacgaactaacttaaccgaaacgaaaccgaacgtaaggtacgacgtacgtacgaacgtaaacgtaacgaacgaacgaccgtaggaacggtacggtacggtacgggaccggacggtcgttacgtacgttacgttacgtaggtcggtacggacggtacggacgggtacgtacggtaccgtaacgtaactacgtaccgtacggtttaccgggg

SEQ ID NO: 164 - DNA, 573 bp, Homo sapiens
  misc_feature: GYAE6OF01AKTBN.19.26.C04.1.454.CMB.1.raw
  modified_base (349)..(349): a, c, t, g, unknown or other
  misc_feature (349)..(349): n is a, c, g, or t
  modified_base (514)..(514): a, c, t, g, unknown or other
  misc_feature (514)..(514): n is a, c, g, or t
  modified_base (557)..(557): a, c, t, g, unknown or other
  misc_feature (557)..(557): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggcccctcagggatccctgagcgactctctggctccaactctgggaacncggccaccctgaccgtcagcagggtcgaaggccggggatggaggccgactattactgtcaggtgtgggatagtagtagcggtcagtgtgtagttttcggcgggtagggaccgaagctcggaccgtccgtaggtcgacgcccgaaggcctcgcccccgtcggtccnccgtccgtcgttccccacccgtccctcccacgacgtacgtacngacggcgggcgtcggg

SEQ ID NO: 165 - DNA, 683 bp, Homo sapiens
  misc_feature: GYAE6OF01DVMMA.19.26.C04.1.454.CMB.1.raw
  modified_base (262)..(262): a, c, t, g, unknown or other
  misc_feature (262)..(262): n is a, c, g, or t
  modified_base (289)..(289): a, c, t, g, unknown or other
  misc_feature (289)..(289): n is a, c, g, or t
  modified_base (315)..(315): a, c, t, g, unknown or other
  misc_feature (315)..(315): n is a, c, g, or t
  modified_base (320)..(320): a, c, t, g, unknown or other
  misc_feature (320)..(320): n is a, c, g, or t
  modified_base (355)..(355): a, c, t, g, unknown or other
  misc_feature (355)..(355): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggagcgtggtccagcctgggaggtccctgagactctcctgtgcagcctctggattcaccttcagtagctttggcatccacgtcgggtccgccaggcctccgagggccgaaggggctaggaggtggggtgctagttanatcatatgatggaagtaaatatattanggagactcgtagacggcatcacatcncaganacaatcaagacagagtgatctgaacaaatcgaacngctagagacgtcgtaggggacacggtctaggttagttagttcgtaggtcggacggaggacggcggacgtggaacctaactaacgtacttaccgttaacggttttacgggtttacgggacggttaccgggttacgggggaacccgtaaacggggaccccgttaacgggtaccgtacgttccccggttacccgtcccccgaacgtccccgttaaccccgaacccggaaccgggtcccctacggttccccgggttccccttccccccggtcgggacccccgtccccgttcggaccccgttacccggaacgggtcccgcccgtaaccccggg

SEQ ID NO: 166 - DNA, 714 bp, Homo sapiens
  misc_feature: GYAE6OF01DECQU.19.26.C04.1.454.CMB.1.raw
  modified_base (403)..(403): a, c, t, g, unknown or other
  misc_feature (403)..(403): n is a, c, g, or t
tcagtactctcgtgcacgaccggtgctcgatttagtctagcgactttgggtttggggctgggagaggagtccagcactagaagtcggcggtgtttccattcggtgatcagcactgaacacagaggactcaccatggagtttgggctgagcttgggttttcctcgttgctcttttaagaggtgtccagtgtcaggtgcacctggtggagtcgtgggggaggcgtggtccaggccgtgggacgtccctgacgactctcctgtgcagcctcgtggacttccacctttcagtagtctttggcactccgacgtcgggtcccgccaggcctccgagggccgaagggggtctaaggaggttggggtgactaggttatatcattatggaagtagggtaaagttaaaaattnttaattagtagggaacgtaccgtccgggtaggaacgggtccgtattaccaccgtacttcctaccgaagacgtaactaaacttaccaaacgaaccaacgtaggtacgtactacgtacgaactaaagtcgaaaccgtacggaccgtaggaacggtacggtaccgggttagggggaaccgtaaccggggtacgttacgggtttacggttaaacgttttaaccggttgggttacgggtaaccgggaagggtaacgggtcccgggtacggttacgggaacccttaaacccgttaacgttaaccgtttaaccccggg

SEQ ID NO: 167 - DNA, 540 bp, Homo sapiens
  misc_feature: GYAE6OF01D5MOE.19.26.C04.1.454.CMB.1.raw
  modified_base (346)..(346): a, c, t, g, unknown or other
  misc_feature (346)..(346): n is a, c, g, or t
  modified_base (492)..(492): a, c, t, g, unknown or other
  misc_feature (492)..(492): n is a, c, g, or t
  modified_base (508)..(508): a, c, t, g, unknown or other
  misc_feature (508)..(508): n is a, c, g, or t
  modified_base (518)..(518): a, c, t, g, unknown or other
  misc_feature (518)..(518): n is a, c, g, or t
  modified_base (524)..(524): a, c, t, g, unknown or other
  misc_feature (524)..(524): n is a, c, g, or t
  modified_base (531)..(531): a, c, t, g, unknown or other
  misc_feature (531)..(531): n is a, c, g, or t
  modified_base (533)..(533): a, c, t, g, unknown or other
  misc_feature (533)..(533): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggactccctgagcgactctctgctcactcgtggaacncgccacctgaccgtcagcgacgggtcgaaggccggggatggaggccgactacttacgtgtactagggtcgtgggtagtagtaggtagcggtactagtgtgtattttcgggacgaggacgaagcgtgaccgtcgtagtcagccagcncgcccgtcgcacgtcntcccgcctcnccacgnacgtacngngcggtcg

SEQ ID NO: 168 - DNA, 702 bp, Homo sapiens
  misc_feature: GYAE6OF01A3P0P.19.26.C04.1.454.CMB.1.raw
  modified_base (264)..(264): a, c, t, g, unknown or other
  misc_feature (264)..(264): n is a, c, g, or t
  modified_base (277)..(277): a, c, t, g, unknown or other
  misc_feature (277)..(277): n is a, c, g, or t
  modified_base (308)..(308): a, c, t, g, unknown or other
  misc_feature (308)..(308): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcactggtggagtcgtgggggagcgtggtccagccgtgggacgtccctgacgactctcctgtgcagtcctntggattcaccttnagtagtctttggcatccgacgtcgggtcccnccgaggcctaccgaagggaccgaaaggggggtctaagggtacgggttggggtacgtactaaggtttaactagtacgtaagttagtagtaagttaagggtaaaagttaaaattagttaacgttaagtaggaacgtaccggttacggtaaggaacggtacctacttaccactacgtacctaacgtaacgaacgtaactaacgtaaccgaaacgaactacgtagtagtaactacgtaacgaactaacgtaacgaacgtacggtaacgtacggacgtacggtacgggtacgtaacggtacgttacgttacggttacgttacgtaggtacggaggtacggacgtcggtacgtacgtaaccgtactacgtaccgttacggttaccgttggttaacccggg

SEQ ID NO: 169 - DNA, 643 bp, Homo sapiens
  misc_feature: GYAE6OF01AP5C2.19.26.C04.1.454.CMB.1.raw
  modified_base (303)..(303): a, c, t, g, unknown or other
  misc_feature (303)..(303): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggagcgtggtccagcctggggaggtccctgagactctcctgtgcagcctctggattcaccttcagtagtctttggcatccacgtggggtccnccaggcctccgaggccgaagggggcctaggaggtggggtggcaggtttatatcaatatgatagggaaggttaaaatataattagtggagtactccggtaggaacgggcctaattccacctatcctaccaagtacgaactaaacttaccgaaagaaaccacgaaggtaggtataccgtagaactaaagtacgaaacacgtacctaggaacggtaacggacggttacgggggaaccgaacgggtcgttaggttacggttaactacgttaggtcggacggtaaggacggcgggacgttacgggaacctaacgttaaccacttcccgttaaggtttaaccgggg

SEQ ID NO: 170 - DNA, 788 bp, Homo sapiens
  misc_feature: GYAE6OF01B1UOO.19.26.C04.1.454.CMB.1.raw
  modified_base (182)..(182): a, c, t, g, unknown or other
  misc_feature (182)..(182): n is a, c, g, or t
  modified_base (287)..(287): a, c, t, g, unknown or other
  misc_feature (287)..(287): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccagtggagtttgggctgagcgtgggttttcctcgttgtcttcttttaaggnggttcgtccagtgtcaggtcgctaccgttggtggaggtcggtgggggacgtcgtcggtccaggtcccgttggggacgtcccgtagacgtccttctcgtgtcgacngtcccgtgtgtacttccacttgtaggtcttcgttggacctacgtcccgtacggttcgggccccgacgacggtccctaccggaggtaccggaaaggggtcctaagggtcgggtacggggtcgtaacgttagtttaacgtacgtacttaaagtgttaacggaagttaaaggggtaaaatttaaaatggtttaagtttaacgggacgggtaacgttaaacccggttcggggttaaagggaaccgggttcccgttaaagttccccaaacgttcgtacccgtaacgaaggtaacctaacgtaaaccttaccgaaagtaccgtaacgtagttacggacttacgtacgaaagtaacgtccggaaactacggtaccggtagaacgggtccggtaacgggtacgggtacccaaccggtttgtaacggtttcgttaacgtttcggacgggtcggtaaacggccgaggggttccgaccttacggaaacctaacggtcgtaacgttacccggg

SEQ ID NO: 171 - DNA, 757 bp, Homo sapiens
  misc_feature: GYAE6OF01BLL1W.19.26.C04.1.454.CMB.1.raw
  modified_base (218)..(218): a, c, t, g, unknown or other
  misc_feature (218)..(218): n is a, c, g, or t
  modified_base (319)..(319): a, c, t, g, unknown or other
  misc_feature (319)..(319): n is a, c, g, or t
  modified_base (378)..(378): a, c, t, g, unknown or other
  misc_feature (378)..(378): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagcccaccctcagtgtcagtggccccaggagagacggccaggattccctggtggggganacaactttgataagtaaaagtgtgcactggtaccagcagacggccacggccacggcccctatacgtggtcatctatatataccgtccgcctcaggactccngacgcgtactcgtctacggctaccaactcgtacggaaccacggccaccctggacccgtnacgcgacgggtacggaacggccggggagtacggacggaccgtacgttacgttaccgtggtacggtagggttcgggtagggtaacgttaaggtaacgggttacggtaccgggttataaggtttcgggtggtttacggttttcgggggaccgggtaaacgggtaccgtaacgggtccgttaccggtacccgggttaccgttaaccggggtacccgtaaccgggtaccccggtaacgggtcccggtcccgggttaccccccggttaccggttcccgttaaccccgttccggttcccggttaccccccgtcccccgttcccgttaaccccggaccgtacggtaaccctttcggaccgggaccgtccggggtccggtaccgggg

SEQ ID NO: 172 - DNA, 814 bp, Homo sapiens
  misc_feature: GYAE6OF01EQKFM.19.26.C04.1.454.CMB.1.raw
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagactaactttgataagtaaaagtgtgcactggtaccagcagacggccaggccacggcccctatactggtcatctattataactaccgtccggccctcgaggactcccgtgacgcgactcgtccgtggcctaccaactccgtacgggaaccacccgggccctaacccgtcgacccgtacacgacgacggggtaccgaacgggccgggggagttacggacgggaccccgtaacgttacgtttaaccgttcggttaccggtaggggttacggggttacggggtaaggtttaacgggttaaagggttaacgggtaccgggtttaccggtaggtttagggtttacggtttaacgggttttttacggggaccgggggtaacggggtaacccgtaacgggtaccggttaccgggtaacccggttacccggttacgggttacccgaacccgggtacccgaacgggtcccgttaccccgggtcccccgttaccgggttaccctacccgtttcccgttcccggtttaccccctacccccgttcccgttaccccgaacggtaccggtaacgttaccggtacgggacgggtccgggtccggtaccgggg

SEQ ID NO: 173 - DNA, 687 bp, Homo sapiens
  misc_feature: GYAE6OF01A688H.19.26.C04.1.454.CMB.1.raw
tcagtactctcgtgcacgaccggtgctcgatttagtctagcgactttgggtttgggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctggtgggggagacaactttgataagtaaaagtgtgcactggtaccagcagaggccaggccaggccctatactggtcatctattataataccgtccgcctcagggatccctgagcgactctctcggcctccaactcgtgggaaccaccggcccacctggaccgtcacgcgaggggtcgaacgggccgggggatgggacgggccgtacgtaacgtttacgtggtaccgtagggttggtaggggaacttagggtagtaggtcggtcgagttggtgtacgttttacggggcgggacggggtaacccaggtcgtacggaccgttcccgtaacgggttccaggtaccccccgtaaagggtcccgttcccgggtacccccccgttccggggttacccctacccgtttaccccggttcccgggtttaccccccggtaccccccctttcccggttacccccgaacccggggtaaacccggg

SEQ ID NO: 174 - DNA, 721 bp, Homo sapiens
  misc_feature: GYAE6OF01EZ773.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctggtgggggagacaactttgataagtaaaagtgtgcactggtaccagcagaggccaggccacggcccctatacgtggtcatctattataataccgtccggccctcgagggactccctgagcgactctcgtgcctccaactcgtagggaaccaccggcccaccctcgacccgtcgacgcgacgggtcggaacggcccgggggatacggacgggccgtaacgttatttacgtcgtacgtagggtggtacgggtaagtaaggttaggtacggtcggtacgtagttggttaggttacggttttccggggacgggtaacgggtacccgaaggtaccgttacgggtaacccggttaccgtacgggttaccgaaccggacccgtaacgggtcccgtccgggtacccccccgttccgggtacccttacccgttcccgttaccccgttaccccccgtaccccgtccccgtacccgaacccggtacgtaacggttacccgtacgggaccgggtcgggtacccggg

SEQ ID NO: 175 - DNA, 756 bp, Homo sapiens
  misc_feature: GYAE6OF01C5QYE.19.26.C04.1.454.CMB.1.raw
  modified_base (235)..(235): a, c, t, g, unknown or other
  misc_feature (235)..(235): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagcccaccctcagtgtcaggtcggccccagggagaggacggccgaggacttcccgtgggtaggggganaactaactttgaataagtaaaagtgtgcactggaccagcagaggccacggccacggccctatacgtggtcatctaattataacgtaccgtccgccctacgacgggtactcccgtggacgccgactcgtcgtcggcctaccaaacgttcgtacgggaaccaccggaccccacccgtacgacccgtcgaacggcggtaacgggtaccggaacgggccgggggaagtcgggaacgggtacccgtaacttacgttaaccgttcggtacgtagggtgggtagggtacgtaaggtagtacggtacgggttcgtaggttggttaggttacggttttaccggggacgggtaacggggtaccgtaagggtccgttaaccggtacccgggttaccgtaacgggttacccgacggaccccgtaagggtcccgtaccccggttaccccccggtttacggttacccgttcccggtttcccggttaccccccgttccccgttaccccgttaccccgaacggtaccgggtaaccgg

SEQ ID NO: 176 - DNA, 793 bp, Homo sapiens
  misc_feature: GYAE6OF01ENBV7.19.26.C04.1.454.CMB.1.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcactggtggagtcgtgggggagcgtggtccagcctgggaggtccctgagactctcctgtgcagcctctggattcacctttcgagtagtctttggctactccactcgggtcccnccgaggcctcccgaagggccaaagggggtcctaggacggttgggnggactagttatatcaatatgagtagggaaaggtaaaaatcttaagttagtggaacgtaccgttaccggttaggaaacggggtcccgtaatttacccaaccctaacgttccctaacccgaagtaacggtaaacctaaacgtttaacccaaaagggaaaccctaacgaacggttacgggaaacttaccgttacggaacgtaaaacgttaccggaaaacctaacgggtaccccgttaagggaaacggttaacgggaccggttaacgggggggaacccgtaaccggggttcccgttaagggtttaacggtttaaaccgtttaaccgttaggggttacgggtaaccgggtaacgggtaaccgggtccggggtaccgttacggggtaaccctaaaacccgttaacccgtaacgttaacccccgttaagggtttttaaaccccgggggg

SEQ ID NO: 177 - DNA, 600 bp, Homo sapiens
  misc_feature: GYAE6OF01B0HRX.19.26.C04.1.454.CMB.1.raw
  modified_base (322)..(322): a, c, t, g, unknown or other
  misc_feature (322)..(322): n is a, c, g, or t
  modified_base (458)..(458): a, c, t, g, unknown or other
  misc_feature (458)..(458): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcacgtggtaccagcagaggccaggccacggcccctatactggtcattctattataataccgtccggccctcagggactcccngagcgactctctaggctccaactcgtacggaacacgccacctcgaccgtcacgcgaggtcgaagccggggatcggacggccgacgtattacgtgtcgaggtgtggatagtagtagcgtacagtgtgtagtttcggnggtaggacagctcgaccgtcgtacggtacgacgacccgaagccgtaccgccccgtacggtcctacctcgttccgttccccgccccgttcccgtccgaaccggtacgtacgttaccggtacggtacggcggggtcgtaccggg

SEQ ID NO: 178 - DNA, 900 bp, Homo sapiens
  misc_feature: GYAE6OF01E20R9.19.26.C04.1.454.CMB.1.raw
tcagtactctcgtgcacgaccggtgctcgattttagtctagcgactttgggtttgggggggtgagggttgaggaacctatgaacattctgtagggccaccgttctcctcctcggccgtcctctctcactcgcacaggctctgtcgacctcccatgtggtgactcacgccaccctcagtgtcagtggcccaggagagacggccaggacttccctggtgggggagacactttgataagtaaaagtgtgcactggtaccagcagaggccaggccaggcccctatactggtcatctattataactacccgtccgaccctcgagggactccctgagcgactctcgtgcctccaactcgtagggaacctaccggccaacccgtcgaacccgtcacggaccgacgggtcggaacggcggggaacgtcggaaccggtacccgtaacgttacgtttaaccgttagtaccggtaagggttcgggttacggggtaaagttaagggttaacgggttaacggtaccggggttaccgtaaggtttcggggtttaacggttttaccggttttttacccgggggaaccggggggtaaccggggttaaccccgtaaagggtaccccgtttaacgggggttaaccccccgggttacccgggtttaaccggggtttaaccccggaaaccgggtaacccccggttaaacgggggtccccggttttaaccccgggttccccccccgggttacccgggtttaccccggttaaaccccgttttacccgtttcccccgggttttaaccccccctaaccccccggttttccccgttaaccccggtaaaccccggttaaacgggttaacccggtttacggttaaacccgggccgggggttacccggggtacccggttaaccggggg

SEQ ID NO: 179 - DNA, 729 bp, Homo sapiens
  misc_feature: GYAE6OF01BZAQ8.19.26.C04.1.454.CMB.1.raw
tcagtactctcgtgcacgaccggtgctcgatttagtctagcgactttgggtttgggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggacttcccgtgtggggagacaactttgatagtaaaagtgtgcactggtaccagcgagacggccaggccacggcccctatactggtcatctattataactaccgtccgccctcacggactccctgacgcgactctctggcctccaactcgtacgggaacaccggccacccgtgacccgtcacgcgacgggtacgaacggccggggatacggacggcccgtacttaacgttacgtcggtacgtagggttaggtacggggtaagttaacgggttaggttacggtaccgggttacgtaagtttaggttacggttaacggtttttccggggaccgggtaacggggtaacccgaacgggtccgttaccgggtaacccggttaccgggttaccgggtacgtaaccggtaccccggaacgggtcccgttacccggtccccccggttaccgggtccgaacccgttccgttcccgttacccccaccccgttccctacccgacggtaccggtaacgtacccgtcggacgggtccgggtacgg

SEQ ID NO: 180 - DNA, 550 bp, Homo sapiens
  misc_feature: GYAE6OF01BFMDP.19.26.C04.1.454.CMB.1.raw
  modified_base (380)..(380): a, c, t, g, unknown or other
  misc_feature (380)..(380): n is a, c, g, or t
  modified_base (484)..(484): a, c, t, g, unknown or other
  misc_feature (484)..(484): n is a, c, g, or t
  modified_base (518)..(518): a, c, t, g, unknown or other
  misc_feature (518)..(518): n is a, c, g, or t
tcagtactctcgtgcacgaccggtgctcgatttagtctagcgactttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtggggggaggcgtggtccagcctggggaggtccctgagactctcctgtgcagcctctggattcaccttcagtagctttggcatccacgtgggtcccgccgaggcctccgaggcgaaggggctaggagtggggtgctagttatatcatatgagtggaagtaaatatattagnggagactcggtagaacgggccattccacactcctaccagacgaactaacttaccaaagaacacgagtaggatcgtgacaatgaacagctgagagcgtggggacncggctgtagtacttagtgtcgaggaggcggcggngtaggactactacactccgtaaggttaccggg

SEQ ID NO: 181 - DNA, 625 bp, Homo sapiens
  misc_feature: GYAE6OF01CTD6R.19.26.C04.1.454.CMB.1.raw
  modified_base (603)..(603): a, c, t, g, unknown or other
  misc_feature (603)..(603): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgaccctcccatgtggtgactcagccaccctcagtgtcagtggccccaggagagacggccaggattccctggtgggggagacaactttgatagtaaaagtgtgcactgtaccagcagaggccaggccacggcccctatactggtcatctattataactaccgtccggccctcgagggactccctgacgcgactctctggctccaactcgtacgggacaccggccaccgtcgaccgtcacgcgagggtcgaacggccggggatgacggccgactattctgtcgaggtggtagggataggtagtaggtcggtagagtgttggtacgtttcgggcgggaaggaccgaagtctacggacccgttcgtacgggtacacggacccaagggtctacccgcccccgttcggtacctccgtccgttccgttccccctaccccgttccctacccaacgggtataccggtaccgnggaccggccggggtcgtacggg

SEQ ID NO: 182 - DNA, 786 bp, Homo sapiens
  misc_feature: GYAE6OF01C6SKD.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagagacggccaggacttcccgtggtgggggagacaactttgataagtaaaagtgtgcactggtaccagcagaggccgaggccgacggcccctatacgtggtacatctattactaataccgtccgcctcgaggactcccgtgacgcgactctcgtggcctccaactcgacgggaacctacggacccacccgtacgacccgtacacgcgtacgggtacggaacggtaccggggagtcgggacggaccgtaacgtacgtttaaccgtgttacggtagggttacggtagggaagttagggtaggtacgggtaccggttacgtagttagggttcggtttacgggttttccggggaccggggtaacggggtaacccgtaacgggttccggttacgggtaaccccgggttacccggttaacggggtacccgaaccggtaccccggtaagggtccccgttaccccggtccccccggttccgggtacccctacccggttcccgttaccccgttaccccccgtacccccttcccggaaccccgtaacggttaacggtaacccggttaccgtaggggtaccccggtaccggggtccgttaacccggggg

SEQ ID NO: 183 - DNA, 895 bp, Homo sapiens
  misc_feature: GYAE6OF01AGASF.19.26.C04.1.454.CMB.1.raw
  modified_base (177)..(177): a, c, t, g, unknown or other
  misc_feature (177)..(177): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagcttgggttttcctcgttgcttcttttaagnggttgtccagtgtcaggtgcaccgtggtggagtcgtgggggagcgtggtccagccgtggggacgtccctgacgtactctccgtgtcgcacgtccttgtggtactttcctacgttttgattcgtatttagtcggcctagtcggacctaccggttcgggggtacccgacgaacggtcccgtaaccgggaaggggggaaccgggtccgtaggggtacggtttggggttacccttacggtaagggtttaagttttagggttagggtaaaagtttcggtacggtacgtttaaggtaacgttaacggtccccgtttaagtccgggtaccggtaactttcggtacgggttaacgggaaaccggggtcccttaaacgttccccgaaccgttaccgttacccgtacccccggaaaggtaacccgaaaacccgaaacccggtaaccccgtaaaaacggttaaccccgttccccgttaaagtttaaccttacccggtaacgtaaaccttaaaagttaccggaaaaccttacgggtttacgacggtaaaggttacccgacgtttaaacgggggaacccggtaacccgttaacccgggtttccgtttaacggttttaaacgtttcccgggtaggtaacgggaaccgggttaaaaggggtcgttaaacgtacccgtacggtaacgttaccctaacgggttaacccgggttaacgtacccgggttaacggggg

SEQ ID NO: 184 - DNA, 692 bp, Homo sapiens
  misc_feature: GYAE6OF01EH9T3.19.26.C04.1.454.CMB.1.raw
  modified_base (197)..(197): a, c, t, g, unknown or other
  misc_feature (197)..(197): n is a, c, g, or t
  modified_base (401)..(401): a, c, t, g, unknown or other
  misc_feature (401)..(401): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtncaccgtggtggagtcgtgggggagcgtggtccagccgtgggacggtccctgagacctctcctgtgcagcctctggacttccaccttcagtagtcctttggactatcccacgtcgggtcccgccagggcctaccgaggcgaaggggctaggaggtgggtgactaggttatactcagttagtggaagttagggaaagttaaaaatnttaagttagagggtaacgtaccgtacggtaggaaacgggtccgtaatttacccaaccgtacttcccgtaaccgaaggaactaaaccgtaaacttaacccaaaggtaaaccaacgtaaggtaggaacttcgtaagaactaaaagtcgaaactacggaccgtaaggaggtacgccgggtaacggggacgtaccggtcgttagtaacggtttacttacggtggtagggaccggaggtaccgggtacgggtacgttacgggaaaccctaaaccgttacgtaaccgtttaacccgg

SEQ ID NO: 185 - DNA, 706 bp, Homo sapiens
  misc_feature: GYAE6OF01C24CX.19.26.C04.1.454.CMB.1.raw
  modified_base (220)..(220): a, c, t, g, unknown or other
  misc_feature (220)..(220): n is a, c, g, or t
  modified_base (362)..(362): a, c, t, g, unknown or other
  misc_feature (362)..(362): n is a, c, g, or t
tcagtactctcgtgcacgaccggtgctcgatttagtctagcgactttgggtttgggggggtgagggttgagaacctatgaacattctgtagggggccaccgttctcctcctcggcctcctctctcactgcacaggctctgtgacctcccatgtggtgactcagccaccctcagtgtcagtggccccaggagagacggccaggacttccctggtggggganacaactttgatagtaaagtgtgacactggtaccagcagaggccaggccacggcccctatactggtcattctattataactaccgtccgccctcagggactccgtgacgcgactctctggcctaccaactcgtacgggaaccncggaccacccgtgacccgtacgacgcgagggtacgaacggcccgggggatacgggacggacccgtaacgttacgtttacgtacggtaccgtaggggttcggtaggggtaagttaggttacggtaggtacgggtcagttggttgttacggttttccgggacgggtacggggaccaacggtcgtcggtaaccggttaccgtagggtaccgtacggccccgtaacgggtcctacccggtacccccgttccggtaccgtacccgtcccgtttccggttccccccgtaccccttcccgtacccgtaccggtacgtaaccgtacgtacggacgggcgggtcgtaccgggg

SEQ ID NO: 186 - DNA, 809 bp, Homo sapiens
  misc_feature: GYAE6OF01B5ROJ.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgataagtaaaagtgtgcactggtaccagcagaggccaggccaggcccctatactggtcatctattataataccgtccggccctcgacgggactcccgtgacgcgactctctggcctaccgaactcgtacgggaaccacggccacccgtgaccgtcacgcgacgggtcgaacggccggggaatcggacggcccgtaacgttacgttacgttaggtacgtaacgggttggtacggggtaagttaagggttaaaggttagggtccgggtacgtaggttagggttcggttaacggtttttccggggacggggtaacgggtaacccgtaacgggtccgttaacgggtaaccccggttaccggtaacgggttacgaaccgggtaccccgtaaaggggtccccgttacccgggtcccccccggttacgggttaccccgttaacccgtttccccggttttacccggtttacccccccctaaacccccggtttcccccgttaacccccggtaaacccgggttaaaccgggtacccggtttaacccggtaaccgggtaaccgggggtccccggggtaccggttaacccgggggg

SEQ ID NO: 187 - DNA, 774 bp, Homo sapiens
  misc_feature: GYAE6OF01D3G5G.19.26.C04.1.454.CMB.1.raw
  modified_base (374)..(374): a, c, t, g, unknown or other
  misc_feature (374)..(374): n is a, c, g, or t
tcagtactctcgtgcacgaccggtgctcgatttagtctagcgactttgggtttgggctgagctgggttttcctctttgctcttttaagaggtgtccagtgtcaggtgcacctggtggagtctgggggaggcgtggtccagcctgggaggtccctgagactctcctgtgcagcctctggattcaccttcagtagcttttggcatcccactgggtcccgccaggctccgaggcaaggggctagaggtggggtggcagttatatcatatgagtaggaaggtaaaatatattatgggagtacctccgtaggaacgggtccgatttccaaccattacctccaagacgaacctaacttaccaaagaacacagtaggatcngacaaatacgaacagacctaggagacggcgtagggggaccacgggtctaggttagttaactttaccgtggtacggtacggaaggacggccggtcgtacgggactaacctactaccttaccgttacggttttaaccgggtttggtacccggttacgggttacgggggaacccgtaaaccgggggtaacccgtaccggggttacctaccggttacccggttcccctaccccccggacggtaccccctaccccgaacccgggaaccccggggtaccccgttacccgggtttacccccggtttccccccggtttccccccgcccggggttccccccgaccccggtttccccggtaaccccgttcccgggtaaacccgggcccggtccccgtaaacccccccggg

SEQ ID NO: 188 - DNA, 704 bp, Homo sapiens
  misc_feature: GYAE6OF01CW8UW.19.26.C04.1.454.CMB.1.raw
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattcccgtggtgggggagactaactttgaataaggtaaaagtgtgcacgtaggtaccagcaggaggccaggccacggcccctagtactggtcatctattaataactaccgtccggcctcgagggactcccgtagacgccgtactcctcgtcggtcctccaactcgtacgggaaccaccggcccaccgtcgaccgtcaggcgaggtacgacgggccggggatacggacggccgtacgttacttacgtacggtcgtagggtggtagggaagttaggtaggtaaggtcggtcgtaggttggttacggttaggtttccggggacgggtaacgggtacccaagggtccgtaaccggtacccggttaccggttaacgggtccgaacggacccgtaacgggtccctcccgggtacccccgttcggtacctaccgttcccggttccgttcccccgtacccttcccgacccgtacggacgtacgttacgtcggaacggccgggtcgtacggg

SEQ ID NO: 189 - DNA, 615 bp, Homo sapiens
  misc_feature: GYAE6OF01BUUI9.19.26.C04.1.454.CMB.1.raw
  modified_base (159)..(159): a, c, t, g, unknown or other
  misc_feature (159)..(159): n is a, c, g, or t
  modified_base (174)..(174): a, c, t, g, unknown or other
  misc_feature (174)..(174): n is a, c, g, or t
  modified_base (379)..(379): a, c, t, g, unknown or other
  misc_feature (379)..(379): n is a, c, g, or t
  modified_base (466)..(466): a, c, t, g, unknown or other
  misc_feature (466)..(466): n is a, c, g, or t
  modified_base (529)..(529): a, c, t, g, unknown or other
  misc_feature (529)..(529): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttccncgttgctctttaagnggtgtccagtgtcaggtgcacctggtggagtcgtggggagcgtggtccaggcctggggagtccctgacgactcgtcctgtgcagcctgtggattcaccttcagtagctttggcactccacgtgggtccgccaggctccgaggccaaggggctaggacggtggggtggctaggttatatccaatatggatgggtaaaggtaaaatntaattaagtggaagtacctccggtaggaaacgggtccgaatttaccaccgtactctaccgagaacgaacaattacccaaagaaccanaagtggactacgtagactaaatgaaacgtagacctaggaagagaccggtaggggacacgggtnttagggtagttacgttacgtggtcgtcggaacggtaggccggtacgtcggtaccaaacgttaccacttcccgtagttttaccgggg

SEQ ID NO: 190 - DNA, 719 bp, Homo sapiens
  misc_feature: GYAE6OF01DOUDH.19.26.C04.1.454.CMB.1.raw
  modified_base (175)..(175): a, c, t, g, unknown or other
  misc_feature (175)..(175): n is a, c, g, or t
  modified_base (368)..(368): a, c, t, g, unknown or other
  misc_feature (368)..(368): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttcctcgttgctctttaaggnggtgtccagtgtcaggtgcaccgtgggtggaggtcgtggggggaggcgtggtcccaggtccgtggggacggtccctgacgtactctcctggtcgcagcctgtggtattcctaccttgaagtcgttctttcggctacgtccacggtcgggttcccgaccgtagtcctacccgaggaccgaaaggggcctaaggngggtgggtagactaaggtttatatgtagttagtgaacggtaggtaaaaggttaaatagtaattagtacgggactacggttaccgtaggaaacgggtccgtattaccggacctacgtccgtaccgaagtaacgaacgtaaactaaccgaaacgaaacgacgtagtacgtagtactacgaactaaagcgaaacgtcgaccgtagaacggtcgggtaacgtccggggaacgaccggtacggttagttaccggttaatttaccggaggtcggacgggtacggtacgggaccgggtactaacccgggtaaccttaaccaaccgttcggttaaacccgttggttttaaacccggggg

SEQ ID NO: 191 - DNA, 713 bp, Homo sapiens
  misc_feature: GYAE6OF01BWSAL.19.26.C04.1.454.CMB.1.raw
  modified_base (214)..(214): a, c, t, g, unknown or other
  misc_feature (214)..(214): n is a, c, g, or t
  modified_base (385)..(385): a, c, t, g, unknown or other
  misc_feature (385)..(385): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgcaccgtggtggagtcgngggggagcgtggtccaggccgtggggacgtccctgagactcctccgtgtcgcacgcctcgttacggtacttacctacctttacgtacgtacgttcgtttaggcctactcccgtacggttcggggtcccgcccgtacggccgtacccgagggaccgaacgggggcgtaaggngggttacggggtggactagttaacgttagtactagtaagtggaagttaagggtaaagttaaaaaatttcgtaaagtttaaggcggtaacgtacggttacccggtaaggacgggtacctaacgttaccgaacctactcgtaccgaaggtaacgtaactaaacgttacccaaaggaaccacggtaagtaggtataccgtggaaaccaaagttacgaaactacgtacgtacgaaggcggagtacggggacgtacggtcgttagttagttagttacgtgggtagacgtaaggcggtacggtcgtaacgaaccgtactactacccgttacggg

SEQ ID NO: 192 - DNA, 651 bp, Homo sapiens
  misc_feature: GYAE6OF01BELA6.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcagaggccaggccaggcccctatactggtcatctattataataccgtccggccctcgagggactcccgtgacgccgactctctcggcctaccaactcgtagggaaccaccggcccacccgtcgacccgtcacgcgacgggtcgaaacggccggggatcgggacggtcccgaacgttacgttacgtgtacgtagggttggtgggtagttaggtaggtaggcggtgtagtggtgtagttttcgggaggtacgggacacgcgtacgaccgtccgtaggtaccacgacccgtaacggccgtaccgcccccgttcggtcctaccgttccgttcccgttccccgtccccttccccgtacccgtaaccgacgtaccgttaccgtacggcggtccgggtcgtaccggg

SEQ ID NO: 193 - DNA, 641 bp, Homo sapiens
  misc_feature: GYAE6OF01EEJEB.19.26.C04.1.454.CMB.1.raw
  modified_base (268)..(268): a, c, t, g, unknown or other
  misc_feature (268)..(268): n is a, c, g, or t
tcagtactctcgtgcacgaccggtgctcgatttagtctagcgactttgggtttgggggggtcacaagaggcagcgctctcgggacgtctccaccatggcctgggctctgctgctcctcactctcctcactcaggacacagggtcctgggcccagtctgccctgactcagtctgcctccgtgtctgggtctcctggacagtcggtcaccatctcctgcacgtggaaccagcagtgatgttaggaaattctaacttgtctctgtaccaanatcaaccaaataacaccccaaactcatctattactgatcgaccaactaacgccgtaccctacgtacgggtttactaactcgtcttctcgtacggtctaccgaagtctcggactaacgacggtccctccgtagaactaacttctcgtcggcctccgagctggaaggacgaggtctagtattacgtactcgacttgctactactatcggtacacgggttacttacgttcctttacgtttattacggttccgtttaacgggaaccgttacgggaacccttaacgggtccctaacccgggttacgttaaccgggtacctaacccgggtaaccccgaaaccggtacccctaaaccccgtaccgttccgtcctaacccg

SEQ ID NO: 194 - DNA, 778 bp, Homo sapiens
  misc_feature: GYAE6OF01B92CN.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgataagtaaaagtgtgcactggtaccagcagacggccaggccaggcccctatacgtggtcatctattataactaccgtccggcctcgagggactcccgtgacgccgactcgtcgtcggcctaccgaactccgtagggaaccaccggcccaacccgtcgacccgtacgacggaccgtaacggggtaccgaaacgggcccgggggtatcgggacggacccgtaacgttacgtttaacgtcggtaccgtagggttgggtacggggtaagttaagggtaacggtaggtcgggttactagtttggttacgtttacggttttaccggggacgggtaacgggtaaccgtaagggtccgttacgggtaacccgttaccggttaacgggtacctaaccgggtacccgtaacgggtccctacccgggtacccccccgttcgggtaccctaacccgttcccgttacccggtttacccccctaacccccgttccccgttaccccgaaccgggtaaccgtaaccggttaccggtacgggaaccggtcccggggtcggttaaccgggg

SEQ ID NO: 195 - DNA, 651 bp, Homo sapiens
  misc_feature: GYAE6OF01CR19A.19.26.C04.1.454.CMB.1.raw
  modified_base (466)..(466): a, c, t, g, unknown or other
  misc_feature (466)..(466): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttcctcgttgcttcttttaagaggtgtccagtgtcaggtgcaccgtggtggagtcgtgggggagcggtggtccagcctgggagtccctgagactctcctgtgcagcctctggtattccaccttcagtagtctttggctatcccacgtcggggtcccgccgaggcctccgaggacgaaggggctaggaggtgggtggactagttatagtctatatgagtaggtaaggtaaatatattagtaggtagtacgtacggtgaacggggcctactcgaactactcctaccgagacgaactaacttaccaaagaaccanaggttggatcgagtaacaaacgtacgaacgacgtccgtaaggacgtacggcgggttaacgggacgtaccggtcgttaggttacgttacgtttagtacggtcggacgggtacggaacggtcccgggtacgttaccggtaccctaaacttaccgtaacttaccggtttaacggttttaacccggggg

SEQ ID NO: 196 - DNA, 858 bp, Homo sapiens
  misc_feature: GYAE6OF01BK9YK.19.26.C04.1.454.CMB.1.raw
  modified_base (160)..(160): a, c, t, g, unknown or other
  misc_feature (160)..(160): n is a, c, g, or t
  modified_base (179)..(179): a, c, t, g, unknown or other
  misc_feature (179)..(179): n is a, c, g, or t
  modified_base (193)..(193): a, c, t, g, unknown or other
  misc_feature (193)..(193): n is a, c, g, or t
  modified_base (289)..(289): a, c, t, g, unknown or other
  misc_feature (289)..(289): n is a, c, g, or t
  modified_base (330)..(330): a, c, t, g, unknown or other
  misc_feature (330)..(330): n is a, c, g, or t
  modified_base (410)..(410): a, c, t, g, unknown or other
  misc_feature (410)..(410): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagcgtgggttttccncgttgctctttaagaggtntccagtgtcaggtnacaccgtggtggagtcgtgggggagcgtggtccagccgtgggacgtccctgacgacctcgtccgtgtacgcaggtcctgtggtacttccacccttntaggtacgtctttggcctaacttccaccggtcggggtcccnccgacggtcctcccgaagggccgaagggggtctagggacgggttgggtacgtacgtaggttaactacgtactagttacgnggtaagtaggggtaaaagttaaaatagttaaactttacgggtacggtaacgtaccgttaccgggtaaggtaaccggggtaccttaacgttacccgaacccgtaactttacccggtaaccgttaacggaaacgttaaacccgtaaaaccgtttaacccggaaaaaacgtaaccgtaacccgtaacgggtttaaggtaacccgttaccgttaacgggaaacccttaaaaggtaacccggaaaacccgttaaccggaacccggtaaggtacgggtaaaccgggtaccgggttaaccgggggacccgttaaccgggtcggtttaggtaaccggtttaacgttacccggggttaggtacccggtaccgggaaagggtacccgggccgggtacggtaccggtaaaccttaaccggttaacccgtacgttacccggtttagggtttaacccgggg

SEQ ID NO: 197 - DNA, 724 bp, Homo sapiens
  misc_feature: GYAE6OF01A2103.19.26.C04.1.454.CMB.1.raw
  modified_base (320)..(320): a, c, t, g, unknown or other
  misc_feature (320)..(320): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcaccgtggtggagtcgtgggggagcgtggtccagcctgggacgtccctgacgactctcctgtcgcagcctcgtggatttccacctttcaggttacgtcttttggctattcccagtcggggtcccnccgaggtcctccgaggaccgaaggggctaaggaggtggggtgactaggtttatacgtacatagtgtaagtagggtaaaagttaaaattgttaacgttagtagggaacgtaccgtaccgggtaaggtaaccgggtacgttacgttaccaaccgttacttacccgtacgaaacgtaacgtaaccgttaaacttaaccgaaacgaaacgtacgtaacggtagtacgtacgtacgaaaccgtaaagtacggaaacctacggacgttaacgggaagtaacggtccggggtaaccggggacgtaaccgggttacgttacggtttaaggttaaacgttccggttagggtacggaacgggtaggacggtccgggtacgtacgggtaacctaaccgttacgtaccgttaacgg

SEQ ID NO: 198 - DNA, 717 bp, Homo sapiens
  misc_feature: GYAE6OF01B7AWT.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctccatgtggtgactcagccaccctcagtgtcagtcggcccaggagagacggcaggacttcccgtggtgggggagacgtaacgtttgaagtaagtaaaagtgtgctacgtaggtaccagcagacggccaggccacggccctatacctggtacatctattactaacgtaccgtccggccctacgacgggtactcccgtagacgcgtactctcgtcggtcctaccgaactcggtacgggaaccacccggaccctacccgtcgacccgtacgacggccggtaacgggtacgaacgggccggggagtcggacggaccgtacttaacgttaacgtcgttacggacggttggtagggtaagtacggtacggtacggcggtacgtagttcggttagtttacggtttaccggggacgggtaacggggtaccgaaacgggttcgtaccggtacccgtaccggttacggaccgtaaccggacccggtaacggtccgtacccggaccccccggttcggtaccctcccgttccgttcccggttacccccacccgtttacccgtacccgacggtaaccgg

SEQ ID NO: 199 - DNA, 604 bp, Homo sapiens
  misc_feature: GYAE6OF01E12NI.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcgagggactccctgagcgactctctggctccaactcgtggaacacggccaccctgaccgtcagcagggtcgaaggccgggatgaggccgactattacgtgtcgaggtgtagggtatagtagtacggtcggtacagttggtaggttacgttttccgggcggtaacgggacccaaggtacgtcggtacccgtccgttacgggtccacggcccgtaaggcctccggcccccgtcggtccacgttcctcgttcccccaccctcccacccaacggacgtacgtacgtaggcgcgggcgtcggg

SEQ ID NO: 200 - DNA, 751 bp, Homo sapiens
  misc_feature: GYAE6OF01AY6L9.19.26.C04.1.454.CMB.1.raw
tcagtactctcgtgcacgaccggtgctcgatttagtctagcgactttgggtttgggggtgagggttgagaacctatgaacattctgtaggtgccaccgttctcctcctcggcctcctctctcactgcacaggctctgtgacctcccatgtggtgactcagccaccctcagtgtcagtggccccaggacgagacggccagggattccctgtggggagacaactttgatagtaaaagtgtgcactggtacagcagacgcaggccaggcccctatactggtacatctattataagtaccgtccggccctcgagggactccctgacgcgacctctcgtcggctccctaacgtccgtacgggaaccaccggtacccaccccgtcggtacccgtacacggaccgaacggggtaccgaagggtccccgggggaattacgggacggaccccggtaacttagttaccgttaggtccgtagggttcggttaggggacttagggttaacggtaggtaccgggttcaaaggttggttacgttacggtttttccggggacggtaacggggaaccctaagggccttacgggtacccggttaccgtacgggttaccaaccggtacccgtaaacgggtccctacccgggtaccccccgttccgggtacccggtaacctttcccgttacccggtttcccctaccccgtcccccgttaacccgaccgttacggaaccgttaccgtacggacgggtccgggtaacccggg

SEQ ID NO: 201 - DNA, 679 bp, Homo sapiens
  misc_feature: GYAE6OF01AVFDO.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggacttcccgtggtgggggagacaactttgataagtaaaagtgtgcactggtaccagcaggaggccaggccacggcccctatactggtcatctattataactaccgtccggccctcgacgggtactcccgtgacgcgactctcgtacggctaccaactcgtacggaaccacggcccaaccgtcgaccgtcacgcgtacgggtcgaacgggccgggatcggacggaccgtatacgttacgtgtacgtaggtggtaggtataggtagtacggtcggtctagttggtagttacgtttcgggacgggtacgggaaccgtaaggtccgtacggtacccgttaccggtacggtccgaacggacccgaagtcccgttaccgtcccccggttacggtacccgtaccgttcccgttcccgttaccccctaccccgttaccctacccgtaccggtacgtacggttaccgtacggccgggtccgggtaccgg

SEQ ID NO: 202 - DNA, 682 bp, Homo sapiens
  misc_feature: GYAE6OF01DLWJA.19.26.C04.1.454.CMB.1.raw
  modified_base (227)..(227): a, c, t, g, unknown or other
  misc_feature (227)..(227): n is a, c, g, or t
  modified_base (665)..(665): a, c, t, g, unknown or other
  misc_feature (665)..(665): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtcggcccaggagagacgaccaggacttcccgtggtggggganactaactttgatagtaaagtgtgacacgtggtaccagcgaaggacggccgaggcccgaacggccccttaagtaccgtggtactacgttacttaatttaacgtaacgttacccggtcccggccctacgacgggtactcccgtagacgcgactctcgtcggctaccaacgtcgtaacgggaaccacccgggacctacccgtgtacccgtcgtaacgcggtaacgggtaccgaacgggtcccggggtaagtacggacggacccgtacgttaagttacgtgtacgtaggtggtacgggtattaggtagtacggtcggtacagttgtagttacgtttcgggacggtacggaccgtaaggtctacggaccgttacgtacggtaccgaccgacccgacggtccgtacccggccccgttcggtaccgtcctccgttccgtaccccncctccctcgacgtacgg

SEQ ID NO: 203 - DNA, 738 bp, Homo sapiens
  misc_feature: GYAE6OF01AXCSX.19.26.C04.1.454.CMB.1.raw
  modified_base (338)..(338): a, c, t, g, unknown or other
  misc_feature (338)..(338): n is a, c, g, or t
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgaccctcccatgtggtgactcagccaccctcagtgtcagtggccccaggagagacggccaggattccctgtgggggagacaactttgataagtaaaagtgtgcactggtaccagcagaggccaggccaggcccctatactggtcatctaattataaataccggtccggccctcgagggactccctgacgcgactctacgnggactccaactcgtaggaacacgcccaacccgtcgacccgtcagccgagggtacgaacggtccggggaatgggaacggccgtaacgttacttacgtcggtacgtacgggttaggtacggggtaacttaagggtaacggttaacgggccggtttacgaacgttgggttacggttaacggtttttacggggaccgggggaacgggaacccgttaaacgggaccgttcgggtaaaccccggttaccgttaaccggggttacccaaccgggacccccgtaaagggtcccgttacccggtccccccgttacgggtaccctaacccgttccgtttaccggtacccccctacccgttcccgtaacccgtaccgacgtacggtactacgggaacgcggggtacacggg

SEQ ID NO: 204 - DNA, 706 bp, Homo sapiens
  misc_feature: GYAE6OF01BQ07B.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggacttccctggtgggggagacaactttgatagtaaaagtgtgcactggtaccagcagaggccaggccaggcccctatactggtcatctattaataactaccgtccggcctcgaggactccctgacgcgtactctctcggctaccaactcgtacgggaacctaccggaccctacccgtcgacccgtcgacggtaccgacggggtacgaacggccggggtagtcggaacggcccgtaacgttacgttacgtgtacgtagggttggtacgggtaagttaacggtaggtacgacgggttacgagttgggttagttagggttttcgggcggggtaacgggtaaccgaacgtccggtacggtacccgtaccggttacggtaccgaccgcccgtaacggcccgtacccggccccgttccgggtaccctacggttcccgttacccgttcccccgtacccttccccgtacccgacgtaccggtacgttaccgacgggacggtccgggcggtaccgg

SEQ ID NO: 205 - DNA, 894 bp, Homo sapiens
  misc_feature: GYAE6OF01DSTCK.19.26.C04.1.454.CMB.1.raw
  modified_base (177)..(177): a, c, t, g, unknown or other
  misc_feature (177)..(177): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagcttgggttttcctcgttgcttcttttaagnggtgtccagtgtcaggtgcaccgtggtggagtcgtgggggaggcggtggtccagccgtggggacggtccctgacgtacctcctccgtggtcgcacgtccttcgtggtactttccctacctttcgaggttagtccgttttcggcctaacgtccccgtacggttccggggtccccggacccgacgggtaccctcccggaaggggaccggtaaagggggggtccttaaggggtacgggttggggggtacggtaccggttaaggttttaagtaacttaccgtaagttagttaggtaaaggttaaggggtaaaaggttaaaaattaagtttaagtttaagggtagggtaacggtaccgtttaccgggtaagggaaaccggggttacccgtaacttacccgaacccgttaacgtacccgttacccgaaaggtaaaccgtaaaccttaaaaccgtttaacccgaaaacggtaaaccctaacggtaacgggttacgggtaacttaccggttaacgtaaactaaaacggttacgaaaccgtccggtaacccgtagggaacgggtaaccgggtccgggtaacgggggtacccgtacgggttaccggttaggttacgttacgttacggtacgggttcgggacggaagggtaccgggacgggtacccggttacggaacccgtaaccttaaccgttaccgttaacccggttacgggttttaacccggggg

SEQ ID NO: 206 - DNA, 813 bp, Homo sapiens
  misc_feature: GYAE6OF01C8R3H.19.26.C04.1.454.CMB.1.raw
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcgttgggttttcctcgttgcttcttttaagaggtgtccagtgtcaggtgcactggtggagtcgtggggaggcgtgtcagccgtgggacgtcctgacgtctcctcctgtgcacgcctcgtggtacttcctaccttcagtagtctttcggcactcctacgtcgggtcccgccgacggcctaccgacggaccggaacgggggtcgtaggtagggtggggtacgggtacgtaaggtttataacgttacgtaagttaagttagggaaagttaagggtaaaaggtttaaaaaatttagtttaaagtttaaggtacgggtaacggtaaccgtaccgggtagggaaccggggtaccgtaacttaccgaaccctacgttaccctaccgtaaacgaacgtaaaccgtaaccgttaaacccaaaacgtaaccgtaacgtaacggtaggtaaccttacgtaacgaacgtaaacgtcgtaaaaccgtacggtacccgtagggaaccggtacgggtacccgggttacgggggaacccgttaaccggggtactttacggggtttaacggtttaaacgtttaccggttagggttaccggtaaccggggaagggtaccgggtaccgggtaccggtaacggtaacccttaaaacccgttaacgtaaccggtttaaccccggg

SEQ ID NO: 207 - DNA, 793 bp, Homo sapiens
  misc_feature: GYAE6OF01DZQDY.19.26.C04.1.454.CMB.1.raw
  modified_base (209)..(209): a, c, t, g, unknown or other
  misc_feature (209)..(209): n is a, c, g, or t
tcagtactctcgtgcacgaccggtgctcgatttagtctagcgactttggggtttgggggggagaggagcccagcactagaagtcggcggtgtttccattcggtgatcagcactgaacacagaggactcacagtggtaggtttgggctgagtcttgggttttcctgttgcttactttaaggaggtgtccagtgtcgaggtcgcacgtggnggagtcggtgggggagtcggtggtccagtccggtgggacgtcccgtgacgtcttcctcgtggtcgccgtacggtcccttcggtacggtaccttaccgtacctttcgacggttagttcgtttacggcctaagtccccgtacggttcgggtacccgccgtacggtccgtccgaagggaccgtaaggggcgtaagggtcgggttagggtcggtaacttagtttaacgtactacgtaagtacgtagtaagggttaagggtaaacgttaaaattataggtttaggtacgtaaccggttacgtacggtaacggaacgggtcctacgtaccgactaccgtaccgtacgaacgtacaacgtaactaaccgaaacaacaacggttagtacgtacgtacgtaagtaacgtaagtaccgaacgtgtacgacggacggtaacggtcggaacggggtactaccgggttagttcgggtaacttttagttaccgtggggttacggaaacggtagggtaacccggtgggtaaccgttacccggtaaaccgttaaccgtaaccttaacgggttacccgtttaagggttttacccccggggg

SEQ ID NO: 208 - DNA, 562 bp, Homo sapiens
  misc_feature: GYAE6OF01BRCPV.19.26.C04.1.454.CMB.1.raw
  modified_base (451)..(451): a, c, t, g, unknown or other
  misc_feature (451)..(451): n is a, c, g, or t
  modified_base (533)..(533): a, c, t, g, unknown or other
  misc_feature (533)..(533): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctggggagtccctgagacctctcctgtgcagcctctggattcaccttcagtacgctttggctatcccacgtcggggtcccgccgaggcctccgagggcgaagggggctaggacggtgggtgctagttatatcatagtgagtaggaagttaaaatataattagtaggacgtacgtaccggtaggaacgggtcctattcgactatcctacagagacaatacaaanaacagagtggatcgtagacaatcgaacagacctagagagcgagggacacggctagtagtacttacgtgtgaggaggcgcggngtacgacactactactccgtagttacggg

SEQ ID NO: 209 - DNA, 712 bp, Homo sapiens
  misc_feature: GYAE6OF01AN0OC.19.26.C04.1.454.CMB.1.raw
  modified_base (224)..(224): a, c, t, g, unknown or other
  misc_feature (224)..(224): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgaccctcccatgtggtgactcagcccaccctcagtgtcagtcggccccagggagaggacggccaggacttcccgtggtggggganactaactttgataagtaaaagtgtgacacgtcggtaccagcgaggacggaccaggccacggtcccctatacgtggtcatcgtaattactaacgtacccgtccgacctcgacgggtctccgtgacgcactctacgtcggctaccacgtcgtacggtaacaccggccacccgtcgaccgtcgacgcgacgggtacggaacggaccgggagtacggaccggtaccgtacttacgttacgtaggtcgtacgggttggtaggtaagttaggtacggtacggtcggtacgtagttcggtacggttacggtttcgggacgggacggtacacggtacgtacggtacccgtacggtaacgtaccgaccgtacccgacggtccgtacccggtcccgttaccggtacctacccgttcccgttaacccgttccccccaccgttccccgacgtaaccggaaccgttcggtaacgtcgggacccgggtcgggtcgtaccggg

SEQ ID NO: 210 - DNA, 734 bp, Homo sapiens
  misc_feature: GYAE6OF01BTLT2.19.26.C04.1.454.CMB.1.raw
tcagtactctcgtgcacgaccggtgctcgatttagtctagcgactttgggttggggctgggcctaaggaagcagcactggtggtgcctcagccatggcctggaccgttctcctctcggcctcctctctcactgcacaggctctgtgacctccatgtggtgactcacgccaccctcagtgtcagtcggcccgaggagacgacggccaggtacttcccgtggtgggggaacgtacgtaacgttttagaagtaaagttaaaaagtgttagactacgtacggtaaccagacgaggacggccaggccgaaccggccccttaagtaacgtcggtacctatacgttaatttaacgtaacgttacccgtccggcccttacgagggtctacccgtagacgcgtactctctacggtctaccactcgtacggaaccgacgtcccaccgtcgaccgtcacgcggacgggtacggtaacggccgggtagtacggaacggtaccgtaacgttacgttacgttacggtacgtagggttaggtagggaagtttaggttaacggtaggtcggtagttacgtggttacggttacgttttaccggggacggggtaccgggtaaccgtaggtaccggttcgacccggttccgaagggttccgaaccgtacccgaggtcccgtaccggacccccgttcggtccctaccgttcccgttaccgttccccctaccctccccgtaccgtaccggtaacg

SEQ ID NO: 211 - DNA, 846 bp, Homo sapiens
  misc_feature: GYAE6OF01DXTP3.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagagacggccaggacttcccgtggtgggggagactaactttgataagtaaaagtgtgcacgtggtacagcagacggccacggccacggccctatacgtgtcattactattaataacgttacccgtcccgccctacgagggtacctcccgtgacgccgtacttcgtcgtcggacctaccaacgtcgtacgggaacctaccggacccacccgtgtaccgtccgaacggccggtacggggtaccggaacggggcccgggggtaagtacgggaccggtacccgtaacgtttacgtttacgtcgggtaccgtaagggttgggttacgggtagttaagggttacggtacgggtacggttacgtagttcggttacggtttacggttttaccggggacggggtaacgggtaaccggtaacgggtccggttaccgggtaacccgggttccgttaacggggttacccgaaccgggtaccccggtaaccgggtccccgttccccggtacccccccggttacggttaccccgttacccggttcccggtttcccccgggtttacccccccggttacccccgtttacccccgtaccccggtaaacccgggttacgtaaccgggttaaccggttaccggggaacggggtcccgggtacccgggtaaccggggg

SEQ ID NO: 212 - DNA, 640 bp, Homo sapiens
  misc_feature: GYAE6OF01BKSJE.19.26.C04.1.454.CMB.1.raw
  modified_base (370)..(370): a, c, t, g, unknown or other
  misc_feature (370)..(370): n is a, c, g, or t
  modified_base (461)..(461): a, c, t, g, unknown or other
  misc_feature (461)..(461): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattcccgtggtgggggagactaactttgataagtaaaagtgtgcactggtaccagcaggaggccaggccaggcccctatacgtggtcatctattataactaccgtccgccctcgagggtactcccgtgagcgactctcgtcggcctcaactctagggaaccncgcccaccctgacccgtcagcgtagggtcgaacggcggggatggacggccgactacgttactgtcagggttgtgggatagtagtagcggtnagtgtagtgtttcgggacgggtagggtaccaaggtccgtacggacccgtaccgtacgggtacgtaccgacccgtaacgggtccgtcccggtaccccccggtcggttaccctccgtttcccggtaccccgtttaccccccgtacccccgtttacccctaccccgggtacgtaaacccggg

SEQ ID NO: 213 - DNA, 691 bp, Homo sapiens
  misc_feature: GYAE6OF01A2C1H.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcgagggactccctgacgcgactctcgtcggctaccaactcgtgggaaccacggcccaacccgtcgacccgtcacgcgacggggtcgaacggcccggggagtcggacggtaccgacttacgtttaccgtggtaccgtagggttggtaggggtattaaggttaacggtaggtcgggtaccgtaagttcggttaggttaacgttttcggggaccgggtaacgggacaaacggtcgttacggaacccggttccgtaacgggttccaaccggaccccggtaaggtcccgttcccggtccccccgttacggtcccgtaccgttccgtacccggttcccccacccttacccgtcccgaacgacgtacgtacgaggacgggtcgggcgtacgg

SEQ ID NO: 214 - DNA, 734 bp, Homo sapiens
  misc_feature: GYAE6OF01D2U4G.19.26.C04.1.454.CMB.1.raw
  modified_base (220)..(220): a, c, t, g, unknown or other
  misc_feature (220)..(220): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagagacggccaggacttcccgtggtggggganactaactttgataagtaaaagtgtgacacgtggtaccagcgagacggccacggccacggtcccctaatacgtggtacacttctattataactaccggtcccgcctcgacggactcccgtgacgcgtacgtcctcgtcgacctccaactcgtacgggaactccggacccacccgtcgtacccgacgtacggacgtagggtacgaacgggccggggagtcggaccggcccgtaacttacgttacgttacggtacgtaggggttggtgggaaagttacggtaagggtacgtacggtacagttcggtacgtttacggtttcggggacggtaacgggaacctacgtccgttaacggtacccgtaccggtacgggtacctacggaccccgtaaggtccgtcccggttaccccccgttcgggtccctaccgtttcccggtcccggtttacccccgccctttacccgaaccctcggaaccgtacgttaacccggtggacccggggtccggtagtacccgggg

SEQ ID NO: 215 - DNA, 678 bp, Homo sapiens
  misc_feature: GYAE6OF01DZLI4.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccagggagaggacgggccaggtacttcccgtggtgggggagactaactttgaataagtaaaagtgtgcactggtaccagcagacggccacggccacggcccctatactggtcatctattataataccgtccggcctcgagggctcctgagccgactctctcggcctaccaactcgtacgggaacaccggcccaccgtcgacccgtcacgacgacggggtacggaacggccggggatggaacggccgtacttactttacgtgtacgagggtcggttaggggtattaaggttaggtacggtcggtacgtagttggtacgttacggttttccgggacggggacggggaactaacggctacgggacccgttacgtacggttaccgaccgtacccgaacggtccgtcccgcccccgtagggtccctaccgtccgttcccgttcccccggtccctcccgtaccgaccggtacgtaacgttacgtacgggcggtccgggggtc

SEQ ID NO: 216 - DNA, 691 bp, Homo sapiens
  misc_feature: GYAE6OF01C886K.19.26.C04.1.454.CMB.1.raw
  modified_base (264)..(264): a, c, t, g, unknown or other
  misc_feature (264)..(264): n is a, c, g, or t
tcagtactctcgtgcacgaccggtgctcgatttagtctagcgactttgggtttggggctggggagaggagcccagcactagaagtcggcggtgtttccattcggtgatcagcactgaacacagaggacctcaccatggagtttgggctgagcgttgggttttcctcgttgcttcgttttaagaggttgtccagtgtcaggtgcaccgtggtggagtcgtgggggagcgtggtccagccgtgggacgtccctgacgctctctgtncacgcctctggtacttccaccttcagttagtccgtttggcactccacgtcgggtcccgcacggtcctaccgaggacgaaggggctacggaggtcgggtgaccgtagtttatagtctaatagtagtagttaagggaaaagttttaaaattagttaacgtttaagtacgggtaacgtacccggttacggtagggaaccgggtacctacttacccgaacctacgtccctaacgaacggtaacaactaaacttaccgaaacaaacgtacgtaggtacgtaccttacgtacgaactaaagtacgaacgtacgtaccgtaggaacgtacggaccggtagggaacgtaccggttcgtaggttacgttacgttaacgtggttaggcgggtaacggtcggcggtacgtacggaactaaccgtcgtaacgttaccgg

SEQ ID NO: 217 - DNA, 720 bp, Homo sapiens
  misc_feature: GYAE6OF01CX2ZU.19.26.C04.1.454.CMB.1.raw
  modified_base (668)..(668): a, c, t, g, unknown or other
  misc_feature (668)..(668): n is a, c, g, or t
  modified_base (690)..(690): a, c, t, g, unknown or other
  misc_feature (690)..(690): n is a, c, g, or t
  modified_base (702)..(702): a, c, t, g, unknown or other
  misc_feature (702)..(702): n is a, c, g, or t
tcagtactctcgtgcacgaccggtgctcgatttagtctagcgactttgggtttggggggtgagggttgagaacctatgaacattctggtaggggccaccgttctcctcctcggcctcctctctcactgcacaggctctgtgaccctcccatgtggtgactcacgcccaccctcgagtcgtcaggtcggaccccagggagagaccggccaggtacgttcccgtagggtggggaacgactaacgtttagagtaaggtaaaagtgtcgctactggtaccagcaggacggccgaggcccgacggtacccctaagtccgtcggtactacttctaagttaactaacgttacccgtcccggaccttacggacgggtacctcccgtagacgcctacgtctccgtgtaccctaccgaacgtcgtacggaaccgccggaccgtacctcgaacccgtcgaaggccgaagggtaccgaacgggcggggtatcgggtaacggttacctacgttagttaaccggtgtacggtagggttggaagggttataggtacggtagtcgggtataaggttcggttgttacgggtttccgggacgggaaccggtacaacggtgtaaccggaccgttacggtaacggccgaccgaaccgtcgaccgtcccgacccggtccgacgttcccncgttacccgtcccgcctccacncggtacgacgtnaggtccgggtccggacgg

SEQ ID NO: 218 - DNA, 743 bp, Homo sapiens
  misc_feature: GYAE6OF01CC24J.19.26.C04.1.454.CMB.1.raw
  modified_base (227)..(227): a, c, t, g, unknown or other
  misc_feature (227)..(227): n is a, c, g, or t
  modified_base (737)..(737): a, c, t, g, unknown or other
  misc_feature (737)..(737): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctccatgtggtgactcagcccaccctcagtgtcaggtcggccccgaggagaggaccggccgaggtacttcccgtgggtggggganaacgtaactttagataaagtaaaagtggtgacacgtacggtaccgagcgaaggacggaccgacgggaccgaccggacccctatacgtcggtactaacttacttaatttaacgtaaacgtaccccggtaccccggtcccgttaccggaacgggtacctcccgtacgacgtaccgaccttcgtccgtacggtaccctaccctaaccgttacggtaacggggaaacccacccggacccgtaacccgtacgtacccgtacgacggcggaacggggtacggaacgggtcccggggagtacgggaaccggtaccgtaacgttacgttacgtcggtacggtacggtagggtaggtaagtaggtaggtacggcggtacagttggtgttacggttcggacgggacggaacgacgtcgtacgaccgtcgacgtaccgcgaccgacgtcgtcccgcccgttcgccctacgtccgtcccgtacccctcctcccgtaccgacgacgtacgacggagcggcggngtacgg

SEQ ID NO: 219 - DNA, 677 bp, Homo sapiens
  misc_feature: GYAE6OF01AEGQU.19.26.C04.1.454.CMB.1.raw
  modified_base (284)..(284): a, c, t, g, unknown or other
  misc_feature (284)..(284): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgcacctggtggagtcgtgggggagcgtggtccagccgtggggacggtccctgacgacctctcctgtgcagcctctggacttccaccttnagtagtctttggcactcccacgtcggggtcccgccgacggcctccgaggcgaaggggctaggaggtgggtgctagttatatcatatagagtaggtaaggtaaatataattagtaggaacgtccgtaccggtaggaacgggtcccgtacgttaccacctacttcctacccgaggaacgtaacctaaacttaacccgaaacgtaaaccaacgaaggtacggtacgttacgtagaactaaagtacgaaaccgtacggaccgtaggtacggacggtacgggtacggggaaccgtaccgggtcgttacggttaagttacgttacggttggtacggccggagggtaccgggccgggtaccggtacggtacctaaaccgttaccgtaaccgttacccggg

SEQ ID NO: 220 - DNA, 849 bp, Homo sapiens
  misc_feature: GYAE6OF01A3L74.19.26.C04.1.454.CMB.1.raw
  modified_base (561)..(561): a, c, t, g, unknown or other
  misc_feature (561)..(561): n is a, c, g, or t
  modified_base (587)..(587): a, c, t, g, unknown or other
  misc_feature (587)..(587): n is a, c, g, or t
  modified_base (801)..(801): a, c, t, g, unknown or other
  misc_feature (801)..(801): n is a, c, g, or t
tcagtactctcgtgcacgaccggtgctcgatttagtctagcgactttgggtttgggggggtggagggttgagaacctatgaacattctgtaggtgccaccgttctcctcctcggcctccctctctcactgcacaggctctgtgacctcccatggtggtgacctcacgcccaccctcgagtgtcgacggtcgggaccccgaggaggacggaccggaccgaggtacttcccggtgggtgggggagaccgtaacgtttagaagttaagttaaaaggtgttcgacacgttcggaccaggcgaggacggccgaagggccctaaccgggtaccccttaagttaccgtcgggttactaacgttacttaacgtttaaacgttaaccgtaaccccgggtccccgggtaaccccgtttcggaaaccggggttcctaccccgttaggaaccggtaccggtaccgtttacgttccgaccgggttcctaacccgtaaacgtcggtaacgggaaccgtccccggaccctaccgtaccgaaccggtcgacggtacgacgggtaccgacgggacggngacggaccgccgtacttactacggtntaccggtagggtacgttacggggtaagtacggttagggtaccggtcggttacgtaggttcggttagtttacggttaccgggagggtaacgtaaaccgtcgggtaaccgtacggttacccggttaccggtaacggtcgtaccggaacccgaacgggtcctaccgcccccgttacgggcccgttaacccgtcggttacccctaccccggttacccncgtacccgtacggtacgtacgtacggcgtaaccgggtcggtacccggg

SEQ ID NO: 221 - DNA, 826 bp, Homo sapiens
  misc_feature: GYAE6OF01CC3K7.19.26.C04.1.454.CMB.1.raw
  modified_base (132)..(132): a, c, t, g, unknown or other
  misc_feature (132)..(132): n is a, c, g, or t
  modified_base (154)..(154): a, c, t, g, unknown or other
  misc_feature (154)..(154): n is a, c, g, or t
  modified_base (233)..(233): a, c, t, g, unknown or other
  misc_feature (233)..(233): n is a, c, g, or t
tcagtactctcgtgcacgaccggtgctcgatttagtctagcgactttgggtttggggggtgagggttgagaacctatgaacattctggtagggccaccgttctcctccgtcggcctcctctctcactgcacnggctctgtcacctccatgtggngactcacgcccaccctgagtcgtacaggtccggacccgaggagacggacggaccaggtacgttcccgtgggtagggganactatttagaattaaagtaaagtgtacgactacgttacggacagacgaggacggaccgtacggccgtaccggtacccttagtacgtcggtacttaattcttaaacgttaaccgtaccgtttaccccgggccccgtacccgtaggaaccgggtttcctcccgttaggccgtaccctacgttcctccggtacggaccttaccgaccgttgggaaaccgacccgacccgtacccgtacccgtacggtacccgaggaccgtacgggacgggaaccggacgggacgggataccgggacggtactacgttacgtacggtacgtacgggtaggttagggtacgttaagtaggttacggtacggtacgttagtaggttcgggtttagttaccggtttacggggaccggaacggtccgtacgttccggacccggttaaccgttacggtaccggtacccacggttacccggtaccgtaccgttcccccggtaccgttccgtaaccgtttacccgtccccgtttaccccgtaccccgttacccgtacccgaccggtaccgttacggtaccgttacgccgggtaacgggccgttacggaacccgg

SEQ ID NO: 222 - DNA, 689 bp, Homo sapiens
  misc_feature: GYAE6OF01D5QKZ.19.26.C04.1.454.CMB.1.raw
  modified_base (253)..(253): a, c, t, g, unknown or other
  misc_feature (253)..(253): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
  modified_base (428)..(428): a, c, t, g, unknown or other
  misc_feature (428)..(428): n is a, c, g, or t
  modified_base (558)..(558): a, c, t, g, unknown or other
  misc_feature (558)..(558): n is a, c, g, or t
tcagtactctcgtgcacgaccggtgctcgatttagtctagcgactttggggtttggggctgggagaggagcccagcactagaagtcggcggtgtttccattcgggtgatcagcactagaaacacagaggacctcaacctagtgggtaggtttgggctggaggtcggttcgggttttcctcgttaggtccttacgttttaaggaggttgtccaggtgtacgaggtgctacgtgggtggcgggtcggtggggggnggcggtggtaccaggtccgtaggggcggtctcgtagacgtctctcgtgtcgctacggtcctcgtgtactttccgaccgttntagtntcgttcgactcgtccgacggtcgggtaccgccgacggtcccgacggtagggacggagggtaatggggtagtcggggtgtatagttaacntaacttgtagaggtaagtagggtaaaatttaaactgtaagttacggaggttacgtacgtacggagggtaaccggtctacgtcaaccctagtactacgagtaacaataccgtaacaaacgtacagtacgtnacgctaggactaatagaacgctagtgacggtacggtgaccgggtactgggtactaggttcgttaaactgggcgtaacgggaggtaaccgggcgtaccgggaggtaaccaaccggtacttaacttaccgggg

SEQ ID NO: 223 - DNA, 904 bp, Homo sapiens
  misc_feature: GYAE6OF01EUCMY.19.26.C04.1.454.CMB.1.raw
  modified_base (181)..(181): a, c, t, g, unknown or other
  misc_feature (181)..(181): n is a, c, g, or t
  modified_base (195)..(195): a, c, t, g, unknown or other
  misc_feature (195)..(195): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagcttgggttttcctcgttgcttcttttaagaggtntccagtgtcaggtnccacgtggtggagtcgtgggggagcgtggtccagccgtggggacgtccctgacgtactccttccgtgtgccagtcccttcgtaggtacttccgaccctttcaacggttacgtccgttttgggacctaacttcccccgtaacgtttccgggggtaccccgtacccgtaacgggtccctttacccggaacgggggtaccggtaaaagggggggtccgttaagggtaaggggtttcgggggttacgggtaccgttaagggttttaaacttaacgttaccgtaagttaacgtaaggtaagttaagggggtaaaaggttaaaaaactttaagtttaaagttttaaggtaacgggtaaacgttaacccgttacccgggtttaagggaaaaccggggttcccgtaacgtttacccgaaccgttaacgttacccttaccgaacggtaacgtaaaccgtaaaccgtttaacccgaaaacgtaaacccgaaccggtaacggttaacgggtaacttacgtaccggtaacgtaaacgtacgaaacgtacggacccgttaggaacggtacgtaccgggtacggggaaccgtaccgggtacgtaggtttaacggttaacgtttaacggtaggtaccgggaacggtacggtacggtcccgggtacgtaccggtaactaaacccgttaaccgtaacgttacccgtaaacgggttttaacccgggg

SEQ ID NO: 224 - DNA, 1177 bp, Homo sapiens
  misc_feature: GYAE6OF01ED1VT.19.26.C04.1.454.CMB.1.raw
tcagtactctcgtgcacgaccggtgctcgatttagtctagcgactttgggtttggggctgggagaggagcccagcactagaagtcggcggtgtttccattcggtgatcagcactgaacacagaggactcaccagtggagtttggctgagtcgttgggttttcctcgttgtctttacgtttttaaaggaggttcgttaccgtaggttcggtccgtaagggtcgtaccgtacccggttggggttacgggtacgggttccggggttgggggggggaacgggtccggggtttaccgggttaccccgaacggggtcccgggttaggggggtaaccgggttcccccgttagggaaaccgttaccccgtttccgttacccggttgggttccggaccccggtaaccggttcccgtttaccgggttacgggtttaacccttttaccccggtttaaccttttaccggttaacgggtttaaccggtttccggtttttaccgggacccctttaaccggttaaccccccggtttaccggggtttacccggggggttccccccgtacccggtaaaccggggttcccccgtaaccgggaaaccggggggtaccgggtaaaacggggggttaccgttaaggggtaccggggggtttaggggttaacgggtaaccggttttaaagttttaaccgtaagttaccggttaaatttcgggttaaacgggtaaagggtttaaaaagggggtaaaaaagttttaaaaaagtttaggttttaaaacgtttaacggggtttaaacgggaaacgggttttaacccccgggttacggggtaaaacgggggtaaaccgggttacccggtttaaaccgtttaaccccgtaaaccgtttaacccgtttaacccgtaaccgttaaaacggaaccggttaaaaccgttaaacccgttaaaacccgaaaaccggttaaaccgtaacggtaaccggtttaggaaccggtttactaacgggtaaacctaaacggttaaccggaaaggttccccggtaaacggtaagggacggtaacccggggtaacggggttacccggggtaaaccgtcggggttacgttaagggttacgttttaaccgtaagggtcggaacggttacggacggttacgggacgttcggaacgaacccgttaactacgtaccgtttacggg

SEQ ID NO: 225 - DNA, 802 bp, Homo sapiens
  misc_feature: GYAE6OF01B40AB.19.26.C04.1.454.CMB.1.raw
  modified_base (233)..(233): a, c, t, g, unknown or other
  misc_feature (233)..(233): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactagcacaggctctgtcgacctccatgtggtgactcacgcccacctcagtgtcagtcggcccaggagacggacggccgaggacttccgtgggtaggggganactaacgtttgaattaaggtaaagtgtgactacgtacggtaccagacgaaggacggccgacggcctaccgggaccctagtactggtacacttacttagttataacgtacccgtccgaccctgaggtactcccgtgacgccgtactcgttcgcggtcctaccgaacgttacgtacggggaaccaccggtaccccgacctcggtaacccgtacgacgggtcgtaacgggggtaccgaacgggccggggacgtacgggaccggtaccgtaacgttaacgtttacgtacggttacggtacggggttgggtagggtaacggttaggtaaggtacgggtacggttacgttaggttagggttacgggttaacggttttacggggaccggggtaacgggtaacccgtaacggtaccggtaccggtacccggttaccggttaccgggtaccgtacccgggacccggtaaccgggtccgttaccccgggtaccccggttcccggttacccgtaccccgttccccggttccccgttacccccggttacccccttccccgttaccggacccggtaaccggg

SEQ ID NO: 226 - DNA, 730 bp, Homo sapiens
  misc_feature: GYAE6OF01DZ8IA.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtcgacctcccatgtggtcgactcacgcccaccctcagtgtcagtcggcccagggagacggacggccgaggtacttcccgtgggtaggggggactaactactttagataaggtaaagtgtgacacgtgtaccagcgagcggccacggccgaacggccctatacgtgtacattacttattactaacgtaccgtcccggcctcggaggtacctccgtaggacgtccgtactcctcgtcgtacctacccgtaactcggtacgggaaccacccgggacccctaacccgtcggacccctagaccggtcggaaccggggtacggaacgggtccggggacgtacggaccggtaccgtacgttaacgttcgtggtacggtaggtagggtacgggagttacggttaggtacggtcggtacgtacgttggttcgtttacggggtttcgggaacggggtaccgggtaaccgtagtcggtaccggtaccgtaccgtacggtaccgaccgtacccgaccgtccgtaccccgccccggttcgaccccttcgttaccccgttccgttacccccctacccgtaccccgccgtccggtaacg

SEQ ID NO: 227 - DNA, 633 bp, Homo sapiens
  misc_feature: GYAE6OF01DU8AK.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgaccctcccatgtggtgactcagccaccctcagtgtcagtcggccccaggagagacggccaggacttccctggtgggggagactaactttgataagtaaaagtgtgctacgtggtaccagcgagacggccacggccgacggcccctatacgtggtcatctattataacgttaccgtcccgcccgtcgacggtctccgtgcgcgtactctcgtcgcctacaactccgtaggacgaccgccacctcgtaccgtcacgcgagggtcgaacggcgggatggacggcgtacttagttcgtagtcgtggtcggtaggtagtgtaggtagcgtactgtgtgttagtttcgggcggacggacctaaggtcgacggtacctacggtacgtaccgacgaccgacggccgtcccgtccccggtcggtcccgtactccgttccctacccccgtaccctcccgtacgagtaccggtagtaacccggtgaccgggtggcggtaccggg

SEQ ID NO: 228 - DNA, 877 bp, Homo sapiens
  misc_feature: GYAE6OF01A62Z8.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagcccaccctcagtgtcagtcggccccaggagagacggccgaggacttcccgtggtggggagacctaactttagaataaggtaaaagtgtcgacgactacggtaccagcaggacggccgacggccgacggcccctaatacgtggtctattattaattaactaaccttaccccggtccccggtcccgttacgaacggggaccttcccgtagacgtccgtacctccgtactcggcctaccgtaactccggtacgggaacccgaccggtaccctacccgtacgacccgttaccgacggacccggtaacggggtaccggaacggggtaccgggggtaacgttacgggaaccgggtacccggtaaccgtttacgtttaaccggttcgttacgggtaacgggttgggtaacgggtagttaaggttaaggtacgggtcggtaccgttagttacgggttaggtttaaccggggtttacgggggaccgggtaaaccggggtaacccgtaagggcccggtttaaccgaaccccgggtttacccgggttaaccggggtaaccgtaaccccgggtaaccccggtaacggttccccgtcccccgggtacccccgtttcccgggtaaaccccttcccgttttccccggttaccccgtttacccccacccccgttaccctacccggtaccggtaacgtaaccgttcggaccgggttcgggcccgggtaccggg

SEQ ID NO: 229 - DNA, 802 bp, Homo sapiens
  misc_feature: GYAE6OF01BF9DI.19.26.C04.1.454.CMB.1.raw
  modified_base (516)..(516): a, c, t, g, unknown or other
  misc_feature (516)..(516): n is a, c, g, or t
  modified_base (521)..(521): a, c, t, g, unknown or other
  misc_feature (521)..(521): n is a, c, g, or t
tcagtactctcgtgcacgaccggtgctcgatttagtctagcgactttgggtttggggggtggagggttgagaacctatgaacattctgtaggggccaccgttctcctcctcggcctcctctctcactgcacaggctctgtggaccttcccgatgtggtgactcacgcccaccctctagtgtcgacggtcggccccgaggagacggaccggaccgaggtcgttcccgtggggtgggggacgaaccgtaacgttttggaacttaaaggtaaaacgttggtacgtaccgtaccggtacggtaacccgaggaccgaagggtacgggacccgacgggtaccaccgggtaccccttaagttaccgttggtctaaacttcttaaagtttacttaaaccgtccccggtaccgtccccgtacggaacggggtccttacccgtacgggacctccggtaccttccgtcgtacgggtaccctaccgaacgttcgtaacgggaccacccggtccaccgtacgaaccgtnacggngtacgggtacgaacgggcggtacgcgggtacggtctaacgttacggtttaccgtcggttaccgagggttaggtgggtagtaggttagtacgggtcgtaggagttcggtacgttacggtttaccgggagggacgtaacgtacgtacgtacgtaccggtactacggtaccgacgaccgtacgggtcccgtaaccggtcccgttacgaccgttcgttccgtccccgtttacccacccgttccctaccgggacacggtacctcggaggtaccggtcgcgtacggg

SEQ ID NO: 230 - DNA, 740 bp, Homo sapiens
  misc_feature: GYAE6OF01BN8V5.19.26.C04.1.454.CMB.1.raw
  modified_base (247)..(247): a, c, t, g, unknown or other
  misc_feature (247)..(247): n is a, c, g, or t
  modified_base (468)..(468): a, c, t, g, unknown or other
  misc_feature (468)..(468): n is a, c, g, or t
  modified_base (726)..(726): a, c, t, g, unknown or other
  misc_feature (726)..(726): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacgaggctctgtcgaccctccatggtggtcgactcgacgccctaccctcagtgtcgaggtcggcccgagggacgacggaccggccgaaggtcttcccgtagggtggggganaacttaacgtttgaagttaaggtaaagtggtacgactacgtacggaccacgacgacggacggaccgacggacccgaccggtaccctagtacgtcggttaccaattccttaatttaacgtaaccgttaccccggtcccgtccctacggacggtacctccccggaggaccgtccgtacttccgtcgtccgtacgtacccgtaacgttcgggtacgggaacccnccgggtacccacccgtacggacccgtacgacgggtccggaacgggtacggaacggggccgggtagacgggtacggaccgtacttacgttacgttgtacgggtagtgggtagggtagttagggtagtacggtcgtagtggttgttcggttacgggttcgggacgtacgggaaccgtgtacggtcgtacccggtgtacggtcgaacgcccgacgtcccgtacgaccccggtcggaccttccgtctacccgtccctacccncgtaccgcgtaacg

SEQ ID NO: 231 - DNA, 757 bp, Homo sapiens
  misc_feature: GYAE6OF01CRVTE.19.26.C04.1.454.CMB.1.raw
  modified_base (178)..(178): a, c, t, g, unknown or other
  misc_feature (178)..(178): n is a, c, g, or t
  modified_base (196)..(196): a, c, t, g, unknown or other
  misc_feature (196)..(196): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagcttgggttttcctcgttgcttcttttaaagnggtgtccagtgtcaggtncacctgggtggagtcgtgggggagcgtggtccagcctgggacggtccctgagactctcctgtgcagtcctctggattccaccttcagtagtcttttcggctactcccacgttggggtccccgccgacggcctccgaggaccgtaagggggcctagggaggtcggggtggtactaaggttactatactagtactggaagtagggtaaaggttaaaaatgttaaactttagacgggtaacgtccgttaccggtagggtaaacggggtccgtaacttccgtaaccctaacgttcccttaaccgaaggtacgtaaaccctaaactttaacccaaaaggtaacctaaccgtaaggttacgggtaacttcgtacggtaactaaagtaacgaaccgtaacgccgttaacgaagggacggtacgggtacggggtaaccggtaccgggtacgttagggttacgttacgttaccggttagggtacggtaccgggtagggtacgggtaccgggtcccgtagggtaaccctaaacgttccttaaacgtccgtttaaccggttttaacgggggg

SEQ ID NO: 232 - DNA, 685 bp, Homo sapiens
  misc_feature: GYAE6OF01EJG2J.19.26.C04.1.454.CMB.1.raw
  modified_base (218)..(218): a, c, t, g, unknown or other
  misc_feature (218)..(218): n is a, c, g, or t
  modified_base (560)..(560): a, c, t, g, unknown or other
  misc_feature (560)..(560): n is a, c, g, or t
  modified_base (640)..(640): a, c, t, g, unknown or other
  misc_feature (640)..(640): n is a, c, g, or t
  modified_base (666)..(666): a, c, t, g, unknown or other
  misc_feature (666)..(666): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagagacgcgaggacttccgtggtggggganacgtaacttgataagtaaaagtgtgactgtacggtaccagacaggacgccgacggccgacgtaccccgtaatcgtcggtcaattactaattaactaaccgttacccggtccggtacccctacgtaacgggctcccgttaggtaccgacgttcctcctcggttcgcctaacctcgtacggtcccccggaaaggtacccgaccctaccggtacgcctacggacgacggtacgggaacgtaccggggaacggtacgacgggaccggcgtaaacttacgttacgtcgaacggtagtcgggtagtagtaggaagtggtcgtatagtgtatcggtcgacgggacacgngtgaccgtacgcgttgacgtaccacgtacgcgtaccccgtccggttccgtacctactccgtttcccgaccccgttccccnccgttacgacggacctaggttaccgnggaacgggtccgagtacgg

SEQ ID NO: 233 - DNA, 750 bp, Homo sapiens
  misc_feature: GYAE6OF01COWL6.19.26.C04.1.454.CMB.1.raw
tcagtactctcgtgcacgaccggtgctcgatttagtctagcgactttgggtttggggggtgagggttgagaacctatgaacattctgtagggccatcgttctcctcctcggcctcctctctcactgcacaggctctgtcgacctcccatggtggtgactcagccacactcgagtcgtcaggtcggaccccgaggagacggaccggccgaggtacttcccgtgggtgggggaacgactaacgtttagaagtaaggtaaaagtgtgactacgtacggtaccgagacgaggacggccgacggccacggaccctatacgtcggtctatacttaattaacgttaaccgtaccccggtcccggtccccgtacggtaaggtacccgttacccggtaggaccgtaccgtaccgttcctcgtccggtaccctacccgtaacgtcggtacggaaccgaccgacccgacccgtacgaccgtcgacgtacggacggtacggacggacgggacgtacggaccggaccgtacgttacgttacggtcgacggttaggtacggtaggtagtagtaggtcggtcgtagtagtcgttaggttacggttcgggaccgggtaacggacgtacgtaccgtaccggtaccgttacgtaggacccgtaccggaccgtagcccggtacccgtccggtacgtaccgtcccgttccgttcccgttcccctcccgtcccgtaccgtacgtaccgtagtaccgggtacgcgggtacgg

SEQ ID NO: 234 - DNA, 720 bp, Homo sapiens
  misc_feature: GYAE6OF01A098M.19.26.C04.1.454.CMB.1.raw
  modified_base (249)..(249): a, c, t, g, unknown or other
  misc_feature (249)..(249): n is a, c, g, or t
  modified_base (263)..(263): a, c, t, g, unknown or other
  misc_feature (263)..(263): n is a, c, g, or t
  modified_base (384)..(384): a, c, t, g, unknown or other
  misc_feature (384)..(384): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggtttcctcgttgctcttttaagaggtgtccagtgtcaggtgcacctggtgagtcgtgggggagcgtggtccaggcctgggaggtccctgagactcncctgtgcagcctgnggtacttcgacctttcagttacgtcgttttaggccacgttccccacggtcgggtaccccgccgacggtcctaccgagggacccgaagggggccttaagggaggtcgggtgactaggtttanatcgtatagtggaagtagggtaaaagtaaaattagtacgtttaagtacgggtaagacccgttaccggtaagggaaccgggtaccttacggtaccctaaccgtacgttaccccgtaccggtaaacgtaaccgtaacgttaaaccgttaaaccgaaaccgtaaaccaacggtaggtacgttacgttacgtaacgtaactaagacgtaaccgaccgtagtacggagtacggcgggtaacgggcgtaccggtacgttcggttacgttaacgttcggtagggacggtacggaaggcggacgggtaccgtacgaaaccgtacctacgtaaccgtttaccggg

SEQ ID NO: 235 - DNA, 720 bp, Homo sapiens
  misc_feature: GYAE6OF01AUWKL.19.26.C04.1.454.CMB.1.raw
  modified_base (177)..(177): a, c, t, g, unknown or other
  misc_feature (177)..(177): n is a, c, g, or t
  modified_base (201)..(201): a, c, t, g, unknown or other
  misc_feature (201)..(201): n is a, c, g, or t
  modified_base (455)..(455): a, c, t, g, unknown or other
  misc_feature (455)..(455): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagcgtggttttcgtcgtagctctttaagagtntccagtgcaggtgcacctggtggngtcgtggggaggcgtggtcaggccgtgggacggtccctggacgccttcgtccttggcgacacgtcctgtggattccacctttcgaggtagtcgtttacggctaacttcccgacgttccggggtacccgcccgtaggggtcctacccgggaggacccgtaaaggggggtcctagggtagggtcgggtagggacctaggtttactacttacgagttagtgaaggttaggtaaaggttaaaaattgttaattaaggnggtaacgtacgttcggtaaggaaccgggctaccttcgactacgtacctacgaagacgtaactaaacgttaacgaacgtaaccgacgagtacggtactccgtagaaacctagtacaacgcacgtggaagtacggtaccggtacggggaacctacggaccgttaggtaacgtttagttacgtacggtagggtacggtaacgggcggttaccggaccgtcggtaaacctacccttaagtaccgttacggttacgttttacccgggggg

SEQ ID NO: 236 - DNA, 733 bp, Homo sapiens
  misc_feature: GYAE6OF01BAX1V.19.26.C04.1.454.CMB.1.raw
  modified_base (587)..(587): a, c, t, g, unknown or other
  misc_feature (587)..(587): n is a, c, g, or t
  modified_base (659)..(659): a, c, t, g, unknown or other
  misc_feature (659)..(659): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgaccctcccagtgtggtgactcacgcccaccctcagtgtcagtcggccccaggagagacggccaggacttcccgtggtgggggagactaacgtttagataagtaaaagtgtgcacgtcggtacagcaaggacggaccacgggccgaccggtacccctattacgtcggtactattaccttaatttaactaaaccgtaccccggtcccggtacccctcgacgggtacctcccgtggacgccggtacctccgtcgtcgcctacccaaccgtcggtacggaaccgcccggaccctacccgtacggtacccgtcgaccgtacgggacgggtacggaacggggaccgggagtacgggaccggaccgtaaccgttagtttacgtcggttacggtagggttgggtagggtagttaggtagggtgtcgtacgtagttggttgttcggtttacgggnggacggtacagtcgtacggaccttcggacgtaccgaccgaccgtacggtcccgtcccgtcccgtcggtcccnccgttcccgttcccgtccccctcccgttcccaccggacgtagtccgtacggcgggacggccgggaccgtacggg

SEQ ID NO: 237 - DNA, 872 bp, Homo sapiens
  misc_feature: GYAE6OF01CDVVD.19.26.C04.1.454.CMB.1.raw
  modified_base (142)..(142): a, c, t, g, unknown or other
  misc_feature (142)..(142): n is a, c, g, or t
  modified_base (520)..(520): a, c, t, g, unknown or other
  misc_feature (520)..(520): n is a, c, g, or t
  modified_base (808)..(808): a, c, t, g, unknown or other
  misc_feature (808)..(808): n is a, c, g, or t
tcagtactctcgtgcacgaccggtgctcgatttagtctagcgactttgggtttggggctgggcctaaggaagcagcactgggtggtgcctcagccagtggcctggaccgttctcctcctcggcctcctctctcactgcacgnggctcgtgtcgaccctccagtggtggtcgacctcgaccgcccaccctgaggtcgtcgacggtccggacccgaggacggacggaccggaccgtacggtaccgttcccggtaggggtacgggggaactaaacgttaacgtttaggaaagttaaaggttaaaaggttcggtacgaccgtaacggttacggtaacgacggacgacggacggaccggtacggacccgtacccggtacccgtagtaccggtcgtactacttagttaacgttaacgttaccgtacccggtccggtaccctacggaacggtcccttaccggaggacgtccgtactcgtacgtccgtacctaccgtacgtacggtaccggaaccgaccgccgtaccncgggacgtcgacggtacggtaaccggggacggaaccgggtcgggtaacggtccgggaaccgtaccggttaacttacggttaccggttcggtagggtacgggttaggggaacgttaacgggtttaacgtacgggtacggttacggtacggtttagggttcggttacgggtttttaacggggtaccgggaaccgggtaaaccgggtccgtaacggtcccgttacgggttacccggacgggttacgacccggaccgggtaaccgacccgggttccctcccgggttaccccncggttcccgacccgtttacccgttcccctaaccccgtccctaacccggtcgtccggtaaaccgg

SEQ ID NO: 238 - DNA, 840 bp, Homo sapiens
  misc_feature: GYAE6OF01CR7RN.19.26.C04.1.454.CMB.1.raw
  modified_base (816)..(816): a, c, t, g, unknown or other
  misc_feature (816)..(816): n is a, c, g, or t
  modified_base (825)..(825): a, c, t, g, unknown or other
  misc_feature (825)..(825): n is a, c, g, or t
tcagtactctcgtgcacgaccggtgctcgatttagtctagcgactttgggtttgggggggtgagggttgagaacctatgaacattctgtaggggccaccgttctccctcctcggcctcctctctcactgcacgaggctctgtgaccctccatgtggtgactcacgcccaccctcagtgtcagtcggccccgaggagacgacggcctaggtacttcccgtggtaggggacaactaacgtttgattaaagtaaagttgtcgacacgtaggtacagcgagacggccacggaccgtacggccccttagtccgtcggtactacgttactaatttacgtaaaccgttcccggttaccccggtcccctacggaacgggtaccttacccgtgtaacgtccgtaccttccgtcgtacggtcctaacccgtaaccgtacggtaccgggtaacccgaccgtaccccgtacccgtaaccggtacccggtacgaaccggtccggggtaacgggttaacccgggaacgggggtccccggggtaagtaccggggtaaaccgggtcccgtttaaaccgtaggttttacccgagggttacccgggtagggtttacgggtagggtaaacggtttacggtaaaggttcgggtacggtttaccgttagggttacgtttagggtttacgtttaccggggacggtaaaccgggtacctacgggtactaaccggtacccgtagtaaccgggtcgacccgaacgtccggtcctaccccggcccgttacgccgttccctcgtcccccttacccgcccttcccgaacgttaccgcggttacncggaccggnggtccggccgtaagg

SEQ ID NO: 239 - DNA, 715 bp, Homo sapiens
  misc_feature: GYAE6OF01CQE3U.19.26.C04.1.454.CMB.1.raw
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagtccaccctcagtgtcagtcggccccgaggagaggaccggccaggtacttcccgtggtgggggacgacgtaactttgaattaagtaaaaggttgtagactacgtcggtaaccagacgaggacggccgacggccgaccggaccctatacgtggtcattcttaattatacgtaccgtccgccctagacggactccgtgacgcgtactctcgtcgacctaccgactcgtacggaccgtcgaccaccgtcgaccgtacgacgcggaggtcggaacggcggggactacgggacggtaccgtaacttacgtagtacggtacggtacggtagggtacggtagtaggtaacggttaggcgtataggttcgttggttacgttcgggacgggacggtacgacgtcgtaccggtaccgtcgtacggtaccgtacggacggtaaccggcctaccggtccccgtctaccgttcccgtaccgttcccgttaccccggttcccccgtcccgttacccctacccggacgtaaccggtcgttaacccggcgggaaccgggtcgtaaccggg

SEQ ID NO: 240 - DNA, 770 bp, Homo sapiens
  misc_feature: GYAE6OF01BQU2H.19.26.C04.1.454.CMB.1.raw
  modified_base (162)..(162): a, c, t, g, unknown or other
  misc_feature (162)..(162): n is a, c, g, or t
  modified_base (180)..(180): a, c, t, g, unknown or other
  misc_feature (180)..(180): n is a, c, g, or t
  modified_base (671)..(671): a, c, t, g, unknown or other
  misc_feature (671)..(671): n is a, c, g, or t
tcagtactctcgtgcacgaccggtgctcgatttagtctagcgactttgggtttgggggggagaggagcccagcacttagaagtcggcggtgtttccattcggtgatcagcactgaacacagacggactcaccatggagtttgggctgagcttgggttttccngttgcttcgttttaaggnggtctccagtgtcaggtcgcactggtggagtcgtggggagcgtggtccagtcgtgggacgttcccagacgaccttctccgtgtcgcacgccttacgtggtacttccaccttgaagttcgtcgtttcggactacgttacccgaggttcgggtaccccagacggcccttcggaaggtaccggaagggggtctacgggtagggtcggggtagaccgttaagtttatacgtacgtaattacggttagaacgttaagggtaaaacgtttaaatgttttaagtacggtacgggtaactaaccggtccggtaagggaaaccgggtaccttaacttcccggaactacggttaccctaccggaacgtaacgtaaacccgttaaacgtaccaaaagtaacccgagttacgggtaacgtactttacgaacgaaaccggttaagaaccggtaaacgaccgtacggtaacggaggacggttacgggacggggtactaacgggtnttacgggtacttacgttacgggtagtaccggtacgaggtacccggcggtaccgtacggtaacctaccggttacctacggttcccgttaagggttacggg

SEQ ID NO: 241 - DNA, 589 bp, Homo sapiens
  misc_feature: GYAE6OF01ESBK5.19.26.C04.1.454.CMB.1.raw
  modified_base (198)..(198): a, c, t, g, unknown or other
  misc_feature (198)..(198): n is a, c, g, or t
  modified_base (208)..(208): a, c, t, g, unknown or other
  misc_feature (208)..(208): n is a, c, g, or t
  modified_base (260)..(260): a, c, t, g, unknown or other
  misc_feature (260)..(260): n is a, c, g, or t
  modified_base (314)..(314): a, c, t, g, unknown or other
  misc_feature (314)..(314): n is a, c, g, or t
  modified_base (360)..(360): a, c, t, g, unknown or other
  misc_feature (360)..(360): n is a, c, g, or t
  modified_base (382)..(382): a, c, t, g, unknown or other
  misc_feature (382)..(382): n is a, c, g, or t
  modified_base (390)..(390): a, c, t, g, unknown or other
  misc_feature (390)..(390): n is a, c, g, or t
  modified_base (419)..(419): a, c, t, g, unknown or other
  misc_feature (419)..(419): n is a, c, g, or t
tcagtactctcgtgcacgaccggtgctcgatttagtctagcgactttgggtttggggctggggagaggagcccagcactagaagtcggcggtgtttccattcggtgatcagcactgaacacagaggactcaccatggagtttgggctgagcttgggttttcctcgttgcttcttttaagaggtgtccagtgtcaggtncactggtggngtcgtgggggagcgtggtccagccgtggggacgtccctgagtacctctctgncacgcctctggattcaccttcagttgtctttggcactccgtacgtcggggtccnccgaggtcctccgaggcgaaggggctaggaggtgggtgctagttantcatatgagtaggaattaaatnttattagnggacgtactcggtaggacggctatacacnctctccgagacaactaactacaacaacgtaacgagtagtactctacgaactaagagaaacgcgtaccgtaggaggtacggtcgtacggggaacacgggtcttggtaacgttacgttcggttagcgggcgtaggaggccgtacgtacggaacctagtactacgttaaccgg

SEQ ID NO: 242 - DNA, 1023 bp, Homo sapiens
  misc_feature: GYAE6OF01CQMX2.19.26.C04.1.454.CMB.1.raw
  modified_base (253)..(253): a, c, t, g, unknown or other
  misc_feature (253)..(253): n is a, c, g, or t
tcagtactctcgtgcacgaccggtgctcgatttagtctagcgactttgggtttggggctgggcctaaggaagcagcactggtggtgcctcagccatggcctggaccgttctcctccgtccggcctcctctctcactgcacaggtctctgtcgacctccctatggtggtgacctcgaccgcccaccctcagtgtcgacgtccgggcccgaggagacggaccggaccgacggtacgttcccgtgggtacgggganaaccgttaacgtttagaagttaagttaaagtggtacgactacggtacggacagaccgagtacggcgacggaccgaccggtaccctagtacgtcggtactacgttaacttaactttaacgttaaacccggttcccggttacccgggtaccccttacggggtacggttacccgttacccggtacggtaccggtaccgtacccgttccgttccggtaccggacccctttacccggtaaacccgtttacgggtaacccggggtaaaccccgaaccccggggtaccccccttaacccgggtacccggaaccccggttacgggacccgggtaaaccggggtaccggggtaaaacccggggaacccgggggtccgggggtttaaaccgaccggggggtaaccggtacccccgggtttaaacgtttaccggtttaaacgggtttcccgggtaaggggttaacggggggtttttaggttaaaccggggttaaaggtttaacgggggttaaacccggttagggtttaacccgggttagttaacgggtttcgggttttaacggggtttaaccgggggtttaacccggggttaacggggaaccccgggtaaccgttaaaccgggttccgggttaaccgggttacccggttaacggtacccgggttaacctacccgggtaccgtacgggtaccccggttccccgtaacccgggttcctacccgtacccgggttcctttacccccgtaccccggttcccctaaccgtccggaacgttacccggg

SEQ ID NO: 243 - DNA, 898 bp, Homo sapiens
  misc_feature: GYAE6OF01DZM4M.19.26.C04.1.454.CMB.1.raw
tcagtactctcgtgcacgaccggtgctcgatttagtctagcgactttggggtttgggggggtgagggttgagaacctatgaacattctggtaggtgccaccgttctcctcctcggcctcctctctcactgcacaggctctgtcgacctcccagtggtggtacgactcacgcccaccctcgaggtcgtcgaggtccggacccgagggagacggacggccgagggtaccttcccggtggggtacggggggaacgtaactaacgtttaggaagttaaaggttaaaaggttcggtacggtacctacggttacgggtaaccgacggacgaacggggaccggaccggaaccggggacccgaacccgggtaccccttaacgttaccggtacgggttaccttaacttacgtttaactttaaacgttaaaccggttacccccgggtccccggtacccgtacgggaacgggtacccttcccggtagaacccggtcgtaccttccgtcggtcggacccttaccgaaccgttacggacgggaacccgaccggacccgtaccgtacgaccgtcgacggacggacgggtacggacgggcgggagtcggacgtcgtatacgttcgtgtacggtaggtacggtaggtacgtaggtaggtacggacggtacgtaggtcggttcggtttacgggttcggggaacgggtaacggtaacgaacggtcggtaccggtaaccggtaccgggtaacggtaccgaccggtaccggtaccgggaccggtccccggtacccccggttacgtaccgttacccgttccccggttacccgtaccccccgtaccccgttaccccgtaacccgggtaacccgggtaacgtaccgggtaacggttcgggaccgggttcggggtaaccggg

SEQ ID NO: 244 - DNA, 801 bp, Homo sapiens
  misc_feature: GYAE6OF01AEFHV.19.26.C04.1.454.CMB.1.raw
  modified_base (453)..(453): a, c, t, g, unknown or other
  misc_feature (453)..(453): n is a, c, g, or t
tcagtactctcgtgcacgaccggtgctcgatttagtctagcgactttgggtttggggggtgagggttgagaacctatgaacattctgtagggccaccgttctcctcctcggcctcctctctcactgcacaggctctgtgacctccagtgtggtgactcacgcccaccctcagtcgtcagtcggccccaggagagaccggctaggacttcccgtggtgggggacactaacttagataagtaaaagtgtgtcaacgtcggtaccaagcgacgaggtaccgagggaccaacgggcccctaatacctaggtccatacctactttaactaacgttacccggtccggacctcggtaagggacctacccgtgaaccggctacctcgtactcggtccacccaagttcgaacggggaacacccggacctaccttaggaacccggttaccgagtaaccggggngtaaaccgggccggggtaagtagggacccggggtacctaaaccggttaactttaaccgtaccggttaccggaaaggttcggggtaggggtaagtaaacggttagggtaacggtaccgggtagttaaggtcggtttaaggttaccggttttacgggaccggggtaacggaaccgttaacgggactcggtaacccgggttacgtaccggtacgtacgacccgggtaaacgccgggtacctaccccgggttcgacccttatacccggttcccgttacccccgacccgtttccgtaccccgaaacggtacgtaaccgtttacgaaccggaggtacccggggttcgaaccggg

SEQ ID NO: 245 - DNA, 1048 bp, Homo sapiens
  misc_feature: GYAE6OF01B5VQO.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtcgaccctccatggttggtgactcgacgcccaccctcagttcgtcgaggtccggaccccgagggacggaacggtaccggaccgaaggtccttcccggtggggtagggggaaataaccgttaacgttttagaaagttaaaaggttaaaacggtggtcggtacctaacggttacggtaaccaggaccgaagggtaccggacccggaaccggtacccgacccggtacccgttaacgttaccggttacggtacctaactttaacgtttaaagtttaaccgtttaaacccggtcccccggttaccccggtaccccgttaacggaaccggtaccgttcccggtacggtaaccggtccgtaccgttccgttcggtaccgtacccctaacccgtaacgggttaccgggaaccggaacccggacccgtaccccgttacccggtacggaacccggtacggacgggtaaccgggtacggggaccgggaaccgggtacggggtacgtacgggtaccgtaaccgtactttaacggttcggttacggtacgggtacgggtagggtaagggtacgtacggtacggtacggtacggtacgttagttacggttacgggtttacgggttacggggtaccgggtaaaccgggtaccgtaaccggtacggttacccggtaaccggttacccggtaccggtacccggtaacccggacccggttaccgggacccccggttaccccggttaccccgggttacccggtttaccccggtaccccgttttccccggttaacccccgtttaccccccgtaaccccggttacccccggtaacccgggtaaacccgggttaacccggggtttaacccgggtttacccggggtaaccggggttaacccgggggtacccgggttaaccggggtaaccgggg

SEQ ID NO: 246 - DNA, 692 bp, Homo sapiens
  misc_feature: GYAE6OF01D92FC.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagagacggccaggacttcccgtggtggggagacaacgttttgaataagtaaaagtgtcgctacgtggtaccagcaggaggccaggccacggcccctatacgtgtcattactaattataactaccgtccggcctgacggactccgtagcgcgactctcgtgcctaccaactcgtaggaccaccgccacccgtcgaccgtcacgcggacggtacgacggtccgggatgacggccgtaacttattaccggtcgtacggtaggtagggtaggtaacgttaaggtacggtacggtcggtactagttcggttagttaccggtttcggggacggtacgggaaccacggtctaccggtacccgtacggtacggtacgaaccgtcccggaaggtcctcccggtaccccttggtccctaaccgtttcccgtaccccgtttacccccaccccgttcccgttacccgacggtaacgtacggttaacccgagggtacgggccggtacgtaacccggg

SEQ ID NO: 247 - DNA, 801 bp, Homo sapiens
  misc_feature: GYAE6OF01BCR79.19.26.C04.1.454.CMB.1.raw
  modified_base (337)..(337): a, c, t, g, unknown or other
  misc_feature (337)..(337): n is a, c, g, or t
  modified_base (368)..(368): a, c, t, g, unknown or other
  misc_feature (368)..(368): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccacactcagtgtcagtcggccccaggagagacggccaggacttccctggtggggagactaactttgaataagtaaaagtgtgcacgtcggtaccagcagacgccgacggccacggtcccctatacgtggtcattctattaataactaccgtccgccctgacggactccgtggacncgactctcgtcgcctcactcgtacggaaccnccgcccaccgtcgaccgtacgacgacgacgggtacggaacgggtccgggagtacggacggaccgtaacttacgttcgtaggttacggtagggtaggtaggggtaagttacgggttaacgtacggtccggttagttggttaggttggtttacggttttccgggacggggtaacgggtaacccgtaggtaccgttacccggtaccggtacccggttacggttacccggaacccgacccggtaacgggtccccgttaccccgggtcccccggtttccgggtaacccgttacccgtttccccgggtttaccccggtttcccccccggtccccccgtttacccccgttaaccccgggtaaccccggttaacgggttaaaccccgggtttaaccgggttccgggggtaacccgggtccccgggggggttaaaccccggg

SEQ ID NO: 248 - DNA, 928 bp, Homo sapiens
  misc_feature: GYAE6OF01E4Q2E.19.26.C04.1.454.CMB.1.raw
  modified_base (315)..(315): a, c, t, g, unknown or other
  misc_feature (315)..(315): n is a, c, g, or t
  modified_base (842)..(842): a, c, t, g, unknown or other
  misc_feature (842)..(842): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcacatggagtttgggctgagtcttgggttttcctcgttgcttacgttttaagagggttacgtcctagttcgtcgagggtcgcctaccggtgggttagggagtcggtagggggaggtcgttggtcccgaggccgtagggggtaccgtcccgtaggacgtaccttccgtccgtgtcgacgacgtccttcgngtacttacctaccttgtacgtagttccgtttgcctacgtaccgcgggtccgggtaccccgtacgacggggtcctccggaacggggtacggaacgggggttactacgggtaggggttcgggtacggtaacgttaaaggtttactaagtacgtaattaaggtcgtaaagggttaaggggtaaaaaacttaagttaagttttaaacgtagggttaacggaaccggttacccgtaccgggttaaaaggaaacccggggttctttaaaccctccgtaaacccgtacgttaccccgtaaccgaagggtacctaaaactaaccgttaaaccggaaaacgaaccgaaagggtacggtttacggaacgttttaaccgaacggtaaaccgtaaagtaaccgggtaaccgtacggtaacccggtaaggggaccgggtacgggtaaccgggtaacggtaacccgggcgggtttaacggtttacggtttaacgttaagggtttaccgttacgggggacgaaacggggttacggggtaccncccgggggttaacgtaacggttaaacccgttaacccttaaccgggtttaacgtttacggggttttaaacccgtttaaccggggggg

SEQ ID NO: 249 - DNA, 874 bp, Homo sapiens
  misc_feature: GYAE6OF01EXMXV.19.26.C04.1.454.CMB.1.raw
  modified_base (282)..(282): a, c, t, g, unknown or other
  misc_feature (282)..(282): n is a, c, g, or t
tcagtactctcgtgcacgaccggtgctcgatttagtctagcgactttgggtttgggctgagctgggttttcctcgttgctcttttaagaggtgtccagtgtcaggtgcaccgtggtggtagtcgtgggggaggcgtggtccagccgtgggaggtccctgagctctcgtgtcgcacgcctcgtggacttccaccttcaggttacgtcgttttggacctacgtcccgtacggtcgggtccccgccgaaggccgtaccgagggaccggaaacggggtctaagggngggttcggggtaggccgtaagttatacgtactagttaggtgtaaggttaaggtaaacggttaaaaattagttaagttaggttacgggaacgtaccgttacccgggtaaggaacgggtcctaagtttaccactacgtacctaccgaagaacgtaactaacttaccgaaaagacaacggtaggtaggctaccgtagtaacaaaagtcgaaacgtacgcgtaacggacggtacggacgggtacgggtaacgtcggttacgtagggtttacgttaagttaccggttaggtacgggtaacggacggtacggtccgggaacgttacgggtaaaccctaaccttacgttaccggttaaccgtttacgggtttacgggtttagggaacccgggttcgggaaccggggtaacccggaaccgggtaacccgtaccgggtaccgttaaccgtcccgtacccgttaccccggaaccgtccccgtaaaccccgtaccgggaaccggtccccgtaccgggtttccccgtacccccgttccccgggacccttcccggaccccgtacggtcccggaccggaacggttacccgccccggttaacccggg

SEQ ID NO: 250 - DNA, 738 bp, Homo sapiens
  misc_feature: GYAE6OF01BORWL.19.26.C04.1.454.CMB.1.raw
  modified_base (536)..(536): a, c, t, g, unknown or other
  misc_feature (536)..(536): n is a, c, g, or t
  modified_base (699)..(699): a, c, t, g, unknown or other
  misc_feature (699)..(699): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtcgacctccagtggtggtcgactcacgcccaccctcgtagtgtcgacgtccggccccgagggagacggaccggccgtaaggtccttcccggtgggtacgggggaactaaccgttaagtttagaaagttaaagttaaaggtcgtgacctacggtacggaccagcgaaggtaccggccgacggcccgaccggtacccttagtacgtcggtactacttacttaattaacgtaaccgttacccggtcccgtacccgacggtacggtacctccgacgacggctacgtctcgtccgtacctacgtacgtacggtaaccggaccaccggcctacggcgtaccgagacgacggtacggacggacgggacggtaggacgacgtacgtaacgttacgtcgtcggtagnggtcgggagtacgtaaggtcggtcgagttacgtgtagttcggtacggttacggacggtacggtaccgcggtaccgtaccgggtacccgtacgtacgaccggtacgtacccggagtacccggtccgtccccgtagtaccctccgttccgtaccctcccctcccncgtaccggaccgtaggtactcgggcgtacggcggtacgg

SEQ ID NO: 251 - DNA, 882 bp, Homo sapiens
  misc_feature: GYAE6OF01BJVLS.19.26.C04.1.454.CMB.1.raw
  modified_base (149)..(149): a, c, t, g, unknown or other
  misc_feature (149)..(149): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccntgtggtgactcacgcccaccctcagtgtcaggtcggccccgaggagagacggcgaggtacttcccgtgggtaggggaacgaacgtaacgttttagaagttaagttaaaaggtggtagacgtacgtacggtaccagaccaaggacggccacggccacggccctaagtacgtcggctattacttaattaagtaacgtacccggttccccgcccgttacgacgggtaccgtccgtacggacgtaccgtaccgtcctttccggccgggtcccttaacccgtaaaccgttccggtaaccggggaaacccggtacccggtacccccgtaacccgttcgaacccggtccgaaccggaccggtaggggtaaccgggaaccgggtacccgggggtaacgtcgggaacccggtacccggtaacctttaacggtaaccgtttcgggttaacccggtaggggtttacggggtaggggttaacgttaacgggttaacgggttaccgggttacggttaacggttacggttaggttacggggtttaaccgggttttccggggaaccgggtacggtaaccgaaccgggtcggttaccggtaccggttacccggttacgtaccggaccggtacccggtaggtacccgtcccgtaccccggtcctacgtcccgtccgtccctttacccccacccgttccctacgaaccgggttacgtaccgggtacgtaacgggtcggcgggtacggtcgg

SEQ ID NO: 252 - DNA, 1063 bp, Homo sapiens
  misc_feature: GYAE6OF01A2Q7E.19.26.C04.1.454.CMB.1.raw
tcagtactctcgtgcacgaccggtgctcgatttagtctagcgactttgggtttgggggtgagggttgagaacctatgaacattctgtaggtgccaccgttctcctcctcggcctcctctctcactgcacaggctctgtcgacctccatgtggtgactcacgcccaccctcagtcgtcagtcggacccgaggacgacggaccggccgaggtaccgttcccgtgggtagggggacgtaaccgtaacgtttgaagttaaaggtaaaacggtggtgcgtacgttacggtaaccagacgaggacgaccgacggaccgacccggtaccctaagtactcggtactaacgttacttaatttaacgtaaccgttaccccggtcccggtaccccttacggaacgggtcccttacccgtacggaccgtaccgtaaccggttccgttaccgacccggtacccttaaccgtaacccggttacggtaacccggtaaaccccgtacccccgggtaaccccaaccccgggttaccgaaccccggttaaccgaccgggtaacccgggtaaacgggggtaacccggaacccggggggttaaccgggtaacgggtaacccgggtaccggttaaacccggttaaacggtttacggttaaacccgggttacggtttaacccgggtaagggggtttaagggttaacgggttaaacgttaaacggggttaacggttaccggggtaccgggttttaacccggtaagggtttttaccggggttaacccggtttttacgggggtttaccggggtaaacccgggggaaccggggttaaacccgttaacccgggggtaccgttaacccccggggtttaacccgggttacccgggttaaccgggtaacccgtaaccccggggtaacccgttacccgggtacccccgtttaccccgggtcccccggtttaaacccggttacccctttcccgggttaccccgttacccccgtaaccccctaccccgtccgggttaacccccggaagttacccggtacccggtacggggtacccggtccgggtcgggtaaccggg

SEQ ID NO: 253 - DNA, 947 bp, Homo sapiens
  misc_feature: GYAE6OF01CX059.19.26.C04.1.454.CMB.1.raw
  modified_base (215)..(215): a, c, t, g, unknown or other
  misc_feature (215)..(215): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgcagtcggcccaggagagacggccaggacttccgnggtaggggagtacctaactttgaataagtaaaagtgtgacacgtacggtaccgagacgaacggacggccgacggaccctaaccgggacccttagtaccgtggtactaattcttaatttaacttaacgtaccccggtccggtccctacggacgggtactcccgtacggacggacctaccgttacctccgtacgggtaccccttaccgtaaaaccgttcggtaaccggggaaaacccgtacccggacccccgtaaccccgttaccggaaccccgttaccgaacgggaccccggtaacgggggttaacgggaaccgggacccggggggtaaagttaccgggaacgggtaaccccggttaacgtttaaacgtttaccgggttacggtaaccggtaaacggggtttgggttacgggggttaattaaaggggttagtaaccgggtaccggttaacgtaggtttacggggttacggtttaaccggtttttccgggggaacccggggtacggggtaaacccggtacggttaacccggttacggaccccggtttaaccggtaaaccggggttacccgaaaccggtacccccgggtaaaccgggtccccgttacccccgggttacccccccggttacccggggtaccctttaaccccccgtttacccggtttcccccggggtttacccccccccgttaccccgttacccccgttaccccgggaaacccgggtaaaacccggg

SEQ ID NO: 254 - DNA, 689 bp, Homo sapiens
  misc_feature: GYAE6OF01EOGXK.19.26.C04.1.454.CMB.1.raw
  modified_base (225)..(225): a, c, t, g, unknown or other
  misc_feature (225)..(225): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagcccaccctcagtgtcagtggccccaggagagacggccaggattccctgtggggganacaactttgatagtaaaagtgtgcactggtacctagccaggacggtccagggccaggcccctatactggtacaattctaattactaacgttacccggtcccggcccttcgacgggtactccccgtgaacggccgacttctctcggcctaccgtaactcgtacgggaacctacggccctaacccgtgacccgtcaacgcgaagggtcgaaggtccggggatggacggtaccgacgttacttaacgtggttacgagggttacgtaggggtaacttaggtaacgggtaggtcggttcgtagttcggtagtaacgttttcgggacgggtacgggaccgtaagtcgtaccggtccgttacgtacggtacgtaccggacccgtaacggtcctcccggaccccgttcggtacctaccgttacccgttaccgttacccccggtcccgttaccccgtccgtaccggtaaccgg

SEQ ID NO: 255 - DNA, 747 bp, Homo sapiens
  misc_feature: GYAE6OF01DLAK7.19.26.C04.1.454.CMB.1.raw
  modified_base (188)..(188): a, c, t, g, unknown or other
  misc_feature (188)..(188): n is a, c, g, or t
  modified_base (691)..(691): a, c, t, g, unknown or other
  misc_feature (691)..(691): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagtcttgggtttttccctcgttgccttcttttaagaggttntccagtgtcaggtgcacgtggtggagtcgtggggggagcgtggtccagcccgttggggacgtccctgacgtcctctccgttgcgcagccttcgtggtactttccacctttcaagttgtctttggactatcccgagtcggggtcccacaggcctaccgaggccgaaggggctaaggaggttggggtacgactaaggtttactaagttacaagttagtacggtaaggttaggtaaaaggtttaaaaacttattaagttttaaggacgggtaaaccggtaccggttacccgggtaaggggaaaccgggttcccgtaacgtttacccgaaccctacgttacccgtaaccgaacgaacgtaaacctaaaccttacccgaaaacgtaaccaccgtaaggttacgtaacttacgttacaaaccgtaaagtccgtaaacgaccgtacgtaacggaagtccggtacgggtacgggaaccgtacccggtagttagttacgttaagtttacggnggttacggacgagggtcgcggtacgtacgaacctaacgtaccgtacgttaacccgg

SEQ ID NO: 256 - DNA, 815 bp, Homo sapiens
  misc_feature: GYAE6OF01EN7BI.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagacgacggccaggtacttcccgtggtgggggagactaactttgattaagtaaagtgtgacacgtggtaccagacagacggccaggccacggtacccctagttacgtggtcattcgtaattataactaccgtccgacccctgaacgggtctcctggacgcgtactctcgtggtacctaccgtaacgtcgtagggaaccaccggtacccacccgtcgacccgtcgtacggcgtaggggtcgaacggggcccgggggtatacggaaccggtacccgtaacttaacgtttacgtacggttaccggtagggttgggtacgggttaacgttaaggttaacgggttaacggtacgggttaaccgttaggtttacggttacggtttaccgggtttttacgggacgggtaacggggtaaccctaaggtacggtaccggtacccggttacccgtacggggttacaacccggtacccgtaacgggtacccgtcccggttcccccgtacggttacccgttacccgtttacccggttccccgtttaccccccgtacccccgttcccccgtacccggtaaacccgtaaccggtaacccggttacgtaccgggtacgggtacccgggttcggtaaccgggg

SEQ ID NO: 257 - DNA, 762 bp, Homo sapiens
  misc_feature: GYAE6OF01ETO9G.19.26.C04.1.454.CMB.1.raw
  modified_base (226)..(226): a, c, t, g, unknown or other
  misc_feature (226)..(226): n is a, c, g, or t
tcagtactctcgtgcacgaccggtgctcgatttagtctagcgactttgggtttgggggggtgagggttgagaacctatgaacattctgtaggtgccaccgttctcctcctcggcctcctctctcactgcacaggctctgtgacctcccatgtggtgactcagcccaccctcagtgtcaggtcggccccaggagagacggccagggtacttcccgtggtgggggganactaactttggaattagtaaaagtgtgctacgtggtaccagcaggacggccacggccgaccggtaccctatacgtgtactatacttaattaataaccgtacccggtcccgacctggacggctccgagacgtccgtacctcgtacgtcgccgtacctacgtcgtaccggaaccgccggaaccctccgtacgtacccgtacgacgtacggacggggacggacggggacgggtagtacggacggtaccgtaacgttacgttacgtcggtacggagggttggacggggttaagtaagggtacggtaacgggtcgtaccgtaggttaggttacgttacgggtttacgggacgggtaccgggtaccgacgtccgtacggtacccggttcgtaacggtcgacccggtaccacgggtcccctcccggtacccggttccgtaccgtacccgtttcccggtcccggtacccccccgtcccttacccggtacccgtaacggtaccgttaccgggttaccgtacgggtccggggtacccgggtaccgg

SEQ ID NO: 258 - DNA, 735 bp, Homo sapiens
  misc_feature: GYAE6OF01BMIDM.19.26.C04.1.454.CMB.1.raw
  modified_base (273)..(273): a, c, t, g, unknown or other
  misc_feature (273)..(273): n is a, c, g, or t
tcagtactctcgtgcacgaccggtgctcgatttagtctagcgactttgggtttggggggtgagggtttagaacctatgaacattctgtaggggccaccgttctcctcctcggcctcctctctcactgcacaggctctgtgacctcccatgtggtgactcagccaccctcagtgtcagtggccccaggagagacggccaggattccctagtggggagacaactttgataagtaaaagtgtgcactggtaccagcagaggccagccaggccctanactggtcatctattataataccgtccggacctcgaggatccctgagtcgactctacgtggacctccgaaactcgtagggtaaacaccggaccctaaccctacggtaccgtacgagtacccgagggttacggaaacgcccggggaagtacgggaacggacccgtaactaaccgttaacgtcgtaccgagggttgtaggggaacgtaaggttacgtaaggtacggttaacctagttacgttagggttaacgttttaccggggacgggtaaccggggtaaccgtaaacggttccgtaacggtacccggtttaaccgtaaacgttacccgtaacgtaaccgtaacggtaccgtacccggcccccttaccgggttactacccgtacgttcccgttaccccgtaacccttcccggtaacccaccgtaacggacgttactacggtaacggcggtcccggtggtaaacgg

SEQ ID NO: 259 - DNA, 957 bp, Homo sapiens
  misc_feature: GYAE6OF01AZCJY.19.26.C04.1.454.CMB.1.raw
tcagtactctcgtgcacgaccggtgctcgatttagtctagcgactttgggtttggggggtgagggttgagaacctatgaacattctggtaggggccaccgttctcctcctcggcctcctctctcactgcacgaggctctgtcgaccctcccatggtggtgactcacgccctaccctcagtgtcgagtcggccccgaaggaggacgaccggccgtagggtacctttcccgttggggtacgggggaacgtaaccgttaacgttttagtaagttaaaaggttaaaaggttgtggactaacggttacggtaccgacgtacgaacgggacggacccggaacggccggaacccggtaccctaacgttacgttcggtactacttacttaactttaacgttaaccgtaccccggtccccggtacccgtaccgggacgggtaacccttcccggtcggaccggtaccgtccgttaccgtccggtaccgtcccgttaaccctaaccggttaccggtaacccggggaacccggtacccggtaccccgtaaccccggtaccggtacccgtacgaaccgggaccgggtaaccgggggtaaccgggaaccgggtaccggggggtaaacggtacgggttaaccgggttacccggttaaacgttacggtttaacccggtgggttaacggggtacggggttgggttacgggttaagggttaacgggttaggttacgggtcgggttacgtagggtttcgggtttaaggtttaccgggttgggggaaccggtacgggtaacgtaacgtccgtaccggtacggttacgggtaccgtacggaccgtaacccggtcggtacccgtcccggtcccggttacgttcccgtaccgtttcccgttccccggttaccccctccctacccggtacccgagggtaccggtagtccgggtaacggcgggtaaccgggtggtacccggg

SEQ ID NO: 260 - DNA, 841 bp, Homo sapiens
  misc_feature: GYAE6OF01D4MRH.19.26.C04.1.454.CMB.1.raw
  modified_base (223)..(223): a, c, t, g, unknown or other
  misc_feature (223)..(223): n is a, c, g, or t
  modified_base (248)..(248): a, c, t, g, unknown or other
  misc_feature (248)..(248): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcacgcccaccctcagtgtcagtcggacccaggagcgacggcaggtacttccgtgggtagggganacctacttagattaagtaaagtgtnactacgtacggtaccagcgacgacggaccgacggaccgaccggtccctacttacggtcggtactacgttacttaactttaactaaccggttacccggccccggtaccccttacggacgggttacctacccgtaggacgaccggttacctcgttcgtccggtacctacccgtaacgttccggaacgggacctacccggacctacccgtacggtaaccgtgaaccggacgggtaacgggtacgggaaccgggtcggggtagtaccggtaccgggtaaccgtacgtttacgttacggtcggtacggtacggggtagggttacgggtaaggtacggttacggcggttccgtacggttagttcgttacggtttaggtttccggggacgggtaaccgggtaacgtcggttaccgtaccggtaccggtttaaccggaccggttcgaacccggtacccgggtaccgttccccggtccccgtacccggttccggtacccgttaccgtttaccccggttacccttcccccctaccgttaacccggacccggtaacgtacggtaccgttacgggaccggttacgggccggtcggttaaccgggg

SEQ ID NO: 261 - DNA, 952 bp, Homo sapiens
  misc_feature: GYAE6OF01DAN62.19.26.C04.1.454.CMB.1.raw
  modified_base (222)..(222): a, c, t, g, unknown or other
  misc_feature (222)..(222): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgaccctccatgtggtgactcacgcccaccctcagtgtcagtcggcccaggagagacgcgaggtacttcccgtgggtgggganactaacgtttgaataagtaaagtgtcgactacgtacggtaccagacgaggacggaccgacggccgaaccggtcccctaagtaccgtggtactactttacttaatttaactaaccgttacccggtccccggtacccctacggaacgggtaccttcccgtacggacgacccgtacctccgttaccgtcggtacccttaccgtaaacgttccggaaccgggtaaaccgacccggtacccctaacccgtaccgggtaacccggttaccgaacgggtaccgggtaaacgggggtaacccgggaacgggggacccggggggtagttaccggggtaaccgggtacccgtttaacgtttaacggtttacggttcgggttaacgggtaggggttagggttacgggtaagttaaggttaacgggtacggttaccgggtagttaacgttcgggttaacggtttccggggtttaccggggaaccggggtaacggtaacccgttagggtcccggttaaccgggtaccggtttaacccggtacgggttacccggacccgttaacccgggtaaccggttcccgttacccccgggtaccccccgttacgggtaccccgttacccttttccccggtaacccccgtttacccccacccccggtttaccccgtaaccgggttaacggtaaccgggttaaacccggttcggaaacccgggggtccgggacccggggttccggtaacgggg

SEQ ID NO: 262 - DNA, 802 bp, Homo sapiens
  misc_feature: GYAE6OF01B7U70.19.26.C04.1.454.CMB.1.raw
tcagtactctcgtgcacgaccggtgctcgatttagtctagcgactttgggtttgggctgagctgggttttcctcgttgctcttttaagaggtgtccagtgtcaggtgcaccgtggtggagtcgtgggggagcgtggtccagccgtgggaggtccctgagactctcctggtgcacgtcctctggtacttccaccttcagttagtctttggcactccacgtcgggtcccgccgaggcctacgagggacgaaggggctaaggacggtggggtgactagttatatcatagtgtaagtagggtaaagtaaaacttagtaattagtacggaagtaccgttaccggtaggaacgggcctattccacctatcctcgaagacgaactaactacaaacgaactagagtagactcagaactaaagtacgaacgacgtacgtaggaacggtcggtacggtaacggggacgtaaccggtcgttaggttaacgtttaacgttacgtacgggtacggacggaacggggacggtaccgggtacggtaccgtaaaccgtaaccgttaacgtaaccgttaacggtttaacggttttaaccggggttacggtaacccggttcggggtaaccgggaacccggtaaacggggaccccgtaggttacccgtaaccttcccgggtacccctacccggacccgtacccctaacccggaaacccggtaacccggtacccttacccgggtttcccggttacccccgttcccggcggtacccctccccggtacgcccgttaacccggacggtaccgccccgtaacccgg

SEQ ID NO: 263 - DNA, 673 bp, Homo sapiens
  misc_feature: GYAE6OF01EEXVW.19.26.C04.1.454.CMB.1.raw
  modified_base (190)..(190): a, c, t, g, unknown or other
  misc_feature (190)..(190): n is a, c, g, or t
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (238)..(238): a, c, t, g, unknown or other
  misc_feature (238)..(238): n is a, c, g, or t
  modified_base (467)..(467): a, c, t, g, unknown or other
  misc_feature (467)..(467): n is a, c, g, or t
tcagtactctcgtgcacgaccggtgctcgatttagtctagcgactttggggtttggggggtgagggttgagaacctatgaacattctgtaggggccaccgttctcctcctcggcctcctctctcactgcacaggctctgtgaccctcccatgtggtgactcacgcccacctcagtgtcagtggcccaggngagacgcagnttccgtggtgggganactacgttgatagtaaagtgtgnacgtgtacagacgaggacggaccacggccgacggtcccctaataccgtagtactatacttaattaagtaacctaccggtccgccccgtcgtaacgggactcccgtacgacgaccggtactactcgtcgacctcctacgtacgtacggaccgtacggaccgacccgtacgtaccgtcacgcggacggtacggacggcgggtacgcggacggccgtattacgttactcggngtacggtgttagggactaggttaaggtggtacgtgagtgtacggttagtttcgggacgggaacggaccgtaggcttcggaaccgttcggaacgtcgacgcccgtagacgtcccggccctcggtacctcccttccggggttccttccccggtccctcctaccggaccgtacggtacccgtacgtagggtacgcccgggtgaccgggg

SEQ ID NO: 264 - DNA, 904 bp, Homo sapiens
  misc_feature: GYAE6OF01BOJ5U.19.26.C04.1.454.CMB.1.raw
tcagtactctcgtgcacgaccggtgctcgatttagtctagcgactttgggtttggggggtgagggttgagaacctatgaacattctgtagggccaccgtctcctcctcggcctcctctctcactgcacaggctctgtcgaccctcccatggtggtcgactcgacgcccacctcagtgtcagtcggccccaaggagacggacggccgaggtcttcccgtgggtgggggacacgtaacgttttgaagttaaagttaaaacgtgttgaccgtaacgttacggtaccagtacgaggacggaccgacggccgacgccccttagttaccgtggtacctatccttaagttaactaaggttacccgtccgggaccccaggtaccgggtaacctcccggttagaaccggtccgtaacgttccgttacggtaccggtcctaaccccggtaaacttccgggtaaccggggaacccgtacccggacccccgtaaaacccggtccggtaacccgtaccggaaccggaaccgggtagggggtaaaccgaaccgggggacccgggggtagttaacggggaccggttacccggtaactttaccgtttacggtacgttaccggtagggttggggtagggtaaggttaggtacggtaaggtcggtataggttaggtacggtttacgttcgggtaccgggaggtaacccgtaagtacggtacgtacccggttaccggttaccgggtactacccgggaaccgttaccggtaccctcccggtaccccggttcgttacccgtaaacccgttcccgttaacccgttacccccccgtacccccgtccccggttaaccccggtaaccggtaaacccgttaaccggttaccggtaacgggtccgggttaccccggggtggtaaccccggg

SEQ ID NO: 265 - DNA, 763 bp, Homo sapiens
  misc_feature: GYAE6OF01DHR5R.19.26.C04.1.454.CMB.1.raw
tcagtactctcgtgcacgaccggtgctcgatttagtctagcgactttggggtttgggggggtgagggttgagaacctatgaacattctggtaggggccaccgttctcctcctcggcctcctctctcactgcacaggctctgtgaccctcccatgtggtgactcacgcccaccctcagtcgtcaggtcggccccagggagacgacggccgaggtacttcccgtgggtagggggaacaccgtaacgtttgaattaagtaaaacggtgtagactacgtaggtaccagacgaggacggaccgacgggaccgaaccggtccccttaagtacgtcggtacctattacttaattaactaacgttaccccggtcccggccccttacggaacggggtaccttccggtacggacgtccggtaccttccgtcgtccggaccttaccgaacgtcggtacgggaaccgtaccggacccctaccgtacgacccggtacgacggacggacggggtaccgaacgggacccgggggatacgggaccggtacccgtacgttaacgttaccgtcggtacggtagggttaggtagggtaacgttaggtacgtaggtacgtctacgtggtgtacgttcgggacgggtacggacgtagtcgtacgtacccgttacgtagaccgacgacccgacgtcccgtccggtccccgttcggtccaccgttccgtcccgtccccgtccctccccgacgcgagtaccgtacggcggacggtccggtcgacggg

SEQ ID NO: 266 - DNA, 954 bp, Homo sapiens
  misc_feature: GYAE6OF01D5XU9.19.26.C04.1.454.CMB.1.raw
  modified_base (158)..(158): a, c, t, g, unknown or other
  misc_feature (158)..(158): n is a, c, g, or t
tcagtactctcgtgcacgaccggtgctcgatttagtctagcgactttgggtttggggggtgagggttgagaacctatgaacattcgtgtaggggccaccgttctcctcctcggcctctctctcactgcacaggctctgtcgacctccatggtcggtanactcacgcctacccgtcagtgtacgaggtcggaccccagggtagaggaaccggcaacgggtacttcccgtaggggtagggggaacgtaaccgttaactttttggaaagttaaaggtaaaaggttcggtagacctaacgtacggtaacccaggaccgaggacggtaccgacggaccgaccggtaccccttagtaccgtgggtacctattaccgttaatttaacgtaaccgtaacccggtcccggtaccgtcggaacgggtccttacccgtaggaaccgccgtacgttcgtacgtccgactacccgtaacgtcgtaaccgggaacaccggtacccaccgtcggtaccgtacggcgacggtacggggtacgggaacgggtacccggggtagtacgggaacggtaccctaacggtttaaccgttagtacggtaacggttgggtagggttacggtaacggttagttaacgggtaacgtcgggtaattacgttcgggttacgtttacggggttccggacgggtacgggaacccgtacgggtacccggttaacggtaccccggttaaccggtcgggttaaccccggtaacggtaccccccggggttaaaggtcccccgggtttaccccggtaccccccgttaacccgggttccttaaaccccgggttccccgttttacccgggttacccccccgtaccccggtttaaccccgggtaaacccgtacccggggttaaacccgggttacccggttacccggttaccgggggaaccgggttaccccggggttgggtaaacccggggg

SEQ ID NO: 267 - DNA, 645 bp, Homo sapiens
  misc_feature: GYAE6OF02IL7MN.19.26.C04.1.454.CMB.1.raw
  modified_base (208)..(208): a, c, t, g, unknown or other
  misc_feature (208)..(208): n is a, c, g, or t
  modified_base (502)..(502): a, c, t, g, unknown or other
  misc_feature (502)..(502): n is a, c, g, or t
tcagtactctcgtgcacgaccggtgctcgatttagtctagcgactttggtttgggggtgaggttgagaacctattggaaccattcgtacgtagggccgaaccgttcctcctcctcggcctcctctcttccacctgcacaggcgtctcgtgaccttcccatggtggtagactttcagccaacctcacgtgtccacgttggcccctaggngagaccggccggaggattccctcgtcggggagactaacgtttgagtacgtaaaagtgtggcactggtaccagcagtaggccaggccaggccctaatacctgggtccagttcctagttactaataccgtccggcccttacagggtataccctcgtacgtccgaacgtcctcgtgggcttcccaacgttcctaggggtaaccacgggccgacccgttggaccgtcgacgcgaggttcgaagccgggatcgaggcccgagtattacgtcgtcaggtgtggataggtacgtagcggtntagttgtgtatttcggcgaggtaccagtctagtaccgtccgtacggtcgacgtcccgaaggacgtacgacccgttcggtccacgttacgtcgtttcccgacccgtcctccgacgacgacgttaccgtggacgtccggtctcgg

SEQ ID NO: 268 - DNA, 605 bp, Homo sapiens
  misc_feature: GYAE6OF02FPZFH.19.26.C04.1.454.CMB.1.raw
  modified_base (170)..(170): a, c, t, g, unknown or other
  misc_feature (170)..(170): n is a, c, g, or t
  modified_base (172)..(172): a, c, t, g, unknown or other
  misc_feature (172)..(172): n is a, c, g, or t
  modified_base (175)..(175): a, c, t, g, unknown or other
  misc_feature (175)..(175): n is a, c, g, or t
  modified_base (181)..(181): a, c, t, g, unknown or other
  misc_feature (181)..(181): n is a, c, g, or t
  modified_base (309)..(309): a, c, t, g, unknown or other
  misc_feature (309)..(309): n is a, c, g, or t
  modified_base (317)..(317): a, c, t, g, unknown or other
  misc_feature (317)..(317): n is a, c, g, or t
tcagtactctcgtgcacgaccggtgctcgatttagtctagcgactttgggtttgggggagaggagcccagcactagaagtcggcggtgtttccattcggtgatcagcactgaacacagaggactcaccatggagtttgggctgagcggtgttcgctaggctcttaatagncngtntcagtncactgtgagtctgggagcgtggtcagcctgggagtccctgagctctcctgtgcagcctctggattcaccttcagtgctttggcatcccatgggtccgccaggctccaggcaagggctagagtgggtgnagtatatnatatgagtggtaaggtaaataatattagtaggtagtacgtacgtacggacggaccgtactactacctactacctaccgacgaacgaactaactaaccgtaaacgaaccaacgtaacgtagtacgtactacgtaacgtaactaacgaacgaacgtaccgtacgacgacgtacggtacgggtacggacggtacgttacgttacgttacgttacgtacggtacggtacggtacggacggtaccggtacggtcggtaccgtaaccgtaaccgtacgtaccgttacgttacgg

SEQ ID NO: 269 - DNA, 576 bp, Homo sapiens
  misc_feature: GYAE6OF02IDYA1.19.26.C04.1.454.CMB.1.raw
  modified_base (213)..(213): a, c, t, g, unknown or other
  misc_feature (213)..(213): n is a, c, g, or t
  modified_base (275)..(275): a, c, t, g, unknown or other
  misc_feature (275)..(275): n is a, c, g, or t
tcagtactctcgtgcacgaccggtgctcgatttagtctagcgactttgggtttgggctgagcgtggtttcgtcgtaggctctttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagagtggggtggcagttatatcatatgatggaggtaaaatntatatggagactcgtgaagggccgattcaccatctccagagacaattccaaagaacacagtggatctgacaaatgaacagcctgagagcgtggggacacggctgtgtattactgtgcgagaggcggctgggacaactacacttccagtttaccgggtttggacgtcgtggggaccaaggggacccacggtcacgttccgtccctcccgacgccctccgaccgaacgggcccaacggttccggtcccttcccccgtggcccggtcccctcggcccgttacccgacgggtaccgccaacccgg

SEQ ID NO: 270 - DNA, 507 bp, Homo sapiens
  misc_feature: GYAE6OF02JR8XW.19.26.C04.1.454.CMB.1.raw
  modified_base (361)..(361): a, c, t, g, unknown or other
  misc_feature (361)..(361): n is a, c, g, or t
  modified_base (485)..(485): a, c, t, g, unknown or other
  misc_feature (485)..(485): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtcccgccaggctccaggcaaggggctagagtgggtgcagttatatcatatgatggagtaaatntattatggagactcgtagaaggccgattcacatctcagagacaattccaaagacacagtggatctagacaaatagaacagcctagagacgcgtggggacacggctgtagtatacgtgtgcgagngcggtctggacacgtacatacg

SEQ ID NO: 271 - DNA, 541 bp, Homo sapiens
  misc_feature: GYAE6OF02IKD5O.19.26.C04.1.454.CMB.1.raw
  modified_base (528)..(528): a, c, t, g, unknown or other
  misc_feature (528)..(528): n is a, c, g, or t
  modified_base (537)..(537): a, c, t, g, unknown or other
  misc_feature (537)..(537): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaagccggggatgaggccgactatactgtcaggtgtgggatagtagtagcggtcattgtgtatttcggcggagggaccaagcgtgaccgtctaggtcagcccaagctcgcccctcggtcactcgtcgttcccacctcctccacgacgacgtacnggacgcggntcgg

SEQ ID NO: 272 - DNA, 538 bp, Homo sapiens
  misc_feature: GYAE6OF02I5DO5.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccagggattccctgtgggggagacaactttgatagtaaaagtgtgcactggtaccagcagaggccaggccaggcccctatactggtcatctattataataccgtccggccctcagggatccctgagcgactctctggctccaactctgggacacggccacctgaccgtcagcagggtcgaagccggggatgaggccgactatactgtcaggtgtgggatagtagtagcggtcagtgtgattttcggcggagggaccaaggctgaccgtctaggtcagcccaaggctcgcccctcgtactcgtcgttcccaccctcctccacgagacgtactgagcggctggacg

SEQ ID NO: 273 - DNA, 566 bp, Homo sapiens
  misc_feature: GYAE6OF02HQAQY.19.26.C04.1.454.CMB.1.raw
  modified_base (561)..(561): a, c, t, g, unknown or other
  misc_feature (561)..(561): n is a, c, g, or t
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaaggccggggatggacggccgactattaccgtgtcgaggtgtgggtagtaggtagtagcggtcagtggtgtagttttcggcggagggaccgaggctcggaccgtccgtaggtcacgaccctaaggctcgccccgtcgtcacctcgtcgttccccgccctcctccacgacgtacgtactgacggcggngtcgg

SEQ ID NO: 274 - DNA, 549 bp, Homo sapiens
  misc_feature: GYAE6OF02GXSEX.19.26.C04.1.454.CMB.1.raw
  modified_base (431)..(431): a, c, t, g, unknown or other
  misc_feature (431)..(431): n is a, c, g, or t
tcagtactctcgtgcacgaccggtgctcgatttagtctagcgactttgggtttgggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcaagcagggtcgaaagccggggatggagcccgactattactgtcaggtgtgggatagtagtagcggtnatgtgattttcggcggaggaccgaagcgtagaccgtcctaggtcgagcccaaggcctgccccctggtccacgtctcgttacccaccctcctccgagcgacgacgtcgacggcgggtcg

SEQ ID NO: 275 - DNA, 549 bp, Homo sapiens
  misc_feature: GYAE6OF02IHLI0.19.26.C04.1.454.CMB.1.raw
  modified_base (359)..(359): a, c, t, g, unknown or other
  misc_feature (359)..(359): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcgagggactccctgacgcgactctctggctccaactctgggaacncggccaccctgaccgtcagcagggtcgaagccggggatggacggccgactattactgtcaggtgtgggattagtagtagcggtcatgtgtagttttcgggcggagggaccaagctcgaccgtccgtaggtcacgcccgaaggctcgcccctcggtccacgtccgtcgttcccgtccctcctccacgtacg

SEQ ID NO: 276 - DNA, 581 bp, Homo sapiens
  misc_feature: GYAE6OF02JASPS.19.26.C04.1.454.CMB.1.raw
  modified_base (369)..(369): a, c, t, g, unknown or other
  misc_feature (369)..(369): n is a, c, g, or t
tcagtactctcgtgcacgaccggtgctcgatttagtctagcgactttgggtttggggggtgagggttgagaacctatgaacattctgtaggggacccaccgttctcctcctcggcctcctctctcactgcacaggctctgtgacccttcccatggtggtgactcagccaccctcacgtgtccagtggccccaggagagacggccaggattcccgtgtgggggagacaactttgactaggtaaaacgtgtgcactggtaccagcagaggccaggccaggcccctatacctggtcatcctattagtaataccgtccggccctccagggatcccctgacgcgactcgtctgggctccgaactcctaggaacncggccaccctgaccgtcagtccacggtcgaacgccggggatggacggccgactatacctgtacacggtcgtagggtataggtagtacgtcggtcagtgtgtagtttcggcgtagggaccagctgaccgtcctaggcacgcctaaggctcgccctcgcactcgtcgtcccaccgtcctccaccgacgacgtaccgtgtacgcggtcgtacggg

SEQ ID NO: 277 - DNA, 561 bp, Homo sapiens
  misc_feature: GYAE6OF02IUERI.19.26.C04.1.454.CMB.1.raw
  modified_base (349)..(349): a, c, t, g, unknown or other
  misc_feature (349)..(349): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtgggggagacaactttgataagtaaaagtgtgcactggtaccagcagaggccaggccaggcccctatactggtcatctattataataccgtccggccctcagggatccctgagcgactctctggctccaactctgggaacncggccaccctgaccgtcagcagggtcgaaggccggggatggaggccgactattactgtcaggtgtgggatagtagtagcggtcagttgtgtagttttcggcgggtacgggaccaagctacggaccgtccgtaggtcacgcccaaggcctcgccccgtcgtcacgtctcgttcccaccctcctaccgaccgagacgtacgtcggacgcggtcg

SEQ ID NO: 278 - DNA, 626 bp, Homo sapiens
  misc_feature: GYAE6OF02F3YYE.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaaggccggggatgacgggccgacgtattacgtgtcgaggtgtgggataggtagtagcggtcagtggtagtagttttcgggcgggtacgggaccgaaggcgttacggacccgttccgtaacgggtcgaacgaccccgaaaggtccgtacgccccccgtccgggtccaaccgttccgttccggttcccccgccccgttcccgttcccgaccggtacggtacgttaccgtaggaccggtccgggccgtacgggg

SEQ ID NO: 279 - DNA, 548 bp, Homo sapiens
  misc_feature: GYAE6OF02G2IMC.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaagccggggatgaggccgactattactgtcaggtgtgggatagtagtagcggtcatgtgattttcggcggagggaccaagcgtgaccgtcctaggtcgagcccaaggctgccccctcggcactcgtcgttcccgccctcctcccgacgacgacgtacctggacgcgggctcggg

SEQ ID NO: 280 - DNA, 546 bp, Homo sapiens
  misc_feature: GYAE6OF02FWXLP.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaagccggggatgaggccgactattactgtcaggtgtgggatagtagtagcggtcagtgtgattttcggcggagggaccaagcgtgaccgtcgtaggtcagcccaaggctcgcccctcggtccactctcgttcccaccctccctcccacgacgacgtactcgacgcggctcgg

SEQ ID NO: 281 - DNA, 538 bp, Homo sapiens
  misc_feature: GYAE6OF02HASKN.19.26.C04.1.454.CMB.1.raw
  modified_base (400)..(400): a, c, t, g, unknown or other
  misc_feature (400)..(400): n is a, c, g, or t
  modified_base (509)..(509): a, c, t, g, unknown or other
  misc_feature (509)..(509): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaagggccgattcaccatctccagagacaattccaagaacacagtggatctgcaaatgaacagcctgagagctggggacacggctgtgtattactgtgcgagagcggntggcaactacatccatttacgggttggacgtcgtggggaccaagggaccacgatcatcgtcctcccagccctccaaccgaacgggccccaagtccggtcccttccccgnggcccgccctcgcctccgaggacgtcccg

SEQ ID NO: 282 - DNA, 568 bp, Homo sapiens
  misc_feature: GYAE6OF02GZSA0.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgacgcgactctctggctccaactctcgggaacacggccaccctgaccgtcacgcagggtcgaaggccggggatgaggccgactattactgtcgaggtgtgggataggtagtagcggtcagtgtgtagtttcgggcggtagggaccaaggctggaccgtcgtaggtcgacgcccgaaggctcgccccgtcggtcacgtccgtcgttcccgccctccgtcccacggacgtactaccgtggacgcgggctcggg

SEQ ID NO: 283 - DNA, 550 bp, Homo sapiens
  misc_feature: GYAE6OF02GPNDV.19.26.C04.1.454.CMB.1.raw
  modified_base (546)..(546): a, c, t, g, unknown or other
  misc_feature (546)..(546): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcagggtcgaagccggggatgaggccgactattactgtcaggtgtgggatagtagtagcggtcatggtgtagttttcggcgggtagggaccaagctgaccgtccgtaggtcacgcccaaggctcgccccgtcgtcactcgtcgtccctaccctcctccacgacgacgtactggacgcggntcgg

SEQ ID NO: 284 - DNA, 544 bp, Homo sapiens
  misc_feature: GYAE6OF02FJ7Z9.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcaggtcgaagccggggatgaggccgactatactgtcaggtgtgggatagtagtagcggtcagtgtgtagttttcgggcggtagggaccaagctgaccgtactaagtcacgccaggctcgcccctcgtcacgtctcgttcccgccctcctccgacgacgacgtactcggacgcggtcg

SEQ ID NO: 285 - DNA, 586 bp, Homo sapiens
  misc_feature: GYAE6OF02IO5CW.19.26.C04.1.454.CMB.1.raw
  modified_base (316)..(316): a, c, t, g, unknown or other
  misc_feature (316)..(316): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataatacgtcgccctcagggatccctgngcgactctctggctccactctggacacggcacctgaccgtcagcagggtcaagcggggatgaggccgactaatctgtcaggtgtgggatagttaggtagcggtcagttgtagattttcgggcggtaggggtaccaaggtctggtaccgtacgttaggtaccgtacggcccgaaaggcgtacgccccgttcgggtccacgttccgttcgttaccccgtaccctccctaccaccggtacgaacgttacgtcgtaccggcgggtacctccggg

SEQ ID NO: 286 - DNA, 685 bp, Homo sapiens
  misc_feature: GYAE6OF02JLDY1.19.26.C04.1.454.CMB.1.raw
  modified_base (241)..(241): a, c, t, g, unknown or other
  misc_feature (241)..(241): n is a, c, g, or t
  modified_base (304)..(304): a, c, t, g, unknown or other
  misc_feature (304)..(304): n is a, c, g, or t
  modified_base (362)..(362): a, c, t, g, unknown or other
  misc_feature (362)..(362): n is a, c, g, or t
  modified_base (430)..(430): a, c, t, g, unknown or other
  misc_feature (430)..(430): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggagcgtggtccagcctgggaggtccctgngactctcctgtgcagcctctggattcaccttcagtagctttggctagtcccagtcgggtcccnccgaggcctccgaggccaaggggcctaaggcgtggggtgcgtagttatagtcaattanagtatgggaagtaaatataattagtggaatacgtcgtaggaacgggccgtaagttccaacgtataccnccaagacgaactaaacttaccaaaacgtaaccaacgtaaggtacggaacttcgtacggaactaaaagttacgaaaacgtacgtaacccgttaggaaacggtaggacgggttaagggggaacccgtaacggggtccttaagggttacgttaacgtttaccgttagggttacggtaccggtaagggtacgggaccgggtacgttacgggaaccgtaaaccgtaaccgaccgttacccgtaaggtttttaacccgggg

SEQ ID NO: 287 - DNA, 543 bp, Homo sapiens
  misc_feature: GYAE6OF02H88BF.19.26.C04.1.454.CMB.1.raw
  modified_base (301)..(301): a, c, t, g, unknown or other
  misc_feature (301)..(301): n is a, c, g, or t
  modified_base (369)..(369): a, c, t, g, unknown or other
  misc_feature (369)..(369): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (400)..(400): a, c, t, g, unknown or other
  misc_feature (400)..(400): n is a, c, g, or t
  modified_base (413)..(413): a, c, t, g, unknown or other
  misc_feature (413)..(413): n is a, c, g, or t
  modified_base (420)..(421): a, c, t, g, unknown or other
  misc_feature (420)..(421): n is a, c, g, or t
  modified_base (423)..(423): a, c, t, g, unknown or other
  misc_feature (423)..(423): n is a, c, g, or t
  modified_base (427)..(427): a, c, t, g, unknown or other
  misc_feature (427)..(427): n is a, c, g, or t
  modified_base (455)..(455): a, c, t, g, unknown or other
  misc_feature (455)..(455): n is a, c, g, or t
tcagtactctcgtgcacgaccggtgctcgatttagtctagcgactttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccnccaggctccaggcaaggggctagaggtgggtggcagttatatcatatgagtggaagtaaatatattangganactcgngaggcgattcacatctcaganacaatcaagacanagtgatnnanaatnaacagacgtagagcgcgtgggacacggnttgtagttattaccgtggtcggtacggaggtacggcggtcgtcgggacctaaccgtaccgtaacttacccggtaagttttaaccgggg

SEQ ID NO: 288 - DNA, 640 bp, Homo sapiens
  misc_feature: GYAE6OF02JOZM1.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccgccctcgaggactccctgacgcgactctctggctccaactcgtacgggaaccaccggcccacccgtgaccttcacgccgagggtcgaacgggccggggatcggacggccgaactagttacgtgtacgaggtggtgggattaggtagtagcggtactagtggtagttacgtttcgggacgggtacgggaacctaaggccgttacggtacccggttccgtagggtaccgacggacccgtaagggtcccgtaccggtcccccgtcggttacccgtaccgttcccgttacccggttacccccgaccccgtttccccgtacccgtaccggtaaccgg

SEQ ID NO: 289 - DNA, 585 bp, Homo sapiens
  misc_feature: GYAE6OF02GPXWS.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggactccctgagcgactctctggctccaactctgggaacacggccaccctgaccgtcagcagggtcgaagccggggatggacggccgactattacgtgtcgaggtgtgggagtagtagtagcggtcagtggtgtagttttcgggcgggagggaccaaggcgtacggaccgttccgtagggtccacgcccgaaggctcgcccccgtcgtcctactccgttcgtcccctacccctcctcccgacgtacgacgtacctcggacggtccgggcgtacggg

SEQ ID NO: 290 - DNA, 530 bp, Homo sapiens
  misc_feature: GYAE6OF02F94T6.19.26.C04.1.454.CMB.1.raw
  modified_base (304)..(304): a, c, t, g, unknown or other
  misc_feature (304)..(304): n is a, c, g, or t
  modified_base (346)..(346): a, c, t, g, unknown or other
  misc_feature (346)..(346): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctgggggaggcgtggtccagcctggggaggtccctgagactctcctgtgcagcctctggattcaccttcagtagctttggcatccactgggtcccnccaggctccaggcgaaggggctaggaggtgggtggcagttanatcatatgatggaaggtaaaatatattanagganactccggtagaacgggccgattcaccatctccagacgaactaattaccaagaacacagtagatctgacaaatgaacagcctgagagcgaggggaccacggctggtgtagttactgtgacgagagcgggcgtaggaccaacgtacataccg

SEQ ID NO: 291 - DNA, 545 bp, Homo sapiens
  misc_feature: GYAE6OF02I31OU.19.26.C04.1.454.CMB.1.raw
  modified_base (445)..(445): a, c, t, g, unknown or other
  misc_feature (445)..(445): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggactccctgagcgactctctgctccaactctggaacacgccaccctgaccgtcacgcagggtcgaaggccggggatggaggccgactattactgtcgaggtgtgggatagtagtagcggtcatgtgtatttcggnggacggcaagctgaccgtctagcagccaaggctcgcccctggtccacgtccgtcgttccctaccctcctcccacgcgacgtactggacgtcgggctacgg

SEQ ID NO: 292 - DNA, 558 bp, Homo sapiens
  misc_feature: GYAE6OF02F3DE9.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgacccgtcagcagggtcgaagccggggatggacggccgactattacgtgtcgaggtgtgggagtagtagtagcggtcagtgtgtagtttcggcggaggaccaagcgtgaccgtccgtaggtcacgcccaaggcgtcgccccgtcgtcactccgtcgttcccaccctccctccgacgacgacgtacgtggacgcggctcgg

SEQ ID NO: 293 - DNA, 826 bp, Homo sapiens
  misc_feature: GYAE6OF02F1X80.19.26.C04.1.454.CMB.1.raw
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcgttgggttttcctcgttgcttacgttttaagaggtgtccagtgtcgaggtgcaccgtgggtggagtcggtgggggaggcggtggtccaggccgtggggacggtccctgacgtactctccgtgtcgcacgcctcgtggtacttcctacctttacgaacggttacgttcgttttgggacctacgttaccccgtaacggttccggggttaccccgacccggtaaggggtccccttaccccggaaggggacccgggaaaacggggggtaccgttaaggggaacggggttcggggggttacggaccggttaaaggttttaattacgtactaaagttaagtaggtaaggtaaggggtaaaagggtttaaaaattagtttaaagttaagtagggtaacgtaccgttaccgggtagggaaaccgggggtccctaacgtttacccgaaacctacttcccgtaacccgtaaggaaccgtaaacgttaaaaccttaacccgaaaagtaaaccctacgtaagggtacggtattaccgtacgaaactaaaagtacgaaacgacgtaccgtaggaacgtacgtcggtacggggaacctacgggtacgttcggtagttaacgtttcggttggtacggacggaacggagggtcgtaccggtacggtaaccaaccgttacacgtttaacccgg

SEQ ID NO: 294 - DNA, 968 bp, Homo sapiens
  misc_feature: GYAE6OF02I8AE0.19.26.C04.1.454.CMB.1.raw
tcagtactctcgtgcacgaccggtgctcgatttagtctagcgactttgggttgggggggtgagggttgagaacctatgaacattcgtgtagggccaccgttctccgtcctcgggcctcctctctctacctgccaccaggcctctggtgaccctcccgatggtcggtgactcacgccaccctcacgtgtccacgtggcccccagggacgacgacgggccagggacttcccctggtcgggggagaccaaccttttggactacgtaaaagtgtacgacactgggtaccagtcagaggtccaggtccaggcccctagtactggtacatcctagttactaactaccccgtaccggtccctacgtacggggacttaccccgtggacggtccggtaacctccgttaccgttcgggtcccttacccgaaaccgttccgttacggggaaaccaccgggtcccctaaccccgttcggtacccggttaccgaaccggtccgtaacgggggttaccggaaacgggccccggggggtaaacgttccggggaaacccgggtcccccggtaaccgtttaaccgtttaccgttacgggtttacccgtaacgggggtttacgggttacggggggtaacgtttaacggggtttaacgggttaacggggtacccggggttaccggtaacgtttacggggtttaacggttaaggtttttttacccggggaccgggggttaacggggtaaccccgtaaacgggtaccggttacgggtaaccccggttaccggtaacgggttaccgtaaccggtaccccgtaaacgggttccccgttaccgggtaccccccgtttccgggtaccggtacccgtttacccggttacccgggttttacccccgtcccccgtttccccgtacccggtaacccggaaccggtacccggttaacccggtacgggtaacccgggtccggggtaccgttacccgggg

SEQ ID NO: 295 - DNA, 567 bp, Homo sapiens
  misc_feature: GYAE6OF02FVPZA.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattcccctgtgggggagacaactttgatagtaaaagtgtgcactggtaccagcagaggccaggccaggcccctatactggtcatctattataataccgtccgccctcagggatccctgagcgactctctggctccaactctggaacacggccaccctgaccgtcagccagggtcgaagccggggatggaggccgactattactgtcaggtgtgggagtagtagtagcggtcagtgtgtagttttcgggcggtagggaccgagcgtggaccgtccgtaggtccagacccgaagggccgtacgcccccgttccggtcctaccgtccgttccgttccccacccttccctcccacgtaaccgg

SEQ ID NO: 296 - DNA, 561 bp, Homo sapiens
  misc_feature: GYAE6OF02F5TA0.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccgccctcagggatccctgagcgactctctggctccaactctggaacacggccacctgaccgtcagcagggtcgaaggccggggatgacggcgactattactgtcaggtgtggataggtagtagcggtacatgtgtagttttcgggcgggtaggggaccaggctgaccgtccgtaggtcagcccaaggctcgccccgtcgtccgactcgtccgttcccaccccttcctccgacgacgacgtaccgtgacggtcgggcgtcggg

SEQ ID NO: 297 - DNA, 553 bp, Homo sapiens
  misc_feature: GYAE6OF02GT778.19.26.C04.1.454.CMB.1.raw
  modified_base (488)..(488): a, c, t, g, unknown or other
  misc_feature (488)..(488): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcaggggtcaaggccggggatggacggccgatattactgtcgaggtgtgggatagtagtagcggtcagtgtgtagtttcggacggtaggaccaagcgtgaccgtctaggtcacgccgaggcncgcccctcggtcactctcgttcccctacccgtccctccgacgacgtacgtacgtgacggcggtcg

SEQ ID NO: 298 - DNA, 673 bp, Homo sapiens
  misc_feature: GYAE6OF02JNRYN.19.26.C04.1.454.CMB.1.raw
  modified_base (365)..(365): a, c, t, g, unknown or other
  misc_feature (365)..(365): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccagccgtgggacgtccctgagacctctcctgtagcagcctcgtggattccaccttcagtacgctttggctatccacgtcgggtcccgccgaggcctaccgagggcgaaggggtctaggaggttggggtggctaaggttanatctaatagtggagtaggtaaacggttaaaattgtaatttagagggtaacgtaccgttacggagggtaaaccgggtccgtaacgttaccgacctacgttaccgtaccgagaacgtaactaacgttacccgaaagtaaccgaacgtaggtacgatacgtagacgaaatgaaccgacgtaccgtaggaacggacgtacggtacggggaaccgtaccggtagtcggttaaggttacgttaaccggttacggtacggacggtaacggacgtacgggtacgtacgtacccggtaaactaccgtacgttaccgg

SEQ ID NO: 299 - DNA, 752 bp, Homo sapiens
  misc_feature: GYAE6OF02G6Q73.19.26.C04.1.454.CMB.1.raw
  modified_base (216)..(216): a, c, t, g, unknown or other
  misc_feature (216)..(216): n is a, c, g, or t
  modified_base (272)..(272): a, c, t, g, unknown or other
  misc_feature (272)..(272): n is a, c, g, or t
  modified_base (352)..(352): a, c, t, g, unknown or other
  misc_feature (352)..(352): n is a, c, g, or t
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtggggganacaactttgataagtaaaagtgtgcactggtaccagcagagcaggccagcccctanactgtcatctatataatccgtccggccctgagggactccctggacgccgactctcgtcgctacctaactcgtacggaacnccggccaccctcgaccgtcgacgcgaacgggtacgaacgggtccggggagtcggaacgggacccgtacgttaacgtttacgcggttacgtagggttacggtggggtaaattaggtaacggtaagggtcggtaccgtagttgggttacggttacggttttcggggacgggtaacgggtaaccgtaacgtccgtacgggtaacccgttaccgtaacgggttaccaaccgggtacccgtaaacgggcccgttccccggtccccccgttacgggttacccgtacccttaccggtttacccgtttaccccccaccccgttaccccggttaccccgtaaaccggtaaccggttaacccggttaacccttaccggggaacgggtacccgggttccgtaacccggggg

SEQ ID NO: 300 - DNA, 601 bp, Homo sapiens
  misc_feature: GYAE6OF02HOMFA.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctggaacacggccaccctgaccgtcagcagggtcgaaggccggggatggaggccgactattactgtcaggtgtggatagtagtagcggtcagtgtgtacgttttcgggacggagggaccaacggcgtaggacccgttccgtaagggttccacggaccccgaaagggccctcggtccccctggtacccacgttccgttcggttccccctaccctcccgttacccgacgtacggtacgtaccgtaggacggtcgggcctacgggg

SEQ ID NO: 301 - DNA, 613 bp, Homo sapiens
  misc_feature: GYAE6OF02IL168.19.26.C04.1.454.CMB.1.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaaggtaaaatatattatggagactccgtagagggaccgatacaccatctccacgagacaattacaacgaacaacagtaggatactcgacaaatagaacaacgcgtacgaggagcgtgggacgacggacgtgtgtattactgtgacgagagcggctggacaactatactacctagttacggtttcggtacgcgtcggggaccacgggaccgcgtacgtataccgttccacccccgtacgccttacccgacccgaaggggtacccccgacgttaccgggttccccgtttcccccgcgggtccccggtccccgttcgacccttcccgaagggtaccgaccctaacccccgg

SEQ ID NO: 302 - DNA, 584 bp, Homo sapiens
  misc_feature: GYAE6OF02GMYVI.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggcctcagggatccctgagcgactctctggctccaactctgggaaccacggccaccctgaccgtcagcgagggtcgaaggccggggatggacggcccgacgtattactgtcaggtgtgggataggtagtagcggtcagtgttgtagttttcggcggacgggaccaaggcgtcggaccgttacgtaggtcgacgacccgaaggccgtcgcccccgtgtccgtacgtccgtcgttccccgccctcccgtcccgacgacgacgttaccgtgacggtccggcgtcggg

SEQ ID NO: 303 - DNA, 586 bp, Homo sapiens
  misc_feature: GYAE6OF02HOVUC.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcaatgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggactccctggacgcgactctcgtggctccaactctgggaacacggccaccctgaccgtcacgcagggtcgaaggccggggatggacggccgactagttacgtgtacgtaggtggtgggataggtagtaggcggtacagtgtgtatttcgggcggagggaccaagcgtcgaccgtcgtaggtcacggcccaaggcctccggcccctacggtcacgttccgtcggttccccaccctcccgtaccgacgtacgacgtacgtcggacggtcgggctcggg

SEQ ID NO: 304 - DNA, 618 bp, Homo sapiens
  misc_feature: GYAE6OF02G8ZCT.19.26.C04.1.454.CMB.1.raw
  modified_base (307)..(307): a, c, t, g, unknown or other
  misc_feature (307)..(307): n is a, c, g, or t
  modified_base (351)..(351): a, c, t, g, unknown or other
  misc_feature (351)..(351): n is a, c, g, or t
  modified_base (458)..(458): a, c, t, g, unknown or other
  misc_feature (458)..(458): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctnacgggactccctgagcgactctctggcctccaactcgtggaacncggccacctcgacccgtcagccgagggtcgaacgggccggggatcggacggccgacgttaagttactcggtcgagggtggtacgggtataggtaggtacgcgggttnagtgtgtagtttcgggacggtaggaccgagtcgtcggaccggttcgtacggtcacggacccaaggtccgtcgcccccgtcggttccacgttcccgttcgttcccctaccccgttccctaccgacggtacgtacgtaccgtcggacggccgggcgtacggg

SEQ ID NO: 305 - DNA, 615 bp, Homo sapiens
  misc_feature: GYAE6OF02JI2KG.19.26.C04.1.454.CMB.1.raw
  modified_base (436)..(436): a, c, t, g, unknown or other
  misc_feature (436)..(436): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccgccctcgagggactcctgacgcgactctctcggctccaactcgtaggaaccacggccaccctgaccgtcagcgagggtcgaagccggggatcggacggccgactatacgtgtcgaggtgtggatagtagtgcggtnagtgtgtagtttcgggcggaggaccaaggcgtcggaccgtccgtaggtaccacggacccgaaggtcctccgtcccccgtcggtcctaccgtccgttcccggttccccgtccccgttccccgttaccccgaacggtacggtaccggttaccgtacgggtacggtccggggccttacgggg

SEQ ID NO: 306 - DNA, 622 bp, Homo sapiens
  misc_feature: GYAE6OF02GU22L.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctggtgggggagactaactttgatagtaaaagtgtgcactggtaccagcagaggccaggccaggcccctatactggtcatctattataataccgtccgcctacagggactccctgagcactctcgtggcctcctaactcgtagggaaccacggcccaccgtaggacccgtcaggccgtaggggtccgaacgggccggggatggacggaccgacgttagtactgtacgtaggtgtgggtattaggtaggtagtcggtctagtcgtagtacggtttcggacgggtacggtaccgtaagtcgtacggaccgttacgtacggtaccgtacgacccgtaacggtccgtcccggtcccccgtacggtcctaccgttccgtccgttccccgtccctcccgtacccgacgtaaccgg

SEQ ID NO: 307 - DNA, 654 bp, Homo sapiens
  misc_feature: GYAE6OF02JCT8U.19.26.C04.1.454.CMB.1.raw
  modified_base (382)..(382): a, c, t, g, unknown or other
  misc_feature (382)..(382): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtcggccccaggagagacggccaggacttcccgtggtgggggagacaactttgatagtaaaagtgtgcactggtaccagcagaggccaggccaggcccctatactggtcatctattataactaccgtccggccctcagggactccctgacgcgactctctggctccaactctgggaacacggccacccgtgacccgtnacgcgacgggtcgaacggccgggggatcggacggcccggactacgttaccgtcgtcgacgggttggtgggattaggtaggtaggtcggtctagtgttggtagttttaccgggcgggtaagggtaccgaacggtccgtcggtacccggttccgttaacgggtccacggtacccgaacgggtccgtacccggtccccccgttaccgggtaccctacccgttcccgttccggtttacccccctaccccgtttccccttacccgaccggtaaccgg

SEQ ID NO: 308 - DNA, 542 bp, Homo sapiens
  misc_feature: GYAE6OF02F3QXS.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctggaacacggccaccctgaccgtcagcagggtcgaagccggggatggaggccgactagttactgtcaggtgtggatagtagtagcggtcatgtgattttcggcggtaggaccaagctgaccgtcctaggtcacgccgaagctcgcccctcgtcactcgtcgttcccgccctcctccacgacgacgtactgacgtcggctcgg

SEQ ID NO: 309 - DNA, 650 bp, Homo sapiens
  misc_feature: GYAE6OF02I2UHX.19.26.C04.1.454.CMB.1.raw
  modified_base (309)..(309): a, c, t, g, unknown or other
  misc_feature (309)..(309): n is a, c, g, or t
  modified_base (342)..(342): a, c, t, g, unknown or other
  misc_feature (342)..(342): n is a, c, g, or t
  modified_base (351)..(351): a, c, t, g, unknown or other
  misc_feature (351)..(351): n is a, c, g, or t
  modified_base (358)..(358): a, c, t, g, unknown or other
  misc_feature (358)..(358): n is a, c, g, or t
tcagtactctcgtgcacgaccggtgctcgatttagtctagcgactttgggtttgggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcactggtggagtcgtgggggaggcgtggtccagccgtgggaggtccctgagacctctcctgtgcagcctcgtggattcaccttcagtagtctttggcatccactcgggtcccncgaggctccgaggccaaggggctaggagtgggnggcagttanatcatangaatggaaggtaaattatattagtaggagtaccgtcggtaggaaacgggtccgtattacccgacctaacttccgtaccaaggtacgaacctaaacgttaacccgaaacgtaaaccaacgtagggtagaacttacgtacggaactaaaatcggaaacagaccgttaggaacgaacgggtcggtaacggggaacctcggggacttgggttagttaacgtttaccgtaggttcggacggaaggtacgggtacgggtaccggttaggaccctaaacgttaccgtaccttaacccgg

SEQ ID NO: 310 - DNA, 553 bp, Homo sapiens
  misc_feature: GYAE6OF02GI8IO.19.26.C04.1.454.CMB.1.raw
  modified_base (517)..(517): a, c, t, g, unknown or other
  misc_feature (517)..(517): n is a, c, g, or t
  modified_base (548)..(548): a, c, t, g, unknown or other
  misc_feature (548)..(548): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggcccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactctgggaacacggccaccctgaccgtcagcgagggtcgaaggccggggatcgaggccgactatactgtacgaggtgtgggagtagtagtagcggtcagtgttgattttcggcggtagggaccaagcgtgaccgtccgtaggtcagccgaagctcgccctcggtcactcgtcgttcccncctcctccacgacgtacgtactcgaggcggngtcgg

SEQ ID NO: 311 - DNA, 539 bp, Homo sapiens
  misc_feature: GYAE6OF02FHG9J.19.26.C04.1.454.CMB.1.raw
  modified_base (389)..(389): a, c, t, g, unknown or other
  misc_feature (389)..(389): n is a, c, g, or t
  modified_base (452)..(452): a, c, t, g, unknown or other
  misc_feature (452)..(452): n is a, c, g, or t
  modified_base (468)..(468): a, c, t, g, unknown or other
  misc_feature (468)..(468): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctggggggaggcgtggtccagcctgggaggtcccctgagactctcctgtgcagcctctggattcaccttcagtagctttggcatccacgtgggtcccgccaggcctccgaggcgaagggggtctaggaggtggggtggctagttatagtcatatgatggaaggtaaaatatattagtgganacgtcgtagaagggcctattcaccatctcagagacataccaagaacacagtgatctgacaaangaacagctagagacgngtacgggacgacggcgtgtgtacttacgtgtggcggaggaggcggtcgtacggacctaacgtacactaccg

SEQ ID NO: 312 - DNA, 623 bp, Homo sapiens
  misc_feature: GYAE6OF02GF2D6.19.26.C04.1.454.CMB.1.raw
  modified_base (353)..(353): a, c, t, g, unknown or other
  misc_feature (353)..(353): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtggggagacaactttgatagtaaagtgtgcactggtaccagcagaggccaggccaggcccctatactggtcatctattataataccgtccggccctcgagggactccctggacgcgactctctggcctccaactcgtcgggaacnccggcccaccctcgacccgtcacgcgagggtacggaacggccggggatggacggcccgaacttatacgtgtctagggtggtgggataggtagtagcggtctagttgtgtacgttttcgggcgggtacgggaccgtaggcgtacggtaccgtccgttacggtccgacgacccgtacggtccgtaccgtccccgtcggtccgtacctccgttccttaccccgtccccttaccctaccgacgtacgtacgttaccgtcggtacggcggtccgg

SEQ ID NO: 313 - DNA, 605 bp, Homo sapiens
  misc_feature: GYAE6OF02G5NFG.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggactccctgacgcgactctctggctccaactcgtagggaaccacggcccaccctgaccgtcacgcgagggtcgaaggccggggaagtggacggccgactagttacgtgtacgagggtgtgggataggtaggtagcggtacatggtgtagtttcggcggacgggaccaggctcggaccgtcgtagtcgacgccgaaggtctccgtccccgtcggtaccaccgttccgttccgttacccctccctacccgtcctaaccggtacgtacggtaccgtacggacggtccggacgtacggg

SEQ ID NO: 314 - DNA, 749 bp, Homo sapiens
  misc_feature: GYAE6OF02I9840.19.26.C04.1.454.CMB.1.raw
  modified_base (264)..(264): a, c, t, g, unknown or other
  misc_feature (264)..(264): n is a, c, g, or t
  modified_base (268)..(268): a, c, t, g, unknown or other
  misc_feature (268)..(268): n is a, c, g, or t
  modified_base (272)..(272): a, c, t, g, unknown or other
  misc_feature (272)..(272): n is a, c, g, or t
  modified_base (276)..(276): a, c, t, g, unknown or other
  misc_feature (276)..(276): n is a, c, g, or t
  modified_base (281)..(281): a, c, t, g, unknown or other
  misc_feature (281)..(281): n is a, c, g, or t
tcagtactctcgtgcacgaccggtgctcgatttagtctagcgactttgggtttggggtcgtgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctggggaggtccctggagactctcctgtgcancctntggnttcnccttnagtagtcttggcatcccacgttcgggtcccgccgacggtccgtacccagggccgaagggggtctaggagggttggggtacggctaaggtttaatacgtactaactaggttgtaaggttagggaaaagggtttaaaaaattagtttaagtttaagtacggggtaaactacccggtttccggtaaggggtaaaacgggggcccgttacgttacctaacccggtattaccccgtacgaacgtaacgaaacccttaaacgtacccgtaaagaaacccaaacgttaacggtacgggtacttacgtacgaaccgtaaaagtacgaaaccgtacgtaccgtaggaacgacggtacgtacgggggtaaccgacggtacgttaggttacgttaacggtttaacgtacggttcggaacggtaacggtacgggtccggtacggtaaccgggtactaaacccgtaccgtaccgttaccgg

SEQ ID NO: 315 - DNA, 529 bp, Homo sapiens
  misc_feature: GYAE6OF02HD1JU.19.26.C04.1.454.CMB.1.raw
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttgagaggtgtccagtgtcaggtgcacctggtggagtctgggggagcgtggtccagcctggggagtccctgagactctcctgtgcagcctctggattcaccttcagtagctttggcatccactcgggtcccgcaggcctccgaggccaaggggctaggagtgggtggctagttatatcatatgatgggaagtaaaatattaattataggagactccggtagaacgggccgtattacactatctaccagagacaataccaagaacacgagtgatcagacaaatagaacacgctagagagacgtacggggacacggcgtagttagtagttatgtgcgagcggcggcgtggacactctacg

SEQ ID NO: 316 - DNA, 620 bp, Homo sapiens
  misc_feature: GYAE6OF02IMYLB.19.26.C04.1.454.CMB.1.raw
  modified_base (393)..(393): a, c, t, g, unknown or other
  misc_feature (393)..(393): n is a, c, g, or t
  modified_base (512)..(512): a, c, t, g, unknown or other
  misc_feature (512)..(512): n is a, c, g, or t
tcagtactctcgtgcacgaccggtgctcgatttagtctagcgactttgggtttggggggtgagggttgagaacctatgaacattctggtaggggccaccgttctcctcctcggcctcctctctcactgcacaggctctgtgacctcccatgtggtgactcacgcccaccctcagtgtcaggtcggccccaggagagaccggccaggacttccctggtgggggagactaactttgataagtaaaagtgtgcacgtggtaccagcaggacggccgacggccgacggcccctactacgtggtcatcttatataataccgtccggccctcgagggactcccgtgacgcgactctctggctccaactcgtacgggaacaccggccacctcgccgtacngcgacgggtacgaacggccggggatggacgggcccgtacttaacttacgtcgtacgagggtggtgggtagttagtaggtagcgggtcagtggtgttagtttcgggcggacgggacacgngtcgaccgtcgtacggctacgcccaaggtcctccgcccgtcgtctacgtcgtccgttcccctaccctccctcctaccgacgacgtacgtcggacgggcggcgtacggg

SEQ ID NO: 317 - DNA, 597 bp, Homo sapiens
  misc_feature: GYAE6OF02G55FE.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggctccctgagcgactcctctggcctccaactctagggaacaccggccaccctcgaccgtcacgcgacgggtcgaaggccggggatggacggccgactacgttacgtgtcgaggtgtagggatagtaggtagcggtagagtgtgtagtttcggcggaggaccgagcgtgaccgtcgtacggtcgacgtcccgaaggccgtcgccccgtcggtcctaccgtccgtccgttaccccacccgttccctacccgacgtacgtacggtaccgtcggacggtccggcgtacggg

SEQ ID NO: 318 - DNA, 663 bp, Homo sapiens
  misc_feature: GYAE6OF02HU8O8.19.26.C04.1.454.CMB.1.raw
  modified_base (217)..(217): a, c, t, g, unknown or other
  misc_feature (217)..(217): n is a, c, g, or t
  modified_base (356)..(356): a, c, t, g, unknown or other
  misc_feature (356)..(356): n is a, c, g, or t
  modified_base (402)..(402): a, c, t, g, unknown or other
  misc_feature (402)..(402): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtggggganacaactttgatagtaaaagtgtgcactggtaccagcaggaggccaggccacggcccctatacgtggtcatctattataataccgtccggcctcgagggactccctgacgcgactctcgtgcctccaactcgtggaaccnccggccacccgtcgaccgtcacgcgagggtcgaacggccggggaanggaggcccgattactacgtgtacgagggtcggtagggagttaggtagtaggtcggtactagtgttggtacgttttcgggacgggtaacgggaccgaaggtcgttacggaccgttccgtacggtcgaccgtaccgaaccgggtcctaccgtccccgtcgtaccgtaccctttccggtacccggttcccccgtcccggttacccctacccgaccggtacggtaccggttaccgtccgggtaaccggccgggtaccgtaccggg

SEQ ID NO: 319 - DNA, 750 bp, Homo sapiens
  misc_feature: GYAE6OF02HM12D.19.26.C04.1.454.CMB.1.raw
  modified_base (219)..(219): a, c, t, g, unknown or other
  misc_feature (219)..(219): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagagacggccaggacttccctggtggggganactacttagagtaagtaaagtgtcgacacgtacggtaccacgacgaggacggaccgacggaccgaccggacccctatacgtcggtactattacttaattaattaacgttacccggtccccggtcccctcggacggtactccctaggacgcgtacctcgtcgtcggtcctacctaccgtcgtaccggtaacgaccggaccctaccgtccgaccgtcgacgacgtacgggtacggacgggacggggacgtcggaccggaccgtacttacgttacgtggtaccgtaggggttggtagggtaagttaaggtaacgggtcggaccgggttactaggtggtttagttcggtttaccgggggagggtaacccggactaaccggttcgtaccggttaccccggtacggtacggtacgacccggaaccgtacggtacccgtccccggtccccgtaggtcccgttcgtccgttccccggtcccccgttcctacccgtccccgtaagcggtaaccgtccgacgggcggtccggtgtaccggg

SEQ ID NO: 320 - DNA, 773 bp, Homo sapiens
  misc_feature: GYAE6OF02J3T4C.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtcgacctccatgtggtgacctcacgccctaccctcgagtgtcaggtcggccccgaggagacggaccggccgaggtacgttcccggtggtagggggacaactaacgttttagaagttaaggtaaagtcgtacgaccgtacggttacgaccgagcgagggaccggccgacggccgaccggtacccctagtcgtacggtactacttacttaatacgtaaccgtcccgtcccgtcctacggacggtctccgtagcgtacgtacctcgtcgtacgtcctacgtacgtacggtacggaccgccgtacccaccgtcgaccgtcgacggtcggacggtacggacgggtcggacgtcggacggtacctaagttaccgtagtcggtacggtaggtgggtacgtacggttaaggtcggtacgtacggtaccgtggttacggttacgggttacggttaaccgggacggtacggtaaccgtcggtaccgttaccggttacccggttaccggtaaccgtcccgggaaccgttacccggaccgtcggtaccccggtccgtacccgtcgtaccgttcccgttcccgcccgtaccccgtacgtacccggagtaccggttggaacccgttcggccggggtacgcggtaaccgg

SEQ ID NO: 321 - DNA, 569 bp, Homo sapiens
  misc_feature: GYAE6OF02FR4WX.19.26.C04.1.454.CMB.1.raw
  modified_base (552)..(552): a, c, t, g, unknown or other
  misc_feature (552)..(552): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggactcccgtgagcgactctctggctccaactctgggaaccacggccaccctgaccgtcagcgagggtcgaaggccggggatggaggccgactattactgtcaggtgtgggatagtagtagcggtcagtggttgtagttttcgggcggagggaccaggcgtgaccgtccgtaggtcacgcccgaaggctcgcccctcggtccactcgtcgtcccctaccctccctcccacgacgacgtaccgnggacggcggtcgtcggg

SEQ ID NO: 322 - DNA, 657 bp, Homo sapiens
  misc_feature: GYAE6OF02GY0BR.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgataagtaaaagtgtgcactggtaccagcaggaggccaggccaggcccctatactggtcatctattataactaccgtccggccctcgaggactccctgacgcactctctggctccaactcgtacgggaaccacggccctacccgtgtacccgtcacggcgtacgggtacgaacgggccggggatacgggacgggcccgaacttacttaccgtcggtcgagggtggtagggtagttaggtagtaggtccggtcgtagttggttgttacggttttcgggacgggtacgggaccgaacggcgtacggtacccggttccgtaaggtccgacgacccgaacggtccgtccgtcccccgttcggtacctaccgtcgttcccgttcccccgtcccctccctacccgacgacgtacgtccgtgcgggtccggtcgtacgg

SEQ ID NO: 323 - DNA, 554 bp, Homo sapiens
  misc_feature: GYAE6OF02INJ8P.19.26.C04.1.454.CMB.1.raw
  modified_base (314)..(314): a, c, t, g, unknown or other
  misc_feature (314)..(314): n is a, c, g, or t
  modified_base (440)..(440): a, c, t, g, unknown or other
  misc_feature (440)..(440): n is a, c, g, or t
  modified_base (455)..(455): a, c, t, g, unknown or other
  misc_feature (455)..(455): n is a, c, g, or t
  modified_base (549)..(549): a, c, t, g, unknown or other
  misc_feature (549)..(549): n is a, c, g, or t
tcagtactctcgtgcacgaccggtgctcgatttagtctagcgactttgggtttgggggggtgagggttgagaaccgggggtatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctaattataactaccgtccgccctnaggggactcccgtgacgcgactctctggctaccaactcgtaggaacacggccacctgaccgtcagcagggtcgaaggccgggatgacggccgaactattactgtcaggtgtggatagtagtgcgtnagtgtgtagttcggnggaggacagctgaccgtcgtagcagccgaagctcgccctcggtacactcgtcgtcccgccctcccgtccacgacgtacgtacgcggacggcggntacgg

SEQ ID NO: 324 - DNA, 580 bp, Homo sapiens
  misc_feature: GYAE6OF02GINOF.19.26.C04.1.454.CMB.1.raw
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtaggaaggccgattcgaccatctccagagacaattccaagaacacagtggatctgacaaatgaacagcctgagagcgtggggacacggctgtgtattacgtgtgacgagaggcggcgtgacaacgtacactacctagtttacggttgacgtcgtcggggaccaacgggaccgtacggtcacgttccgcctccccagccctcccaccgacggccctaacgtcccggttacccttcccccggtggacccgtccccgtacggtccctacccgacggaccgccgtaaccccgg

SEQ ID NO: 325 - DNA, 872 bp, Homo sapiens
  misc_feature: GYAE6OF02IS6S1.19.26.C04.1.454.CMB.1.raw
tcagtactctcgtgcacgaccggtgctcgatttagtctagcgactttgggtttgggggggtgagggttgagaacctatgaacattctgtaggggccaccgttctcctccctcggcctcctcctctcactgcacaggctctgtgacctcccatgtggtgactcagccaccctcagtgtcagtcggccccaggacgagacggccaggattccctggtgggggagacaactttgataggtaaaacgtgtgcacgtggtaccagcagaggccaggccaggcccctatactggtcatctattataataccgtccggccctcacgggatccctaggacgtcggaactcgtactgggctccgtaactcgtacgggaacaccgggcctaacccgtcggaacccgtacgtacgtccgaacgggtaccgaaacgggacccggggggtaacgtacggaacggggtacccgtaacgtttaacgtttaaccgttcggtaccggtaacgggttacgggttacggggtaacgttaacgggttaacgtaacgggtaacgggtttacccgaagtttcgggtttaacggtaacggtttttttacccggggacgggttaaaccgggggtaacccgtaaaacgggtaccgtttacgggtaaccccgggttacccgtttaacgggggtacccgtaaccgggtaccccggtaaaacgggtcccggtttaccgggtaccccccgttaccgggttaccgtaacccgttaccggttcccgggtttacccccggtccccggtttaaccccggttccccggaaacccggttaaccggttaaccgggtttaacccgtaccggggtaacccgggtacccggggtaccccgttaacccgggg

SEQ ID NO: 326 - DNA, 713 bp, Homo sapiens
  misc_feature: GYAE6OF02FGJ0R.19.26.C04.1.454.CMB.1.raw
  modified_base (207)..(207): a, c, t, g, unknown or other
  misc_feature (207)..(207): n is a, c, g, or t
  modified_base (324)..(324): a, c, t, g, unknown or other
  misc_feature (324)..(324): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattcccngtgggggagacaactttgatagtaaaagtgtgcactggtaccagcaggacggccagggcccaggcccctatactggtcatctattataataccgtccggccctgagggacttcccgngacgcgacctctcgtcggcctaccaacctcgtacggggaacctaccgggacccacccgtcggaacccgttcgacggtcgaacgggtacgaacgggccggggattcgggacggacccgtacgtactaccgttggtctagggttggtacgggtattaggtacggttaaggcggtacgagtaggttgtacgttttcggggccgggtaacgggaccgaacgtcgttacggacccgttaccgtacggttaccgaccggtacccgtaacggccgtccgtacccccgttcggttacctacgtttcccggtaccgttacccccgtaccccgttacccgtccccgaacggtaccggtaacggttaccgtacgggaccggtcgggtaccggtaccgggg

SEQ ID NO: 327 - DNA, 684 bp, Homo sapiens
  misc_feature: GYAE6OF02G753D.19.26.C04.1.454.CMB.1.raw
  modified_base (332)..(332): a, c, t, g, unknown or other
  misc_feature (332)..(332): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtcggccccaggagagacggccaggtattcccgtggtgggggagacaactttgatagtaaaagtgtgcacgtcgtaccagcagaggccaggccacggcccctatacgtggtcatctagttataactaccggtcccgccctcgacgggntccctgacgcgactctcgtggtcctacctaactcgtcgggaacaccggccctacccgtcgaccgtcacgccgacggggtacgaacggccggggtagtcggacggccgtaactattaccgtgtcgtaggtggtgggtagttaggtaggtggcggtactagtggtagttaggtttccgggacgggtacgggtaaccgaacgtccgttacgggtacccgttaccgtacggtacgtaccggaccccgtaagggtccgtccccggtcccccggttcccggttaccgtacccgtttacccggttcccgttaccccccgtacccccttaccccggtaccccgtaaccgggttaacccgg

SEQ ID NO: 328 - DNA, 637 bp, Homo sapiens
  misc_feature: GYAE6OF02GZ23F.19.26.C04.1.454.CMB.1.raw
  modified_base (335)..(335): a, c, t, g, unknown or other
  misc_feature (335)..(335): n is a, c, g, or t
  modified_base (357)..(357): a, c, t, g, unknown or other
  misc_feature (357)..(357): n is a, c, g, or t
  modified_base (586)..(586): a, c, t, g, unknown or other
  misc_feature (586)..(586): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtacagcagaggccaggccacggcccctatactggtcatctattataataccgtccggcccttcgagggactcccgtgacgcgactctcnggtcctccaactcgtggaaccncggcccaccctcgaccgtcgacgacgacgggtacgacgggaccggggatggacgggccgtacgtattacgtgtacgtaggtgggtagggtagtaggtaggtaggtcggtctagtggttagttaggttttacggacggggtacgggaaccgacggtcgtacggtacccgtaccgtacgtcgacgaccgaacggtcctccgtcccgtcggtcaccgtccgtccgttccccncccctcctacccgacgtacggtactaccgtaggacggtccgggtagtccgg

SEQ ID NO: 329 - DNA, 637 bp, Homo sapiens
  misc_feature: GYAE6OF02IVREO.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtggggagacaactttgatagtaaaagtgtgcactggtaccagcagaggccaggccacggcccctatacgtggtccatctattataactaccgtccggccctcgaggactcctagacgcgactctctgctaccactctaggacacggccacctcgaccgtcacgcgacggtacgaacggtcgggatacggacggccgacttactacgtgtacgaggtggtggtagtagtaggtagcggtcagttgtagtacgtttcggacgggtacgggaaccgtaacggacgtacggtacccgtaccgttaggtccgacgacccgtacggcgtccgtccccgtcggtacctaccgttccgttccgttaccccgtaccccgttcccgtacccggaaccggttaccgtaaccggtggaccgggtcgggtacccgtaacggg

SEQ ID NO: 330 - DNA, 609 bp, Homo sapiens
  misc_feature: GYAE6OF02HIAN6.19.26.C04.1.454.CMB.1.raw
  modified_base (444)..(444): a, c, t, g, unknown or other
  misc_feature (444)..(444): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggcccccaggagagacggccaggattccctgtgggggagacaactttgatagtaaaagtgtgcactggtaccagcagaggccaggccaggcccctatactggtcatctattataataccgtccggccctcagggatccctgacgcgactctctggctcaactctggaaccacggccaccctgaccgtcagccgagggtcgaacggccggggatcggaggccgacgtacgttacgtgtacgaggtggtgggatagtaggtagcggtnagtgttgtagtttcggcggtaggaccgaggctggacccgtcgtaggtcacgcccaaggcgtccgtcccccgtcggttacccaccgttccgttccgttcccccgaccccttccccgtccgaaccggtacgtaccggtaccgtcggaccggtcgggcccgtaccggg

SEQ ID NO: 331 - DNA, 732 bp, Homo sapiens
  misc_feature: GYAE6OF02I32J9.19.26.C04.1.454.CMB.1.raw
  modified_base (360)..(360): a, c, t, g, unknown or other
  misc_feature (360)..(360): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcagaggccaggccaggcccctatactggtcatctagttataataccgtccggccctcgagggactcccgtgacgccgactcgtctggctcccgaacttcgacggaacncggccacccgtcgaccgtacagcgagggtacgaacggaccggggtagtcggacgggacccgtactaacgtttacgtcggtacgtaggggtcgggtagggtaataggttaagggtacggcgggtaccgtagttaggttacggttacggttttccgggacgggtaacgggtaccgtaacgggtcgttaccgggtacccgttaccggtaacgggtccgtaaccggtaccccggtaaagggtcccgttaacccggcccccgtttaccggtaccctacggtttacccgttcccggttacccccaccccgttccccgtaacccgaccgggtaacgtaccggttaccggtacggtaacgggtcccgggtacgtaccggg

SEQ ID NO: 332 - DNA, 681 bp, Homo sapiens
  misc_feature: GYAE6OF02I8PYC.19.26.C04.1.454.CMB.1.raw
  modified_base (220)..(220): a, c, t, g, unknown or other
  misc_feature (220)..(220): n is a, c, g, or t
  modified_base (327)..(327): a, c, t, g, unknown or other
  misc_feature (327)..(327): n is a, c, g, or t
  modified_base (364)..(364): a, c, t, g, unknown or other
  misc_feature (364)..(364): n is a, c, g, or t
tcagtactctcgtgcacgaccggtgctcgatttagtctagcgactttgggtttggtgggtgagggttgagaacctatgaacattctgtaggggccaccgttctcctcctcggcctcctctctcactgcacaggctctgtgacctcccatgtggtgactcagcccaccctcagtgtcagtggccccaggagagacggccaggacttcccctggtggggganactaactttgatagtaaagtgtgcactggtaccagcagaggccaggccaggcccctatacgtggtcatctattataatacccgtccggccctgagggactcccgtgngccgactctcgtcggcctccaactcgtacgggaaccnccggtcccacccgtgacccgtcacgcgacggggtcgaagggcccggggatggacggccgaacttacttacgtcgtcgagggtggtagggataggtagtacggcggtcgagttggtgttcgttttcgggacgggtacgggaccaggtccgtacggaccggttccgtacggtaccgaccgtacccgaacggtccgtacccgtcccccgttccggtacctaccgttccgtttacccgttaccccctaacccccgttcccgttacccgaacccggtacggttaacccgttaccgtacgggtacccgggtccggtacccggg

SEQ ID NO: 333 - DNA, 611 bp, Homo sapiens
  misc_feature: GYAE6OF02GUQ9Z.19.26.C04.1.454.CMB.1.raw
  modified_base (461)..(461): a, c, t, g, unknown or other
  misc_feature (461)..(461): n is a, c, g, or t
  modified_base (481)..(481): a, c, t, g, unknown or other
  misc_feature (481)..(481): n is a, c, g, or t
  modified_base (528)..(528): a, c, t, g, unknown or other
  misc_feature (528)..(528): n is a, c, g, or t
  modified_base (590)..(590): a, c, t, g, unknown or other
  misc_feature (590)..(590): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcagaggccaggccaggcccctatactggtcatctattataataccgtccgccctcagggactccctgacgccgactctcgtcggcctccaactcgtacggaacaccggccacccgtcgaccgtcagcgaggtacgacggaccgggagtcggacggccgacttagttactaggtttacgggtgtgggtacgtaggtaggtagcgggtacngtggttagtagttttcgggngggtacgggactagcgtgaccgttcgtacggtcacggccgaggtccncgtccccgcggtcacgttcgtccgtcccctacccgtaccctccgaacgtacggtacgtaccncggtacggccggacgtacggg

SEQ ID NO: 334 - DNA, 760 bp, Homo sapiens
  misc_feature: GYAE6OF02IC9OF.19.26.C04.1.454.CMB.1.raw
  modified_base (319)..(319): a, c, t, g, unknown or other
  misc_feature (319)..(319): n is a, c, g, or t
tcagtactctcgtgcacgaccggtgctcgatttagtctagcgactttggggtttgggggggagaggagcccagcactagaagtcggcggtgtttccattcggtgatcagcactgaacacagaggactcacatggagtttgggctgagctgggttttcctcgttgctcttttaagaggtgtccagtgtcaggtgcaccgtggtggagtcgtggggggaggcgtggtccaggccgtgggacggtccctgacgactctcctgtgcagcctcgtggattccaccttgagtacgtctttggctactccgtacgtcgggtccccncgacggtcctaccggtaggacgaacgggggtactagggaggtggggtacggcgtacggtttaatactacgtagtagagtacggttaggaaagttaaaagttataagtttagagggtacgtaaccgtccggtagggaaccggggtccgtaaccgtttccgaaaccgtacttacccgtaccgaacggtaacgtaacgtaaacttacccgaaacgtaaactaccggtaacggttacggtactacgtaacgtaacgaaaacgtagaaaccgacggtacgtaggaacggtacgtacggggtaacggggaaccgtacgggtactttacgggtacgtttacggtttacggttacgggtcggtaaccgggaggtaccgggtaccgggtcgtaccgggtaacctaaaccggttacctaaccgtttaccgttaacggggttttaaccgggg

SEQ ID NO: 335 - DNA, 720 bp, Homo sapiens
  misc_feature: GYAE6OF02GMFH8.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggcccctcggagtcctccgtagacgacgtacctctcgtcgtcctacctactcggtacggaaccgccgacccctaccgtaccgtaccgacgacggacggtacgggtaacggaaccggggacggtacggtagggaccgggaccgtaacgtttaacttacggtcgtacgggtagggtcgggtaggtaaggtaaggttacgggtacgggtacggtacgtaggttggttagtttacgggtttccgggacggggtaaccgaacggtacggtcgtaccggtacccgtacggttacgacgtacccgaaccggtacgccgtaccccgtccccggtcgtaccgtcccttcgttccccgtaccccctacccctcccgaacccggtacgtacggtaccgttacggacggtcgggtaccggtcgggtaaccgg

SEQ ID NO: 336 - DNA, 754 bp, Homo sapiens
  misc_feature: GYAE6OF02F99EL.19.26.C04.1.454.CMB.1.raw
  modified_base (226)..(226): a, c, t, g, unknown or other
  misc_feature (226)..(226): n is a, c, g, or t
  modified_base (282)..(282): a, c, t, g, unknown or other
  misc_feature (282)..(282): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtcggcccaggagagacggccaggacttccctggtggggganacaactttgataagtaaagtgtgcatggtacagcagagccaggccacggcccctanactggcatctattataactaccgtccggccctcagggtactcccgtgacgcgaccttctcgtcggcctacctaactcgtacggaacaccggcccacccgtgaacccgtcgacggccgtacggggtaccgaacggccggggtaatcggacggtacccgtaacgtacgttacgtcggtagtacgggttacgggaggggttaacgttagggttaacgggttacgggttaccggtacggttaacgtttgggtttacgggtttaacggtttttaccgggggaccggggtaaaccgggggaacccgtaaacggtccgttaaccgggtacccggttaccgtaggggtaccctaccggtaccccggaagggttccccggtcccggttacccccccggttacgggtacccctacccggttcccggtttacccggttccccccgtaccccggttttccccgtaccggtaacccgtaaccggg

SEQ ID NO: 337 - DNA, 674 bp, Homo sapiens
  misc_feature: GYAE6OF02JBN6T.19.26.C04.1.454.CMB.1.raw
  modified_base (283)..(283): a, c, t, g, unknown or other
  misc_feature (283)..(283): n is a, c, g, or t
  modified_base (302)..(302): a, c, t, g, unknown or other
  misc_feature (302)..(302): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactgtcatntatatactaccgtccgccncgaggtacctccgtgcgccgtactcgtcgtcgcctaccacgtcgtacggaccgaccgcccaccgcgtacctcgacgacggaggtacgacgggtccggagtacggaccggtaccgtaacttagttacgttagtacggtaggtggggttagaacggttagtaggtacggtacggtactaggttcgtaagtttcgggtttacggacgggtaccggtaacgacgtcgtaccggtaccgttccggtacgtacgacccgggtaccgtaaccgggtcctaccccggtcccgttaccggtaccttacgttcccgttcccggtacccctccctcccgtaccgtacggaacgtaccgtcgacggccggtacggtcgtaccgg

SEQ ID NO: 338 - DNA, 706 bp, Homo sapiens
  misc_feature: GYAE6OF02GZS72.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagcccaccctcagtgtcagtggcccccaggagagacggccaggattccctggtggggagacaactttgataagtaaaagtgtgcactggtaccagcagaggccaggccacggcccctatacgtggtcatcttattataactaccgtccgccctcgacggactccgtgagcgactctcgtggtcctaccgaactcgtacggaaccgaccggaccctacccgttacgacccgtcacggtccgacgggtacgaacgggccggggtaactgggacggacccgtacttaacgtttaccgtacgttacgtagggttcggtacgggtaagttaacggttaggtacggtacggtaccgtagttggttacggttacggttttcgggaccgggtaagggtaacccgaaggtccgtacggtacccggttacgtacggtccaaccggtacccgaacggtcctcccggcccccgttagtcccgtaccgttccgtccgttaccccaccccgttcccgtaccgaccggtacgtacggtacgtcggacgggccggtgtaccgg

SEQ ID NO: 339 - DNA, 814 bp, Homo sapiens
  misc_feature: GYAE6OF02GCY4E.19.26.C04.1.454.CMB.1.raw
  modified_base (267)..(267): a, c, t, g, unknown or other
  misc_feature (267)..(267): n is a, c, g, or t
tcagtactctcgtgcacgaccggtgctcgatttagtctagcgactttgggtttgggggggagggaggagcccagcactagaagtcggcggtgtttccattcggtgatcagcactgaacacagaggactcaccatggagtttggctgagcttgggttttcctcgttgcttcttttaagaggtgtccgagtgtcaggtgcacctggtgagtcgtgggggaggtcggtgggtccaggcctggggacggtccctgagacctctcgtgtgcngccctgtggacttcgaccttcagtagctttggctatcccgacgtcgggcccgtccgacggccgtaccccggcgaacggggctaggaggttcggggcgtcgaagttttagtaacttcagttacttggaagtacggggtaaaggttaaaaatacgtttaaagtttagttacgggacggtaaccgtacccggttaggggaaacggggtaccccgtaatttacccgtacccgtaacgtaccgtaacccgtaaccggaagtaaacccgtaaacttaaccggaaaacgtaaaccgtaacgtaaggtttacggaaacgtccgttaagtaacccgtaaaaagttggaaaacccgtaacggtacccgttaaggaaccgggaagtttaccggaacccggggggtaaccgtaaccgggtaccggttagggtttacgttaaacgggtttttaccgaagggttcgggaaacccgggttagggaacgggtcccggggtaacgttcggaaccgtacggtaaacctaccgttaacccgttacggttttaaccgggtttagggg

SEQ ID NO: 340 - DNA, 738 bp, Homo sapiens
  misc_feature: GYAE6OF02H8G1L.19.26.C04.1.454.CMB.1.raw
  modified_base (634)..(634): a, c, t, g, unknown or other
  misc_feature (634)..(634): n is a, c, g, or t
tcagtactctcgtgcacgaccggtgctcgatttagtctagcgactttgggtttggggggggagaggagcccagcactagaagtcggcggtgtttccattcggtgatcagcactgaacacagaggactcaccatggagtttgggctgagcttgggttttcctcgttgctcttttaagaggtgtccagtgtcaggtgcacctggtggagtcgtgggggagcgtggtccagccgtgggacggtccctgagactctcctgtgcagcctcgtggattccaccttcagtacgtctttggactactcccgacgtcgggtcccgccacgggtcctcccgaagggccgaaaggggggtcctaaggagggttgggggtcggaccgtaaggtttataagtacaatagtagtagtagggtaaaggtaaaatatttaagttaaggtaggaagtaccgtaccggttagggaaacgggtccgtaactttacccgaaccctagttaccctaccgaacggtaacgaaaccttaaacgttaacccgaaaagtaaaccctaacgtaaggtacggtacttacgtacgaaccgtaaaagtacgaaacctacggtacccgtaggaacgaggtccgggtaggggaaccgaccgggtnttacgggtacttacgtttacgtgggtacgacgggtaacggacggtccggacggtacggacccgtaaacgtaccctacgttacccgttaagggttttacccgggg

SEQ ID NO: 341 - DNA, 691 bp, Homo sapiens
  misc_feature: GYAE6OF02HKM49.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctccatgtggtgactcagccaccctcagtgtcagtggccccaggagagacggccaggattccctggtggggagacaactttgatagtaaaagtgtgcactggtaccagcagaggccaggccaggcccctatactggtcatctattataactaccgtccggcctcgagggactcctgacgcgactctctcggctccaactcgtacggaaccgaccggcccacccgtcgaccgtcgacgcgacgggacgtaagggccggggaagtcgggacggccggacgttacgttacgtgtacgtagggttcgggtgggtaggttaggttagtaggtcgggttacgagttggttaggtttacgttttcgggacgggtacggggtaacctaagggtccgtcggtaacccggttccgtacggttaccggacgtacccgaacgggtcctcccgtcccccgtggtacccctcgttacccggttcccgttaccccgtaccccgttcccgtacccgtaaccggtacgtacggttaccgttcggacgggtcgggtcccgtacgggg

SEQ ID NO: 342 - DNA, 673 bp, Homo sapiens
  misc_feature: GYAE6OF02HRL65.19.26.C04.1.454.CMB.1.raw
  modified_base (372)..(372): a, c, t, g, unknown or other
  misc_feature (372)..(372): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtcggccccaggagagacggccaggtacttcccgtggtgggggagactaactttagataagtaaaagtgtgcacgtcggtacagcagacggccaggccaggtcccctagtaccgtggtcatctatactaatccgtccggcctcgaggactcctgacgcactctcgcgctaccaactcgtagggaaccncggccctaccgcgaccgtcaggcgacgggtacgaacggccggggatcgggacggaccgtacgtaacttcgtagtcgtagggtggtacgggtagttaggtacgtgggtcgtacgagttcggttaggttacgtttcggggacgggaacggggtaccaacggtcgtaccggaccggtaccgttcgggtacaccggtacccgaacgggtcccttacccgggtcccccgtcgggttaaccctccggtttacccgttcccgggtttaccccccaccccgtttccccgtaacccgtaccggtaaccgg

SEQ ID NO: 343 - DNA, 594 bp, Homo sapiens
  misc_feature: GYAE6OF02G74Y2.19.26.C04.1.454.CMB.1.raw
  modified_base (395)..(395): a, c, t, g, unknown or other
  misc_feature (395)..(395): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggctccaggcaaggggctagagtgggtggcagttatatcatatgatggaggtaaaatatattatggagactccgtgaaggccgattcaccatctccagagacaattccaagaacacagtggatctgacaaatgaacagcctgagagctggggacacggctgtgtattactgtgcgagngcggcgtggcaactacatccagttacggttggacgtcgtcggggccaaggggaccacgggtcagttccgtcctccccgagcccctacccgaccgaaccgggccccctaacggttcccgggttccccttccccccggttcggtaccccggtccccgttcggccccgttacccggaccgggtaccgcccgtaaccccccgg

SEQ ID NO: 344 - DNA, 696 bp, Homo sapiens
  misc_feature: GYAE6OF02GXJTE.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataatccgtccgccctcgagggatccctgagcgactctcgtggctccaactcgtacggaaccacggccaccctaggacccgtcgacgcgtacgggtacgaacgggcccggggaagtcggacgggacccgtaacttacttacgtcgtcgtacgggtgggttacgggagttaggtacggtaggtcgggtactagttggtagtaggttttcgggacgggtagggaccgacggtcgtacggacccgttccggtacggtaccgacgacccgtaacggtcccgtacccgcccccggttcccggtccctaccgttcccgttcccggtttccccccggtacccccgttccccgttaccccgaccggttaccgtaaccggttaccgtcggtaaccggggtccgggtccgtaccgggg

SEQ ID NO: 345 - DNA, 565 bp, Homo sapiens
  misc_feature: GYAE6OF02H8YLC.19.26.C04.1.454.CMB.1.raw
  modified_base (264)..(264): a, c, t, g, unknown or other
  misc_feature (264)..(264): n is a, c, g, or t
  modified_base (310)..(310): a, c, t, g, unknown or other
  misc_feature (310)..(310): n is a, c, g, or t
  modified_base (338)..(338): a, c, t, g, unknown or other
  misc_feature (338)..(338): n is a, c, g, or t
  modified_base (355)..(355): a, c, t, g, unknown or other
  misc_feature (355)..(355): n is a, c, g, or t
  modified_base (360)..(360): a, c, t, g, unknown or other
  misc_feature (360)..(360): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggtttttcctcgttgctcttttaagaggtgtccagtgtcaggtgcacctggtggagtcgtgggggaggcgtggtccagcctgggacggtccctgagactctcctgtgcagcctntggacttcaccttcagtagtctttggctatccacttcggggtcccncacggcctccgaggcgaaggggctaggnggtgggtgcagttatancatangagttggaagttaaaatgtaattagaggtagacctcggtaggacgggcctattccacatcctacagacgaactattcccaaagacacgtaggtgactctagacaagtcgaacagtccgtagacgaggcgtacgggacacggtctagtgttacttcgtagcgacgaggcgcggcgtgaccaactactacgtaccgtagtttaccgg

SEQ ID NO: 346 - DNA, 752 bp, Homo sapiens
  misc_feature: GYAE6OF02GY761.19.26.C04.1.454.CMB.1.raw
  modified_base (362)..(362): a, c, t, g, unknown or other
  misc_feature (362)..(362): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagcccaccctcagtgtcagtggccccaggagagacggccaggacttcccgtggtgggggagactaactttgataacgtaaaagtgtgacacgtggtaccagcagaggccaggccaggcccctatactggcatctattataataccgtccgccctcaggactcccgtgacgcgactctctcggtcacctactcgtacggaaccncggaccacccgtcgaccgtcagccgtagggtacgtacgggaccgggtagtacggacggaccgaacgtttaacttacgttcggtacgtagggttacgtaggggtacgttaggtaaggtacgggtacggttaccgtaggtttacggttagtttacgggtttttacccgggaggggtaaccgggttaaccggaaaggtccggttaaccgggtaaccccggttacccggtttaggtaacccgttacgggaaccccgtaaacgggtccgtacccggtacccccgttacggccttaaccgttccggttcccggttaccccgttcccccgtaccccgttacccgaaccggtaccgtacgttaccgtacggtaaccgggtccgggtagtaacccgggg

SEQ ID NO: 347 - DNA, 616 bp, Homo sapiens
  misc_feature: GYAE6OF02JEQ8Z.19.26.C04.1.454.CMB.1.raw
  modified_base (218)..(218): a, c, t, g, unknown or other
  misc_feature (218)..(218): n is a, c, g, or t
  modified_base (407)..(407): a, c, t, g, unknown or other
  misc_feature (407)..(407): n is a, c, g, or t
tcagtactctcgtgcacgaccggtgctcgatttagtctagcgactttgggtttggggggtgagggttgagaacctatgaacattctgtagggggccaccgttctcctcctcggcctcctctctcactgcacaggctctgtgacctcccatgtggtgactcagccaccctcagtgtcagtggccccaggagagacggccaggattccctggtggggganacaactttgatagtaaaagtgtgcactggtaccagcagaggccaggccaggcccctatactggtcatctattatataccgtccggcctcgagggactccctgacgcgactctcgtaggcctcccaactcgtcggggaaaccaccggcccaccctgacccgtcacgccgtagggtcgaaggccggggagnggacggccgactattacgtgtcgtagggtggtagggtagtaggtagtacggcggtacagtggtgtagtttcgggcggacggaccaggtcgtcgacccgttcgtaggcgtacgacccgaaggtcctccgccccgtcgtcctaccgtccgttccgtccccgtcccctccgtcccgacgacgtacgttacgtacggcggccgggcgtacggg

SEQ ID NO: 348 - DNA, 673 bp, Homo sapiens
  misc_feature: GYAE6OF02GE2LG.19.26.C04.1.454.CMB.1.raw
  modified_base (586)..(586): a, c, t, g, unknown or other
  misc_feature (586)..(586): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggagcgtggtccaggcctggggaggtccctgagactctcctgtgcacgcctctggtattccgaccttcgagtagtctttggctactccgacgtcgggtcccgccaggcctaccgaggcgaagggctaggaggtcgggtgactagttactatacgtatagtgagtagggaaaagtaaaattagttaagttagtaggaacgtaccgtaccggtaggaacgggtccgtacttacccgacctacgtccctaaccgaagtaacctaactaaacgttaaccaaacgaaaccgtaacgagttacggtactacgtacgaacgtaaagtaccgaaacgtaggtaccgtaggaacggtaaccggtacggtacgggtaaccgnggtacgttacgttagttaacggttaattcgggtacgtaggaaggtcggacggtacggtacggaacctaaccgtactacgttaaccgg

SEQ ID NO: 349 - DNA, 859 bp, Homo sapiens
  misc_feature: GYAE6OF02H1YYR.19.26.C04.1.454.CMB.1.raw
  modified_base (85)..(85): a, c, t, g, unknown or other
  misc_feature (85)..(85): n is a, c, g, or t
tcagtactctcgtgcacgaccggtgctcgatttagtctagcgactttgggtttgggggtgagggttgagaacctatgaacattcngtaggggccaccgttctcctcctcggcctcctctctcactgcacaggctctgtgacctcccatggtggtgactcacgccaccctcagtgtcagtcggccccagggagagacggccaggattccctggtgggggagactaactttgatagtaaagtgtgcactggtaccagcgagacggccaggccacggcccctagtactcgggtctaactcgtaatttaacgtaaacgttaacccggttcccggtaccctcgaacggggtaaccttccccgttacggaacgtcggtaaccctcgttaccgttcgggccttaccccgaacgttccgtaagggggtaaccgaaccgggtccctaacccggtacgacccggtcaacggccgtaacggggtaccggaaaggtcccggggggtaattcggggaacgggtacccgtacgttaagtttacccgtagggttccgtacgggtagggttacggggtaagtttaaggtaacgggttaacggtcgggttacgtaggtttacggttacgggttacgtttttaccggggacgggttaacggggtaaccgtaacgggtcggtaacgtacccgggttaccgttaacggggttacgaaccggtaccggtaaaccgggtaccgttaccggtaccccccgtttacgggtacccgttaccgttaccgttcccggttacccccggttccccgttacccgtaccccggttaacggtaccggaccggttacgtaccgggtacgggtccggggttacgtaaccgggg

SEQ ID NO: 350 - DNA, 757 bp, Homo sapiens
  misc_feature: GYAE6OF02IYWD2.19.26.C04.1.454.CMB.1.raw
tcagtactctcgtgcacgaccggtgctcgatttagtctagcgactttgggtttgggggggtgagggttgagaacctatgaacattctgtaggtgccaccgttctctcctcggcctcctctctcactgcacaggctctgtgacctcccatgtggtgactcagccaccctcagtgtcagtggccccaggagagacggccaggattccctggtgggggagacaactttgatagtaaagtgtgctacgtggtaccagcagaggccaggccacggcccctatactggtcattctattataataccgtccggtccctacgacgggtctcccgtgacgcgactcctcgtcggcctaccgtaactcgtcgggaaaccgaccggtcccaccccgtcgtacccgtccgacggtccgaacggggtaccggaaacgggccggggggtaacttcgggaacgggtaccccggtaaacgttaacgtttaacgttcggtaccggtagggttagggttgggtaacgttaagggttaacggttacggtccgggttacagttaggttaggttacggttttccggacggggtacgggaaccgtaagtccgtacggtaccggttaccgtaacgggtcgacccgtaccggaaccggtccgtacccggtccccgttaccggtaccgttaccgttcccgtttcccgttaacccccgttaccccctacccgtacccggtaccggacggtacgttaaccggtccggtacgggccggtaccggg

SEQ ID NO: 351 - DNA, 691 bp, Homo sapiens
  misc_feature: GYAE6OF02HU3BT.19.26.C04.1.454.CMB.1.raw
  modified_base (226)..(226): a, c, t, g, unknown or other
  misc_feature (226)..(226): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggacttccctggtggggganacaactttgaataagtaaaagtgtgcactggtacagcagagccaggccaggcccctatactggtcatctaattataactacccgtccggccctcgagggactcccgtgagccgactctctcggctaccaactcgtagggaacctaccggcccaacccgtcgacccgtcgaacgacgacgggtacgaacggccggggatcggacggaccgtaactacgttacgtcgtacgagggtggtagggtaacgttaggtaggtacggtccggtatagttcggtagttaacggttttccggggacgggaacggggtaccgtaaggtccgttaaccgggtaacccgttaccgtacgggttaccgaaccgtacccggtaaacgggtcccgtacccggtccccccgtacgggttaccctaccgttcccggttccgttaccccccgacccctttcccgtaccccgaacggtaaccgg

SEQ ID NO: 352 - DNA, 631 bp, Homo sapiens
  misc_feature: GYAE6OF02GZFKP.19.26.C04.1.454.CMB.1.raw
  modified_base (327)..(327): a, c, t, g, unknown or other
  misc_feature (327)..(327): n is a, c, g, or t
  modified_base (355)..(355): a, c, t, g, unknown or other
  misc_feature (355)..(355): n is a, c, g, or t
tcagtactctcgtgcacgaccggtgctcgatttagtctagcgactttgggtttggggggtgtttagggttgagaacctatgaacattctgtaggtgccaccgttctcctcctcggcctcctctctcactgcacaggctctgtgacctcccatgtggtgactcagcccaccctcagtgtcagtggccccaggagagacggccaggacttcccgtggtggggagactaactttgataagtaaaagtgtgcactggtaccagcagagccaggccacggccctatactggtcatctattataactaccgtccggccctcgagggactcccngagcgactctctgctccactcgtggacncgccacctgccgtcagcgaggtcgaacgccggggatcggacggccgtaacttacttacgtagtcgtaggtggtagggacgtagtaggtacggcggtcaggttgtcggttagtttcgggacgggtagggaacctaagccgttacggtaccgtccgttaaggtccgaacgtcccgaaggcccgtcccgtcccccgtcggtacctacgttcccgtaccgtttccccaccccttcccgtaccgacgtacggtaccgtaccgtggtaccggacgggtccgg

SEQ ID NO: 353 - DNA, 795 bp, Homo sapiens
  misc_feature: GYAE6OF02IAAKL.19.26.C04.1.454.CMB.1.raw
  modified_base (323)..(323): a, c, t, g, unknown or other
  misc_feature (323)..(323): n is a, c, g, or t
  modified_base (337)..(337): a, c, t, g, unknown or other
  misc_feature (337)..(337): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcacgccaccctcagtgtcagtggccccaggagagacggccaggacttcccgtggtagggggagactaacgtttgataagtaaaaagtgtagcacgtggtaaccagcagaggccaggccaggcccctatactggtacatctaattaataactaccgtccggcctnacgggacttcccgngacgccgtactcgtcgtcggtcctacccaacttcggtacggggaaccaccggcccaacccgtcgaccgtacacggacgacgggtacgaaacggcccggggtatggaaccgggccgtacgtaacttacgtacgtacgtagggtcggtaggaacgttaggtacggtacggacggtacgtagttggttacggtttacggttttacggggaccgggaacgggtaaccgtaacggccgtttaaccgggaacccggtttcccggttaaggggtaccgtaaccgggtaaccccggtaacggggttcccgtaaccccgggttaccccgttcccgggttacccgtaacccgtttcccggtttcccggttaccccctaaccccggttacccccttaccccggaaccggtttaccgaaccggttaaccggttccggtaaccggggtacccggggtaccggttaaccggg

SEQ ID NO: 354 - DNA, 754 bp, Homo sapiens
  misc_feature: GYAE6OF02I47GA.19.26.C04.1.454.CMB.1.raw
tcagtactctcgtgcacgaccggtgctcgatttagtctagcgactttgggtttggggtgtgagggttgagaacctatgaacattctgtaggggccaccgttctcctcctcggcctcctctctcactgcacaggctctgtgacctcccatgtggtgactcagccaccctcagtgtcagtcggccccaggagagacggccaggacttcccgtggtgggggagactaactttgatagtaaaagtgtgctacgtggtaccagcaggacggccacggccacggcccctataccgtggtacctactactaattaataaactacccggtcccggtaccctcgacgggtactccgtgacgcgactctacgtggcctaccactcgtacggaaccgaccggccacccgtacgacccgtcacggtcgacgggttacgaacggtccggtagacgtacggacggtaccgtacgttacgttaccgtcgtacgtagggttcggtagggtaagtaggtacggttaggccggttagtagtttcggttaggttacggttttcgggaccgggtaacgggtaaccgtaacggtccggttaccggtacccggttacggtacggtaccgtaaccggaccccggtaaacggtcccgttacccggccccggttacggttacccgtaacccgtttccgttaccccggttacccctacccgttaccccgtaccggtaaccgggtaccgaccgggttaaccgggacgggtcccggtaacgg

SEQ ID NO: 355 - DNA, 729 bp, Homo sapiens
  misc_feature: GYAE6OF02GDEQS.19.26.C04.1.454.CMB.1.raw
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggcctcagggatccctgagcgactctcgtggctccaactctcggggaacacggccaccctgaccgtcagacgacgggtacgaaggcccgggggaatcggacgggacccggaacttaacgttacgtacggtacgtagggttacgtaggggtacgtaaggttaggttaggcgggtacgaacgttggttagtacgtttttcgggacgggtagggaacccgtaaaggtccgtacgggtaacccggttacccgtacgggtaccgtaaccggaccccgttaaaagggcccgttaacggtcccccccgttacgggttacccgtaaccgttcccggtttcccgttacccccgtacccccgtttacccgttaaccccgtaaccggacggtttaccggtaaccggttccggaacgggttcccggggcgttaaccgggg

SEQ ID NO: 356 - DNA, 833 bp, Homo sapiens
  misc_feature: GYAE6OF02FINVQ.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcacgccaccctcagtgtcagtcggcccaggacgagaccggccaggacttcccgtggtgggggacgactaaccttttggattacgttaaaacgtggtacgctacgtcggtaccagcagacggtccagggcccaacgggcccccttaataccgtggtcatccgtatttactaactaccgtccggacccttacgacgggtaccttcccgtagacgtaccggtacctccgttccgtacgggtcctacccgtaaaccgttccggttacggggaaaccctaccggggacccctacccgttacggacccgttacggacgtaccggtaacgggggttaccgaaacgggtacccgggggtacttacgggaaccgggtaccccgtaaaccggtttaacgtttaacccggttacggttaccggtaaacggggttcgggttacggggtaacgtttaacgggttaacgggttacgggtacccgggttacgtaacgtttacgggttacggtttaacgggttttaccgggaccgggtaacgggtaaccgtaacgttccggaaccgtaccggttaccgtacgggtacaccggaccgtaacggtccgtccggtacccccgttacgcccgttaaccgttccgttaccgtcccccggtcccttacccgtaccgtaccggtaaccgg

SEQ ID NO: 357 - DNA, 561 bp, Homo sapiens
  misc_feature: GYAE6OF02F7YCS.19.26.C04.1.454.CMB.1.raw
  modified_base (159)..(159): a, c, t, g, unknown or other
  misc_feature (159)..(159): n is a, c, g, or t
  modified_base (347)..(347): a, c, t, g, unknown or other
  misc_feature (347)..(347): n is a, c, g, or t
  modified_base (354)..(354): a, c, t, g, unknown or other
  misc_feature (354)..(354): n is a, c, g, or t
  modified_base (368)..(368): a, c, t, g, unknown or other
  misc_feature (368)..(368): n is a, c, g, or t
  modified_base (378)..(378): a, c, t, g, unknown or other
  misc_feature (378)..(378): n is a, c, g, or t
  modified_base (436)..(436): a, c, t, g, unknown or other
  misc_feature (436)..(436): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcgtggtttcncgttaggctctttaagaggtgtccagtgtcaggtgcacctggtggagtcgtgggggagcgtggtccagcctgggagtccctgagctctcctgtgcagcctctggacttcaccttcagttagctttggctatcccacgtcgggtccgccaggtctccgaggcgaaggggtctagagtgggtgcagttanatcatangatggaagtaaatntatagtgganactcgtgacggcgtatcacatctacgagagactataccaagacacgagtgatctaganaactaggaaccagccgtagaagacgtcgtacgggtacgacggtcgtaggtagttaacgttaacgttggacgaccggaggtaccggacggtcgtacggacgtaaaccgttacgtacgttaacccgg

SEQ ID NO: 358 - DNA, 663 bp, Homo sapiens
  misc_feature: GYAE6OF02G9SPX.19.26.C04.1.454.CMB.1.raw
  modified_base (360)..(360): a, c, t, g, unknown or other
  misc_feature (360)..(360): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggcccccaggagagacggccaggattccctgtgggggagacaactttgatagtaaaagtgtgcactggtaccagcaagaggccaggccacggcccctatactggtcatctattataataccgtccggaccctgagggactccctgacgcgactctcgtggcctccaacttcgtggggaaccncggccacccgtgtacccgtcacgacgagggtacgaacggcccggggtatacggacggacccgtacttagttaccgtggtacgtaggttcggtagggtaagtaggtacggtagtcggttacagtgttacgttgtttccgggacgggacgggtaccaaggtccgtagacccgtcgtagttaccgacgacccgaagtccgtaccgcccccgtcggtcctacctccgttcccgttacccccacccttcccgcccgtaacggaccgtaccggttaccgtcgggaaccggttccgggtacctaccgggg

SEQ ID NO: 359 - DNA, 835 bp, Homo sapiens
  misc_feature: GYAE6OF02HL0RO.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataactaccgtccggcccttacgacgggattccccgtgacgtccgtaacctcttcgtcgggtcctacccgaaacgttcgtacggggaaccaccgggtaccctaccccgtcgaacccgttcgacggcgtaacggggttccgaaaacgggtcccgggggtaattagggaaccggacccggtaacgttaccgtttaaccgttcgggttaccgtaaggggttcggttacggggtaacggttaacggttaaacgggttacgggtaccggggttcgtaacggtttcgggttacgggttaaacgttttttccgggggaacggggttaacggggtaaacccaaacgggttcgtaccggggttaccccgttaccggttaccgggtaaccgttaaccgtaccccgggtaaagggtcccgttaacccgggcccccgtttaccgggttacccgtaacccgtttccggttaaccggttcccccctaccccgttacccgtacccgtaaccgtacggtacgttacccggttacggtacgggacccgggttaccgtaaccgggg

SEQ ID NO: 360 - DNA, 727 bp, Homo sapiens
  misc_feature: GYAE6OF02FQX39.19.26.C04.1.454.CMB.1.raw
  modified_base (175)..(175): a, c, t, g, unknown or other
  misc_feature (175)..(175): n is a, c, g, or t
  modified_base (247)..(247): a, c, t, g, unknown or other
  misc_feature (247)..(247): n is a, c, g, or t
  modified_base (261)..(261): a, c, t, g, unknown or other
  misc_feature (261)..(261): n is a, c, g, or t
  modified_base (273)..(273): a, c, t, g, unknown or other
  misc_feature (273)..(273): n is a, c, g, or t
  modified_base (303)..(303): a, c, t, g, unknown or other
  misc_feature (303)..(303): n is a, c, g, or t
  modified_base (336)..(336): a, c, t, g, unknown or other
  misc_feature (336)..(336): n is a, c, g, or t
tcagtactctcgtgcacgaccggtgctcgatttagtctagcgactttgggtttgggggggagaggagcccagcactagaagtcggcggtgtttccattcggtgatcagcactgaacacagaggactcaccatggagtttgggctgagctgggttttcctcgttgctcttttaagnggtgtccagtgtcaggtgcacctggtggagtcgtgggggagcgtggtccagcctgggagtccctgagactcncctgtgcagcctcnggattcaccttnagtatctttggcatccacgtcggggtcccnccgaggcctccgagggccgaagggggctaaggnggttggggtggctaaggtttatacgtcgtaattagtggaagtaggggtaaaggtaaaattagttaagttacggtagggtaacgtaacgttacccgggttaagggaaacggggtccctaatttacccgaaccctaacgttacccgtacccgaaggtaacggtaaacctaaaccgtttacccgaaaaggtaaacccaacgtaaggttacgaacttacgtagtaacctaaagtacgaaacgtacgaccgttagaacggtaacgccggttacggggaaccgtacgggtaccgttagggttacgttacgttaacgtgggtacggacggtaggacggtccgggtacgtacgggacctaaaccgttacctacgtttacccgtaggttttaacccgggg

SEQ ID NO: 361 - DNA, 642 bp, Homo sapiens
  misc_feature: GYAE6OF02HNB3H.19.26.C04.1.454.CMB.1.raw
  modified_base (217)..(217): a, c, t, g, unknown or other
  misc_feature (217)..(217): n is a, c, g, or t
  modified_base (421)..(421): a, c, t, g, unknown or other
  misc_feature (421)..(421): n is a, c, g, or t
  modified_base (527)..(527): a, c, t, g, unknown or other
  misc_feature (527)..(527): n is a, c, g, or t
tcagtactctcgtgcacgaccggtgctcgatttagtctagcgactttgggtttggggggttggagggttggagaacctatgaacattctgtagggccaccgttctcctcctcggcctcctctctcactgcacagctctgtgacctcccatgtggtgactcagccaccctcagtgtcagtggccccaggagagacgccaggattcccgtgtggggganacaactttgataagtaaagtgtgcactggtaccagcagagccaggcacggcccgtatactggtcatctagtataactaccgtcgccctcagggactacccgtgacgacgtaccgtctcgcggcctaccgaacttcgacgggtaacacggtccacccgtgacctcgagcaaggtcgaagccggggatcgaggccgaatagttacngttcaggtggtggactagagtacgtcggtactagtggttgtagtttacggcgggaacgggtacacgacgtcggtaaccgtcccgtaggtcgtacgacccgacgggntacccgccccgtccggtacttacccgtccgttccggtaccccccttcccgtaccccgttcccgtaaccggtacgtaccggtaacccgttaggaccggtacgggcccgtaccgggg

SEQ ID NO: 362 - DNA, 609 bp, Homo sapiens
  misc_feature: GYAE6OF02FJCJ1.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatccctgagcgactctctggctccaactcgtgggaacacggccaccctgaccgtcagccgagggtcgaacggccggggatcggacggccgactattacgtgtcgaggtgtgggataggtagtaggcggtcagttgtgtagttttcgggacggagggaccgaagcgtgacccggtccgtacgggtcacgcccgaacggcgtaccgcccccgtcgggtccaccgtccgttcggttccccgccccttcccgtacccacggtacggtacggttaccgtaggtacggaccggggtcgtacggg

SEQ ID NO: 363 - DNA, 687 bp, Homo sapiens
  misc_feature: GYAE6OF02IUZVQ.19.26.C04.1.454.CMB.1.raw
  modified_base (513)..(513): a, c, t, g, unknown or other
  misc_feature (513)..(513): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagcccaccctcagtgtcagtcggccccgaggagaggaccggccgaggacttccctgggtagggggagactaactttgataagtaaaagtgtgcactggtaccagacaggacggccgacggccgacggacccctataccgtcggtctatctaattaactaacgtacccgtccggccctacgacgggtacctccgtaggacgcgacttcctcgtcggtaccctacgtaacctcggtacggaaccgaccgtacccacccgttacggaccgtcgacgcggtacgggtacggaacggcggggataggacggaccgtattactacgtgttcgtaggtggtaggagtagtagtcggcggtnagttggtacggttggttcgggcgggtaacggaactcgggtcgtacggtaccgttcggtagtaccgacgacccgtaacggcctcccggccccgttcgtcctaccggttccgttaccccgttccccacccttcccgaccgtacggtctacgtaccgcggacggtcgggtctacggg

SEQ ID NO: 364 - DNA, 843 bp, Homo sapiens
  misc_feature: GYAE6OF02GH4HY.19.26.C04.1.454.CMB.1.raw
  modified_base (218)..(218): a, c, t, g, unknown or other
  misc_feature (218)..(218): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggacttccctggtggggganactaactttgataagtaaaagtgtgcacgtcggtaccagcagacggccacggccacggcccctatacgtggtcatctattataactaccgtccgccctcgagggactcccgtgacgccgactccgtctacggccttacccgaacgttcgtacggggtaaacccgaccgggaccccctacccgtaccggaacccggtttcgaaccggtccggtaacggggggttaccggaaacgggggccccggggggtaatacggggaaccgggacccggttaaccttaacgtttaccgtcggttacggtacggggttacgggttaaggggtaggttaaggtagggttaacgggtaccggtacgtaggttagggttacgttacgggtttttaccggggaacggggtaacgggtaaccgtaaacgggtccgtacggtacccggttaccggtaccgggttaccgaaccgggacccgtaacgggtcccgttcccggttaccccccgtacggttacccgtacccgttacccggtttacccgtttccccccgtaccccgttccccgttacccggtaaccggtaccggttaccggttaacccggtacgggaccgggtcccggggtaccggttaacccgggg

SEQ ID NO: 365 - DNA, 531 bp, Homo sapiens
  misc_feature: GYAE6OF02FKPSD.19.26.C04.1.454.CMB.1.raw
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
  modified_base (356)..(356): a, c, t, g, unknown or other
  misc_feature (356)..(356): n is a, c, g, or t
  modified_base (362)..(362): a, c, t, g, unknown or other
  misc_feature (362)..(362): n is a, c, g, or t
  modified_base (375)..(375): a, c, t, g, unknown or other
  misc_feature (375)..(375): n is a, c, g, or t
  modified_base (380)..(380): a, c, t, g, unknown or other
  misc_feature (380)..(380): n is a, c, g, or t
  modified_base (384)..(384): a, c, t, g, unknown or other
  misc_feature (384)..(384): n is a, c, g, or t
  modified_base (390)..(390): a, c, t, g, unknown or other
  misc_feature (390)..(390): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
  modified_base (410)..(410): a, c, t, g, unknown or other
  misc_feature (410)..(410): n is a, c, g, or t
  modified_base (420)..(420): a, c, t, g, unknown or other
  misc_feature (420)..(420): n is a, c, g, or t
  modified_base (424)..(424): a, c, t, g, unknown or other
  misc_feature (424)..(424): n is a, c, g, or t
  modified_base (427)..(427): a, c, t, g, unknown or other
  misc_feature (427)..(427): n is a, c, g, or t
  modified_base (432)..(432): a, c, t, g, unknown or other
  misc_feature (432)..(432): n is a, c, g, or t
  modified_base (437)..(437): a, c, t, g, unknown or other
  misc_feature (437)..(437): n is a, c, g, or t
  modified_base (450)..(450): a, c, t, g, unknown or other
  misc_feature (450)..(450): n is a, c, g, or t
  modified_base (478)..(478): a, c, t, g, unknown or other
  misc_feature (478)..(478): n is a, c, g, or t
tcagtactctcgtgcacgaccggtgctcgatttagtctagcgactttgggtttggggggggagaggagcccagcactagaagtcggcggtgtttccattcggtgatcagcactgaacacagaggactcaccatggagtttgggctgagcttgggttttcctcgttgcttcttttaagaggtgtccagtgtcaggtgcactggtggagtcgtgggggaggcgtggtccagccgtggggagtccctgagactctcctgtgcagcctntggattcaccttnagttagcttttggctatcccacgtcggggtcccgccagggcctccgagggccgaaggggctagaggtgggtgcagttnatcatngatggagtaaatntatanggancgtcgngaaggctatacacntcncanagacatcaanacanagngatcngacanacgacagctagangtcgtagggacacgtctgtgtacttagnggtgacgtacggcgtcggctcggacaccgtacacgtaccgtagtttaccgggg

SEQ ID NO: 366 - DNA, 781 bp, Homo sapiens
  misc_feature: GYAE6OF02G7V1D.19.26.C04.1.454.CMB.1.raw
  modified_base (403)..(403): a, c, t, g, unknown or other
  misc_feature (403)..(403): n is a, c, g, or t
tcagtactctcgtgcacgaccggtgctcgatttagtctagcgactttgggtttggggggtgagggttgagaacctatgaacattctgtagggccaccgttctcctcctcggcctcctctctcactgcacaggctctgtacgacctccatgtggtcgactcagccaccctcaggtgtctacgtcggaccccgaggacgacggccggaccagggtacttcccgtagggtggggacgactaacgtttgattaagtaaagtgtcgacacgtacggtaccagtacaggacggccgtacggaccgaccggtacccctagttaccgtcggtactacgttactaacttaacgttaacgttacccggtcccggtccgttacgacgggtcctaccgtaggacgactacgttcncgttcggacctaccgtacgtccggtacgggaccaccggtccctaaccgtacccgggaccgtacgtaccggtaccggtaaccgggttaccggaaccgggttccggggtacgtacgggaaccggaccggtactttaacgttcgggtaccggtcgtagggtacgggtaggtaacgttggtaagtcggtacggtacgttgttacggttacggttacggttacggggtcgaacggtactacggtacgaggtaccctaggtacgtacgacgcccgtaagcccgttaccgtcccgtacgtcctacgttccgtacccggttcccaccgttacccgaggtacccttcgggtaacccgtcgtacgggttaccgccggttacgaccggg

SEQ ID NO: 367 - DNA, 804 bp, Homo sapiens
  misc_feature: GYAE6OF02JB3YD.19.26.C04.1.454.CMB.1.raw
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagccgtgggacggtcccctgacgactcctccgtgtgctacggccttcgtggtacttccaccttcaacggtagtcgtttggctactccctacgttcggggtccccgaccgtaggccctacccgagggtaccgaagggggtccttaagggaggggttacgggggtacgggaccgttaaaggtttaacgtacgttaccaaagtttaagtgggtaagttaaggggtaaaacggtttaaaaattaacgttagtttaacggtagggaaacgtaacccgttaccggtaacggggtaaacgggtcccgtaattacccgaaacccgtacttacccgtaccgaaacgtacgtaaaccttaacgttaaccgaaacgtaactaaaccggtaggtaacggtacttacgtacggtaactaaaacggtacgaaaccgtaccgtacggtaggaagtacgggtaccggaggggaaccgaccgggttattacgggtttacgttaacggtttacggttacggtcggtaaccgggtaacggtacggcccgggtacggttaccgggaaccttaaacccgtagttacccgttaacccgg

SEQ ID NO: 368 - DNA, 662 bp, Homo sapiens
  misc_feature: GYAE6OF02IPB10.19.26.C04.1.454.CMB.1.raw
  modified_base (180)..(180): a, c, t, g, unknown or other
  misc_feature (180)..(180): n is a, c, g, or t
  modified_base (198)..(198): a, c, t, g, unknown or other
  misc_feature (198)..(198): n is a, c, g, or t
  modified_base (545)..(545): a, c, t, g, unknown or other
  misc_feature (545)..(545): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcttgggttttcctcgttgcttacttttaagnggtgtccagtgtcaggtncacgtggtgagtcgtgggggagcgtggtccagccgtgggacgtccctggacgacctcctccgtggtcgactacgcccttgtaggtacttccacctttcgagtacgtcgtttaggactatccagtcgggccacgacgtctccgaggacgaacggggctaggaggtcgggtagctagttatactacgatagtgagtaggaaagttaaatattagtagtaggactacgtaccggtaggaacgggtacgtactacctaacctactaccgtacaagaactaactaaacgttaaccgaaacgtaaaccgtaacgacggttacggtactaccgtagaaccgaaactagaaaccngtacgtaaggtaggacgacgggtacggaacggtacgtcgttagtaagttcgttacgtcggtacggtacggtacggaccggacggtacgtacggtaacctaaccgtactacgtaccgg

SEQ ID NO: 369 - DNA, 719 bp, Homo sapiens
  misc_feature: GYAE6OF02F2GL7.19.26.C04.1.454.CMB.1.raw
  modified_base (373)..(373): a, c, t, g, unknown or other
  misc_feature (373)..(373): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagactaactttgatagtaaaagtgtagcactggtaccagcagacggccaggccgacggcccctatacgtggtccatactattataactaccgtcccggccctcgacgggtactccctgagccggactctcgtcggctacccactcgtacgggtaaccnccgggacctacccgtacgtaccgtcgacgacggtacgggtaacgacgggaccggggtaatcggacgggtcccggaactttacggtttaccgtacggtaccgtaggggttcgtaaggggttactaggtagggttacgggtaccggtcgaagttcggttaggttacggttttccggggaacgggtccgggaaacctaggtcgtaccggaccggtccgtacggtcgaccgacccggagtccgtccccggtccccgtcggtacctccgtaccgtttcccggtccccctacccgtaccctacccgtaaccgaggttaccctacgtccgggacggtcccgggtagacccggg

SEQ ID NO: 370 - DNA, 735 bp, Homo sapiens
  misc_feature: GYAE6OF02H1KY4.19.26.C04.1.454.CMB.1.raw
tcagtactctcgtgcacgaccggtgctcgatttagtctagcgactttgggtttgggggtgagggttgagaacctatgaacattctgtaggtgccaccgttctcctcctcggcctcctctctcactgcacaggctctgtgacctcccatgtggtgactcagccaccctcagtgtcagtcggccccaggagacgacggccgaggacttcccgtggtgggggagaacaactttgagtaagtaaaagtgtgcacgtggtaccagcgagaggccgagccgacggccctataacgtggtacattctaattaataaactaccgtaccgccctcaggtactccctgagcgtactctcgtcgcctacgtactcgtaggaacgaccggtacccaccgttcgaccgtcagtacgacgggtacgaacggcgggtagacggtacggaccgtacgttaacgttaccgtgtacggtacgggttggtagggtacgttaaggtaaggtacgggtccggtagtaacggttcgttacggttacggttttccggggacggggtaaccgggtaacctaacggtccgtaaccgggttaacccgtacgttaacccggtccgtaaaccggacccggtaaacgtcccgttccggtaccccgtcccggtacgttacccgttaccgttcccgttcccctacccccgttaccgtaccccgtagtaccggtaaccgttaccggacggtacgggcccggttacgg

SEQ ID NO: 371 - DNA, 748 bp, Homo sapiens
  misc_feature: GYAE6OF02HNCHO.19.26.C04.1.454.CMB.1.raw
  modified_base (173)..(173): a, c, t, g, unknown or other
  misc_feature (173)..(173): n is a, c, g, or t
  modified_base (220)..(220): a, c, t, g, unknown or other
  misc_feature (220)..(220): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtntcagtcggccccgaggagacgacggccaggacttccctggtgggganacacgtttgataagtaaaagtgtgcacgtgtaccagacgagacggaccgacggccgaccggcccctaagtacgtggtactactcttaattactaaacgtaccccgtacccggtccctcgaacgggaccttcccgtaggacgccgtaccttctccgtcggcctaccgtaacctcgtacgggaacctaccggaccctacccgtacgacccgtcgacgacaggtcggtacgaacgggccgggtatacgggaccggtaccgtaactttaacgtttacgtacggtaccggtagggtacgggttacgggaagtttaacgggtaggtacggtaccggtacttacggttggtacggtttacggtttcggggtaccgggacggtaacgtacggtccgtaccggtaccgttaccggtacgtccgaccggtaccgacggtcccgtcccgtaccccgtcggtaccttacccgtccgttcccggtccccgtcccttacccgtcccgtaacggaccgtacgtaaccgtcggacccggtcggg

SEQ ID NO: 372 - DNA, 774 bp, Homo sapiens
  misc_feature: GYAE6OF02HW1WY.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtcggcccaggagagaccggccaggacttccctggtgggggacactaactttgaataagtaaaagtgtgcactggtaccagcagacggccaggccacggccctatacgtggtcatctattatactaccgtccgcctcgacgggtctccgtgacgcgactctcgtcgcctaccaacgtcgtagggaaccaccggaccctacccgtacggaccgttccgacggaccggtaacgggggttaccggaaacggggtcccgggggtagtacgggtaacggggacccgtaacgtttaacgtttaccggtacggttacggtacggggtttagggtaggggtaacgttaacgggttacgggttaacgggtccggttaacgtacggtttacgggtaggtttacggttttaccggggacggggtacggggaacccgaaggttcgtaccgggtacccggttaccgttacggtaccgtaccggaacccggtacggtccgttaccccgggccccgttaccgggttccctacccgttccggttccccgttccccggtcccttcccgttaccggacggtacgtaccgttacgtcgggtaccggtaccgggtcgg

SEQ ID NO: 373 - DNA, 766 bp, Homo sapiens
  misc_feature: GYAE6OF02GNIOJ.19.26.C04.1.454.CMB.1.raw
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcttgggttttcctcgttgcttcttttaagaggtgtccagtgtcaggtgccaccgtggtggaggtcgtgggggagcgtggtccaggccgtgggacggtccctgacgacctcgtcctgtgcacgcctctggattccaccgtttcagtagtcgtttcggctatccacggtcgggtcccgccgtacggccttcccggaggaccggaaaggggtcgtaagggtacgggtggggtaggtaccgtaaggtttaactagttactaagttaagtggtaagtaggggttaaaaggttaaaaattagtttaaagttacgtagggtaacgtaaccggtaccggtaggaaacggggtccgtaacgttaccgtaaccctagtacccttaccgagaacgtaaacctaagttaaacccgaaacgtaaccgaaacaggttacgtactacgtacgaaactaaacgtaacgaacgtaacgaccgtaaggtaacgaacggtacggtaccgggaacgtaaccgggtacgtacggttagttaaaccggtttacggtacggttacgggaaccggtaacggtacggtcccgggtaacggtaccggaaccgttaaaccggtaccgttacccgttaaccccgg

SEQ ID NO: 374 - DNA, 823 bp, Homo sapiens
  misc_feature: GYAE6OF02HP6YS.19.26.C04.1.454.CMB.1.raw
  modified_base (197)..(197): a, c, t, g, unknown or other
  misc_feature (197)..(197): n is a, c, g, or t
  modified_base (758)..(758): a, c, t, g, unknown or other
  misc_feature (758)..(758): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagctgggttttcctcgttgcttcttttaaggaggtgtccagtgtcaggtncacctggtggagtcgtgggggagcgtggtccaggccgtggggacggtccctgagacctcctccgtgtgccgcgcctcgtaggtacttccaccttcgaagtacgtccgtttggccaattcccaacgttcggggtaccccgaccgaacggtcctacccggaagggccgaaagggggtacctaggaacgggttcggggtagcgttaaaggttatacgtacaagttacgtaggaaagttaagggggaaaaaggtttaaaaacttaagttaaagtttaaggaacggtaacggtacccggtacggtaacggggtaacgggtaacccgtacttacccgaacccgtaacgttaccgtaccctaaaggtaaaccgtaaaccttaagttaaaccccgaaaagtaaacccgaataaaggggttacgtaacgtaaccgacgtaaacctaaaagaccgtaaacgaccgtaccgtaagacgggaaaccgggtacgggtacggggtaaccgaccgggttgttacgggttaacggtttaaccgttaacgggtcggttacgggacgggttaaaccggngggtaccgggtccggtaaaccgggtaaccgtaaaccccggttacgtaccccgttttaaacccggg

SEQ ID NO: 375 - DNA, 848 bp, Homo sapiens
  misc_feature: GYAE6OF02J0K9L.19.26.C04.1.454.CMB.1.raw
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagcccaccctcagtgtcagtcggccccaggagaggacggaccgaggacttcccgtggtgggggacgactaactttagagtaagtaaaagtgtcgcacgtagggtaccagcgaggacggaccgacgggaccgacggccccgtaatacgttcggtactacgttacttaacgttaacttaaacgttacccggtaccccgggtacccttacggacgggtaccgttacccgtacggacgtaccggtacctaccgttccggtacggaccttcccgtaacgtaccgtacggggaaccgaccgggtacccgtacccgtaccggtaccggtacgacggaccggacgggtacggaacgggaccggggacgtacgggacgggaccgtacgtttacgtactcggtacgtacgggtagggtaggaagtaggtaggtacggtcggtactaggtagttcggttaaggtttccgggacggggtaacgggtaacctaacggggtacttaccgggacccgggttaacggtaccgggtcgtaaaccccgggtacccgggtaacggccccgttcccggggacccccgtttaccgggttaccctaaccggtttacccggttccccggtacccctaccccgtttaccccgaccgtaaccgggtcggtaacccggtacgtacgggaccgggtaccgggtaccgtaccgggg

SEQ ID NO: 376 - DNA, 768 bp, Homo sapiens
  misc_feature: GYAE6OF02HA0WA.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctccatgtggtgactcagccaccctcagtgtcagtcggcccaggagagacggccaggacttccctggtgggggacactactttgatagaaagtgtgcatggaccagcagacggccaggccaggcccctataccgtgtacatcgtattataactaccgtccggccctcgagggactccgtagtacggcgaacttctactcggtctaccctaaatccgtggggaaaccctaccgggacccctaccccgtgtaacccggtcgacggtaccgggaacggggtaccgtaacggggtccccgggggtaagttacgggaacgggacccgaacgtttaaacgtttaccgtacgggttaccggaaggggtttacgggtaccggggtaaggtttacggttaaacgggttacggtccggttacgaacggtttcgggttacgttaggttttccggggacgggtaaccggggtaaccgtaacgggttccgtaacgggtaccccgttccggtaacgggtcgaccgggttacccgaaggccgtttacccgacccccgttacgggacctttcccggttaaccgttcccgtttaaccccggaccccctttacccgtcccgtaaccggttaaccgg

SEQ ID NO: 377 - DNA, 755 bp, Homo sapiens
  misc_feature: GYAE6OF02JDZDO.19.26.C04.1.454.CMB.1.raw
  modified_base (203)..(203): a, c, t, g, unknown or other
  misc_feature (203)..(203): n is a, c, g, or t
  modified_base (326)..(326): a, c, t, g, unknown or other
  misc_feature (326)..(326): n is a, c, g, or t
tcagtactctcgtgcacgaccggtgctcgatttagtctagcgactttgggtttggggggtgagggttgagaacctatgaacattctgtagggccaccgttctcctcctcggcctcctctctcactgcacaggctctgtgacctcccatgtggtgactcagccaccctcagtgtcagtcggccccaggagacgacggccaaggnttccctggtgggggagacaactttgataagtaaaagtgtgcactggtaccagcaggaggccaggccaggacccctagtactggtcatctattataagtaccgtccgcctcgagggactcctgngcgtactctctcggctccaactcgtaggacgaccggccaaccgcgaccgtaccgagacgtacgggtacgaacgggtaccgggtaacgtcgacgggacccgtaactaacgtttacgtggtacgtaagggtgggtaccgggtaaagttagggttaaggtaacgggtcccgggtttaaacgtaggttaggttacgggttacgggtttacgggggtaccgggaacgggtaaaccgtaagggtccggtaccggttaacccggttacgtaacggtaccgaaccgggtaaccgtaacggtcccgtacccgtccccgggttaccgttacctacccgttacccggttcccgttacccctaaccccggttcccgtaaccgtaaccggtaacggttacccggttaaccgtacggtacccgggtccgggtaccgtaacggg

SEQ ID NO: 378 - DNA, 802 bp, Homo sapiens
  misc_feature: GYAE6OF02JFXO0.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagcccaccctctagtgtcagtcggccccaggagagccggcacggacttcccgtggtgggggagacctaacttgagtacgtaaagtgtagcactggtaccagcagaggacctaggccacggcccctatacgttggtaccgacttacgtattactaacgtaacccgtcccggcccttacgacgggtacctccccgtagacgaccgtacctcgttaccgtcggtactacctaaccgttccggttagggaaaccgacccggtaccccgtaacccggttccgtacccggtacgtacggaccggtcggtaccggaaccggggtaccgggggtactcgggaaccgggccgtttaactaaccggtttacgtacgtacggtaaggggtttcgggaggttaacggtaaggttaccgggtagggtacccgtagtaacggttgggtttaggttacgttttcccgggggaacgggggacgggtaacccgaacggttccgttccggggtacccttaccgggttagaccgacccggtaaccgtaccggggtcccttaaccccgggtccccggttaccggtaccgttaccgtttcccgtttaccccgttcccccgtacccccgtttacgtacccccgggaggtaacccggg

SEQ ID NO: 379 - DNA, 658 bp, Homo sapiens
  misc_feature: GYAE6OF02F9O1K.19.26.C04.1.454.CMB.1.raw
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagagacggcaggattccctggtggggagacaacttgatagtaaaagtgtgcacgtggtaccagcaggacggccacggccacggccctatactggtcatctattatataccgtccgcctcgaggctcccgtgacgcgtactcgtcgtcgcctaccaactcgtacgggaaccaccggcccacccgtcgacccgtcacggcgagggtaccgaacgggccggggtatcgggacggtccgtaacttacgttacgtgtacgtagggtggtaggtagtaggtagtggtacggtcgagttggtagttaggttcgggcgggtaggacaggtctacggtaccgtcgtacggtaccgacgtaccggaacgtccgtaccgtcccgtcggtaccgtaccttccggttcccgttccccctacccgttccccgtaccgtaaccggtacgtaacggttaccgtggtaccggtccgggtcgtacggg

SEQ ID NO: 380 - DNA, 946 bp, Homo sapiens
  misc_feature: GYAE6OF02GUZAF.19.26.C04.1.454.CMB.1.raw
  modified_base (163)..(163): a, c, t, g, unknown or other
  misc_feature (163)..(163): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtcacctccatggtggtnactcgacgcccacctcgagtgtcgaggtcggacccgaggagaggaccggaccgaggtaccttcccgtgggggtaggggggaactaaccttaaacggtttagtaaagttaaaaggtaaaaacggttcggtacgacctaacggttacgggtaaccacggacaaggggaaccggccggaacgggaccgaacccgggtaccccctttaaggtaaccggttcggtactaacgtttaccttaaaacgtttaacgtaaaacccgttaccccgggtcccccgggtacccgttacgggaacgggttacctccccggtaagtacgggtaccgtaccgttccgttaccggtaccggtacccttaaacccgtaacggttaccggtaacggggaaacccgtacccggtacccccgttaaccggtaaccggaccccgttaacggaacggtaccggggtaacgggtaacggaacccggggtaaccggggtacgtaacgggtaaccggacgtaaccgtttaacgttacgtacgggttcggaaggggttggtacgggtaaagtacgggttaacgtacgggtacggtaacgttacgtacgggtttacgggttacgggttacggggaacgggtaacgggtaaccgtaaggtaccgttaaccggtaccggttaaccgtacgggttacccggacctaacggtacccgggttcccgtacccggtacccccggttacgggttacccaacggttttccctccccggttaacccttacccccgtaccgtacccggtaacggtaaccgg

SEQ ID NO: 381 - DNA, 811 bp, Homo sapiens
  misc_feature: GYAE6OF02FPX94.19.26.C04.1.454.CMB.1.raw
  modified_base (162)..(162): a, c, t, g, unknown or other
  misc_feature (162)..(162): n is a, c, g, or t
tcagtactctcgtgcacgaccggtgctcgatttagtctagcgactttgggtttggggcctgggagaggagcccagcactagaagtcggcggtgtttccattcggtgatcagcactgaacacagaggactcaccatggagtttgggctgagctgggttttccncgttgctcttttaagaggtgtccagtgtcaggtgcaccgtggtggagtctgggggagcgtggtccagcctgggagtccctgagactctcctgtgcagcctctggacttcaccttcagttacgcgtttggctacttcccacgttcggggtcccgccgagggtccttacccgaagggccgaaaggggggtcctaagggacggttgggggtcggacctaaggtttaactacgttcgaagttagtcggtaagttacggggtaaaggttaaaaacttagtttaaagtttaagtacggggtaaacgtaaccgttaccgggtaagggaaacgggggtcccgtaacgtttacccgaacccgtaacgttacccgttacccgaacggtaaaccggtaaacgtaaaccgtttaaccccgaaaacggtaaacccgtaaaccggtaacggttacgggtaacttaccgtacggtaaacctaaaacgtaccggaaaaccgtacggtacccgtacggtaacgtaacgggtaccggtacggggaaccgtaaccgggtacgttaggttacggttaacgtttacggtacggttacggaacggtaacgggtaacgggaccgggtaccggtaccgggtacctaaaccggttacccgtaccgttaacccgg

SEQ ID NO: 382 - DNA, 619 bp, Homo sapiens
  misc_feature: GYAE6OF02F26EY.19.26.C04.1.454.CMB.1.raw
  modified_base (242)..(242): a, c, t, g, unknown or other
  misc_feature (242)..(242): n is a, c, g, or t
  modified_base (424)..(424): a, c, t, g, unknown or other
  misc_feature (424)..(424): n is a, c, g, or t
  modified_base (430)..(430): a, c, t, g, unknown or other
  misc_feature (430)..(430): n is a, c, g, or t
tcagtactctcgtgcacgaccggtgctcgatttagtctagcgactttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtctggggaggcgtggtccagcctgggagtccctganactctcctgtgcagcctctggattccaccttcagttagctttggcatccacgtcgggtcccgcaggcctccaggcgaaggggctaggaggtggggtggctaggttatatcatagtgatagggaacgtaaaatagtaattagtaggagtactccggtaggaacgggccgtataccacctatcncgaganaactaacttacaaagacacgagtgatcgtagactaaagtagaacgcgacctaggacgtaggcggtagggaccgacggtcgttacgttagttcgttaaccgtgggtaaccgacggtacggtacgggtacgggtaccgtcgggaaccctaaccggtaaccgtaccgttacccgttaaggttttacccgggg

SEQ ID NO: 383 - DNA, 641 bp, Homo sapiens
  misc_feature: GYAE6OF02HWCQW.19.26.C04.1.454.CMB.1.raw
  modified_base (370)..(370): a, c, t, g, unknown or other
  misc_feature (370)..(370): n is a, c, g, or t
  modified_base (620)..(620): a, c, t, g, unknown or other
  misc_feature (620)..(620): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagccaccctcagtgtcagtcggccccaggagagacggccaggacttccctggtgggggagacaactttgataagtaaaagtgtgcactggtaccagcgagaggccaggccacggcccctatacgtgcatctattataataccgtccgccctcgaggactcccgtagagcgtactctcgtggcctccaactcgacggaccgaccgccaccncgaccgtcagccgaagggtaccgaagggccggggatacgggacggtaccgaacttacgttactggtaccgtgggttacgggttagggaagtagttaggtaagcgggttcagttggtagtttagtttccgggacgggtacgggacaaggtcgtacggtaccgtccgtagtcgacgtccgaaggtcctccggtcccgccgttacgacctccgtcctaccccctaccctccctaccgcgacgtacggttaccnggacggtccgggtcgtaccgg

SEQ ID NO: 384 - DNA, 837 bp, Homo sapiens
  misc_feature: GYAE6OF02FLQVS.19.26.C04.1.454.CMB.1.raw
  modified_base (229)..(229): a, c, t, g, unknown or other
  misc_feature (229)..(229): n is a, c, g, or t
  modified_base (318)..(318): a, c, t, g, unknown or other
  misc_feature (318)..(318): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgaccctcccatgtggtgacctcagcccaccctcagtgtcagtcggccccaggagagacggccgaggtacttcccgtgggtacggggganacgtaactttgatacggtaaaagtgtgtcacgtgtaccgagcgagacgccgacggccgaacggtcccctaagtaccgttcggtacactnttaactttaagtaaccgtaccggttccccggccctacgacgggtacctcccggtacgagtaccggtactcctacgccggtacctacctaaccgttccggtagggaaccacccgggtcccacccgtcggtaacccgccgtagtaccggtacgggtacggtaacgggacccggggtagtcgggaacgggcccgtaagttaacgtttccgttacggtcggacggttagggtaacgggtaacgtaaggttacggtacgggttaccgtagtacggttaggggttacggttagggttttccgggacggggtcgtaaccggaacggtcggttacggtaccccgttaaccggtacgggttaccaccggttaacccaaccgggttcctacccggacccccgttccgggtaccccttaccgttcccggtttaccccgggtccccctcccccccgggttaacccgtaccggttaaccgggtacctttacgggacccgtttacgggcccgggtacggtacccgggaacggg

SEQ ID NO: 385 - DNA, 735 bp, Homo sapiens
  misc_feature: GYAE6OF02ILGPF.19.26.C04.1.454.CMB.1.raw
tcagtactctcgtgcacgaccggtgctcgatttagtctagcgactttgggtttgggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcacctggtggagtcgtgggggaggcgtggtccagcctgggacggtccctggagactctcctgtgcagcctctggtacttccaccttcgagtagtctttggctatcctacgttcgggtcccgcaggcctaccgagggccgaaggggctaggaggtgggtcgcgtagttatatactatagtagagtaagggtaaagtaaaatattaacgttagtaggtacgtacgttccggtaaggaaccggggcctaattaccaaccgtacttaccgtacccgaaggtaaacgtaacctaaacttacccgaaaagtaacccgtaacgtaacgggttacggtaacttaccgtacgaaaccgtaaaagtaccgaaacgtacggtacccgttaaggaacggtacggtacggtaacgggggtaaacctacgggtacgttagggttacgttacgtttaacggtcgggtacggacggaacgggtaccggtaccggtacggttacggaaccctaaacgtaccgtaaccgtttacccggttaacggttttaacccgggg

SEQ ID NO: 386 - DNA, 668 bp, Homo sapiens
  misc_feature: GYAE6OF02G7OKD.19.26.C04.1.454.CMB.1.raw
  modified_base (372)..(372): a, c, t, g, unknown or other
  misc_feature (372)..(372): n is a, c, g, or t
  modified_base (420)..(420): a, c, t, g, unknown or other
  misc_feature (420)..(420): n is a, c, g, or t
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcaggacggccaggccaggcccctatactggtcatctattataataccgtccgccctcagggactcctgagccgactctctggctccactcgtagggaacacggccacccgtgacccgtnacgcgagggtcgaaggccggggatgacgggacgactattacgtgtcgnggtgtgggattaggtaggtacggcggtacgtgttacggtggttacgttttcggacgggtacggggaccaacggtcgtacggtacccggttaccgtacggttaccgaccggtacccgaaggcccggttcccgtacccccgttccggttcctaaccgtttccgtacccgtttcccccaacccgttccccgtaccccgtaacggtacggtaaccgttaccgtacggaccggggtacggtcggttaaccggg

SEQ ID NO: 387 - DNA, 803 bp, Homo sapiens
  misc_feature: GYAE6OF02HU53S.19.26.C04.1.454.CMB.1.raw
  modified_base (222)..(222): a, c, t, g, unknown or other
  misc_feature (222)..(222): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctccatgtggtgactcagccaccctcagtgtcagtcggccccaaggagagacggccaggtacttcccgtggtaggggganaactaactttgataagtaaagtgtagcacgtaggtaccagacgaggacggaccacgggaccacggaccccctagtaccgtggtactacgtacttaattaataacctacccggttcccggtaccctacgacggtacctcccgtaggacgaccgtactcgtacgtcggtcctaccgtaacgttcggtacggaaccgaccgggaccctaacccgtcgtacccgtacgtacggaccggtaacgggtaaccggaacgggacccgggtagtacgggaacggacccggtaactttacgttaaccggtagttaccgggtaggttacgggtaggtaacgttaggttaaggtacgggtacgttacggtgttacggttacggtttacggtttaccggggagggttaacgggaccggtaacggtcggtaccggtaaccggtaccggtacggtacgtaccggaccgtaacggtccgtacccgtccccgttacggtaccgtcgttacccggttcccgttacccctaccccgttcccgacccggtaacggttacgtacggttaccgtcgggtaccgggtccggacggttacccggg

SEQ ID NO: 388 - DNA, 682 bp, Homo sapiens
  misc_feature: GYAE6OF02JPVS5.19.26.C04.1.454.CMB.1.raw
  modified_base (497)..(497): a, c, t, g, unknown or other
  misc_feature (497)..(497): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgaccctcccatgtggtgactcacgccaccctcagtgtcagtcggcccgaggagacggaccggccgagggacttccccgtgggtcggggggagaacctaactttggaattaaggtaaaaggttgtggacctacgtacggtaccaggacgaaggacggaccgaggcccgaccggacccctagtacgtggttacattactaacttataacgtaccccggtccggtacccgtcgacgggtactcccgtcgagcacctctaccgtgcctactactcgaggaacaccgcccaccgcgtacgtcacgcgacggccggaaggccgggagtcggacggaccgtctaacgtcgtgtacgnggttcggaggtacgtaaggttacggtaggtacgtcgtagtcggtgttacggtttccgggacgggaggacgtaacgtcggtacgaccggtacgtacggtaccacgtaccggacggtcccgttccgtccccggtcgtctaccttccgggtaccccgttcccctccctccccgtacgtaccggtaccg

SEQ ID NO: 389 - DNA, 725 bp, Homo sapiens
  misc_feature: GYAE6OF02HJMBD.19.26.C04.1.454.CMB.1.raw
  modified_base (296)..(296): a, c, t, g, unknown or other
  misc_feature (296)..(296): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtcggcccagagagacggccaggactccctggtggggagacaacttgataagtaaaagtgtgcactggtaccagcgagagcaggccaggcccctaatctggtcatcgtatanaataccgtccgcctcgaggtactccctgacgcgactctacgtcggctaccaacgtccgtagggaaaccacggcccctaccgtacgacccgtacgagcgaacggggtacgaacggtcccggggattacggacgggaaccgtaaccgttaacgttaaccgttcggtaccgtagggttacgggttagggaagttaacggttaaggttacggtacggttaccgtagttcggttaaggttacgtttttacggggcgggtaaacgggaacccgtaaaggtccgtaacggttaacccggtaccgtttaacggggcctaaccgggaaccccgtaacgggcccgtaccccggtacccccggttaccgggtaccctaacccggttccgttacccggttcccccgtacccccgttacccgttacccgaccggtaacccgg

SEQ ID NO: 390 - DNA, 708 bp, Homo sapiens
  misc_feature: GYAE6OF02IUOUC.19.26.C04.1.454.CMB.1.raw
  modified_base (336)..(336): a, c, t, g, unknown or other
  misc_feature (336)..(336): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcttgggtttcctgttgctctttaagaggtgtccagtgtcaggtgcaccgtggtgagtcgtgggggacgtcggtggtccaggtccgtgggacggtccctgaacgtacctcgtcctgtcgacacgtcctcgtcgtacttcctaccgttctaggtacgtcgttacggctactccgtacgttcgggtcccncggacgtccgtacgacgggacgaacggggtctagggacggtgggtcgacgtaggttatactacgtagttgtaagtagtacggaaagttaaatattagttagaggtaactcgttacggtacgggacggtacctaagtaccctaacgtactaccgactacggaactaactactaacgaacaacgtagtacgtacgctactacgaacaagtacaagtaccgtacgaacgtaggaccgggtacggaaccgggtaccggtacgttcgtagggttacgtttacgttaacggtcggttaacgggtaacggtacgggtacggttaccggtaccggttcggtaaacccgtaaccgttaaccggtacccgtttaaaccgggg

SEQ ID NO: 391 - DNA, 645 bp, Homo sapiens
  misc_feature: GYAE6OF02FU632.19.26.C04.1.454.CMB.1.raw
  modified_base (350)..(350): a, c, t, g, unknown or other
  misc_feature (350)..(350): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggcccctatactggtcatctattataataccgtccggccctcagggatcccctgagcgactctctggctccaactcgtcggaacnccggcccaccctgacccgtcacgccgagggtcgaaggccggggatggacggccgaacttattactgtcgaggtgtagggagtagtaggtagcggtacgagttgttgtagttttcgggcggacgggtaccaacggtcgtacggacccgttccgtaggttccgacgacccgaacggtccgtccgcccccgttcggtccctaccgtccgttccggttaccccctaccccgttccccgttaccccgtaccgaccggttacggttaccgtacggaccggtacccgggtcgtaacccgggg

SEQ ID NO: 392 - DNA, 598 bp, Homo sapiens
  misc_feature: GYAE6OF02F92MH.19.26.C04.1.454.CMB.1.raw
  modified_base (351)..(351): a, c, t, g, unknown or other
  misc_feature (351)..(351): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtggccccaggagagacggccaggattccctgtgggggagacaactttgatagtaaaagtgtgcactggtaccagcagaggccaggccaggccccctatactggtcatctattataatacccgtccggccctcagggatcccgtgagcgactctactggctccaactctggaacncggccaccctgacctcagcaggtcgaaggccggggatggaaggccgactagttacgtgtcgaggtgtgggatagtagtaggcggtcagtgtgtgttttcgggcggacgggaccaagcgtacggtaccgtacgtaacggtcgacgacccgaacggcgtaccgccccgtaccggtccacgttccttccggttcccctaccccgtaccctacccgacgtacggtaccgtaccgtggtacggcgggtccgg

SEQ ID NO: 393 - DNA, 723 bp, Homo sapiens
  misc_feature: GYAE6OF02I7KM7.19.26.C04.1.454.CMB.1.raw
  modified_base (201)..(201): a, c, t, g, unknown or other
  misc_feature (201)..(201): n is a, c, g, or t
  modified_base (290)..(290): a, c, t, g, unknown or other
  misc_feature (290)..(290): n is a, c, g, or t
tcagtactctcgtgcacgaccggtgctcgatttagtctagcgactttgggtttggggggggagaggagcccagcactagaagtcggcggtgtttccattcggtgatcagcactgaacacagaggactcaccatggagtttgggctgagctgggttttcctcgttgctcttttaagaggtgtccagtgtcaggtgcactggnggagtcgtgggggagcggtggtccaggccgtgggacggtccctgacgtactctccgtgtcgcgacgtcctcgtggtacttccaccgttnagtcgtctttggctactccacgtcgggtcccgcgtacggccttaccgagggacggaaacgggggtcctaagggtggggttgggtcgggtaccgttaaggtttaattacgttacgtaaagttacgttcggaaggttaaggggtaaaaacggttaaaaaatttcgttaaaggtttagtaagggtacgttaacccgtaccgggtaagggtaaaccggggtcctaaactttccgaaccgtaacttcctaacggaagtacgaaccttaaacgtaaccggaaacgaaccgtacggtaacggtgtaacttcgtaacgaactaaagtaccgaacgagtaccgtaggaccgtaagggcggtaacggggactacggtcgtgtacgttcgtgtacggtgtaagacgcggccgtagcggtacaactcgtacttccgtaggttcgg

SEQ ID NO: 394 - DNA, 704 bp, Homo sapiens
  misc_feature: GYAE6OF02FPTFU.19.26.C04.1.454.CMB.1.raw
tcagtactctcgtgcacgaccggtgctcgatttagtctagcgactttgggtttgggggggtgagggttgagaacctatgaacattctgtaggggccaccgttctcctcctcggcctcctctctcactgcacaggctctgtgacctcccatgtggtgactcagccacactcagtgtcagtcggccccaggagagacggccaggattccctggtgggggagactaactttgataagtaaagtgtgcactggtaccagcaggaggccgaggccacggcccctatactggtcatctattataactacccgtccggccctcgagggactcccgtgacgcgactctcgtggcctaccactcgtaggaaccaccggacccacccgtcggacccgtacacggacgacggggtaccgaacgggccggggatacgggacggaccgtacttacgttacgtgtacgtagggttaggtgggtaagttaggtaggtacggcggtacgagttggtcgttacgttttcgggacgggtaacgggaccgtaacgtcggtacgtacccggttcgttacggtaccgacggtacccgaacggtccgttcccgtcccccgttcgggtaccctaccgttcccgttccggttacccccctaccccgttcccgtacccggaccggtaacggtaaccggttaccgtacgggaccgggtcggggtacccgg

SEQ ID NO: 395 - DNA, 851 bp, Homo sapiens
  misc_feature: GYAE6OF02GN7AB.19.26.C04.1.454.CMB.1.raw
  modified_base (225)..(225): a, c, t, g, unknown or other
  misc_feature (225)..(225): n is a, c, g, or t
tcagtactctcgtgcacgaccggtgctcgatttagtctagcgactttgggtttggggggtgagggttgagaacctatgaacattctgtagggccaccgttctcctcctcggcctcctctctcactgcacagctctgtgacctccatgtggtgactcagcccaccctcagtgtcaggtcggccccagggagaggaccggccgaggtacttcccgtgggtggggganaactaacttttgataaagttaaaaggtgtagctacgtcggtaaccagccgaaggacgggaccgacgggcccgacggacccccttaagtaccgttcgggttacctacgttactttaagttaattaaacgttaccccggttccccggtacccctcggtaacgggggtaccttcccgtagacggccggtacctccttcgtggtcccttaccgtaaccgttcggtaagggaacccgaccgggtacccctacccgtacggtacccgtacgacggtcgaacggggtcggaaacgggcccgggggtaatcggggtaacggcccggtaaacgtttagtttaccgtgtaccggtaagggttcgggtaagggtaagttaaggtacggttacgggtcgggttactaggttagggtttaggttacgggtttcggggtaccgggaacgggtaaccgtaacggtccggttacgggtacccgttacggtacggttaccgaccgtacccgtaacggtcccgtaccgtcccccgttacgttacccgtaccttacccggtcccgttacccccgtaccccttacccgtacccgtaacggtacgtaacggttaccgaccgggtacccgggtcgggccggtaccggg

SEQ ID NO: 396 - DNA, 764 bp, Homo sapiens
  misc_feature: GYAE6OF02GY12P.19.26.C04.1.454.CMB.1.raw
  modified_base (219)..(219): a, c, t, g, unknown or other
  misc_feature (219)..(219): n is a, c, g, or t
tcagtactctcgtgcacgaccggtgctcgatttagtctagcgactttgggtttggggggtgagggttgagaacctatgaacattctgtagggccaccgttctcctcctcggcctcctctctcactgcacaggctctgtgacctcccatgtggtgactcaggccaccctcaggtgtcagtggccccaggagagacggccaggacttccctggtggggganacaactttggataaggtaaagtgtgctactcggtaccagcagacggccaggccacggcccctatacgtggtcatcttaattataacttaccgtccggccctcgacggtactccctgacgcgtactctcgtcgcctaccactcgtacggaaccaccggcccacccgtcgaacccgtcgacgaccgagggtaccggaacgggtccggggtaatacgggacggtcccggtaacgttagtttaaccgtgtccggtagggttagggttaggaacggtttaagggtaagggtacgggtacgggtacgtaacgtgggtttacgttaacggttttcggggaaccggggacggggtaaccgtaggttcccgttacggggtaaccccttcgggtaaccgggtactaacccgggtacccgtaacgggtcccctacccggtcccccgtaaggttccccgtaacgtcccggtttacccggttaccccctaccccgttccccgttaccgaaccggttacgacggttcccgtggggacgggtccgggtacggtaccgggg

SEQ ID NO: 397 - DNA, 568 bp, Homo sapiens
  misc_feature: GYAE6OF02FHEDJ.19.26.C04.1.454.CMB.1.raw
  modified_base (338)..(338): a, c, t, g, unknown or other
  misc_feature (338)..(338): n is a, c, g, or t
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgacctcccatgtggtgactcagccaccctcagtgtcagtggccccaggagagacggccaggattccctggtgggggagacaactttgatagtaaaagtgtgcactggtaccagcagaggccaggccaggccccctatactggtcatctattataataccgtccgcctcagggtatccctgagcgactctcnggtctccaactcgtggaaccacggcccacccgtgaccgtcagcacggggtacaggccggggatggaggccgactattctgtcaggtgtggatagtagtagcggtcagtgtgtagtttcgggcggagggacctaagctacggaccgtccgtaggtcacggacccgaggtcctccgacccccgtggtcccacgtcgttccgttcccccgcccttccctccgtacgtaaccgg

SEQ ID NO: 398 - DNA, 797 bp, Homo sapiens
  misc_feature: GYAE6OF02F14K5.19.26.C04.1.454.CMB.1.raw
  modified_base (269)..(269): a, c, t, g, unknown or other
  misc_feature (269)..(269): n is a, c, g, or t
  modified_base (276)..(276): a, c, t, g, unknown or other
  misc_feature (276)..(276): n is a, c, g, or t
tcagtactctcgtgcacgaccggtgctcgatttagtctagcgactttgggtttggggctgggagaggagcccagcactagaagtcggcggtgtttccattcggtgatcagcactgaacacagaggactcaccatggagtttgggctgagcttgggttttcctcgttgctcttttaagaggtgtccagtgtcaggtgccacgtgggtggagtcgtggggggaggcgtggtccaggccgtggggacgtcctggacgacctctcctggtgcncgtcctntggacttcctaccttcagttcgtcgtttggactagtccccgacgtcggggtaccccgccgacgggtcctaccggacgggacggaacgggggtacctagggacggtgggggtcggacgttaaggttatagtacctaagttaagtggtaacgtagggtaaagtttaaaaatgtttaaagttacggtagggaacgttaacccgtcgggtaacgggtaacgggtcccgttaacttacccgtaacccgtaacgtaccccgtaacgaacggaacgttaaaccgtaaaccgttaaacccgaaaaggaaacccgaacgtaacgggttacgtaacgttaccgtaacggtaaacgtaaacgtacgaaaccgtacggtacgtaacgggaacgaacggttaccgggtacggggaacccgacgggttacgtacgggttagtaaccggtttcggtaacggttagggaccggtaagggtccgggacggttaccggtaccggtaaacccggtaaccgttaccgtaaccgttaaccgg

SEQ ID NO: 399 - DNA, 628 bp, Homo sapiens
  misc_feature: GYAE6OF02IW0JE.19.26.C04.1.454.CMB.1.raw
  modified_base (253)..(253): a, c, t, g, unknown or other
  misc_feature (253)..(253): n is a, c, g, or t
  modified_base (259)..(259): a, c, t, g, unknown or other
  misc_feature (259)..(259): n is a, c, g, or t
  modified_base (275)..(275): a, c, t, g, unknown or other
  misc_feature (275)..(275): n is a, c, g, or t
  modified_base (507)..(507): a, c, t, g, unknown or other
  misc_feature (507)..(507): n is a, c, g, or t
  modified_base (536)..(536): a, c, t, g, unknown or other
  misc_feature (536)..(536): n is a, c, g, or t
tcagtactctcgtgcacgaccggtgctcgatttagtctagcgactttgggtttgggctgagctgggttttcctcgttgctcttttaagaggtgtccagtgtcaggtgcacctggtggagtctgggggaggcgtggtccagcctgggaggtccctgagactctcctgtgcagcctctggattcaccttcagtagctttggcatccactgggtccgccaggcctccaggcaaggggctagagtgggtgcagttanatcatntgatggaagtaaaatntaattatggagactccgtaggaacggggtccagttcacctagtcctccgaagacgactaattaccgaaagtaaccacgagtagggactcgtagaccaaaatcggaaacacggtccctaggaagagcgtacggggacaccggcttcgtgttaatttaccgtggttcggaccgtaaggacgtcggtacgtcggaaccaacttacgacttaccgtagttacggtttcgacgtcgnggggaccaagggccacggtcatcccgtcncccgagccctccgaccgacggtcccgagtcccggtaccctccccgtacgggcccgtccctcggtacccgtccgacgggtccacccgtacccg

SEQ ID NO: 400 - DNA, 780 bp, Homo sapiens
  misc_feature: GYAE6OF02JMUBM.19.26.C04.1.454.CMB.1.raw
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcagccaccctcagtgtcagtcggcccgaggagagaccggccaggtacttcccgtggtgggggagactaactttgaataacgtaaagtgtgcacgtcggtacagcaggacggcaggaccacggtccctatacgtggtctactctattaataacgtacccggtcccggacctacggacggtacttcccgtagacgacctaccgtcttcgtacggtcctacctacgtcggtacgggaacctaccggaccctacccgtccgtaccgtcacggcggtaacgggtcggaacgggccggggtagtacgggaccggtaccgtaacttacgtttaccgtggtacggttacgggttcgggtaggggtacttaagggttacgggttacgtcggtacgtaagttggttacgtttacggtttcggggaaacgggtacggtaaccgtaacggtccgtaacggttacccgtacgggtaggtaccgtacggacccggtaaacggtccgtcccgggtcccccgttacggtaccgtaccgttttcccgttaccgtttcccccctaaccccgtttccctaccgggtaaccgttcgggttaaacccggtccgttacgggggaccggccgggtttaacccggg

SEQ ID NO: 401 - DNA, 802 bp, Homo sapiens
  misc_feature: GYAE6OF02HECJ7.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagccaccctcagtgtcagtggccccaggagagaccggccagggacttcccgtgtcgggggagacaacgtttgagtaacgtaaaaggtgtagcacgtggtaccagcagaggccaggccacggccctatactggtcatctatataactaccgtccggtccctcgacgggtatccccgtggacgccgactccgtacgtggacctccgaacttccgtacggggtaaccgtaccggtacccaaccccgttcggacccggttaccgacggtaccgtaacggggtaccgtaaacggaccccgggggtattaccgggaacgggaccccgtaaccgtagtttaccgtacgtaccgtaagggttcggtacggggtaacgttaggttacggtaacggtaccggttacgtaacgttggtttacggttaacgtttttccgggacgggtaacgggtaaccgtaacggtccgttaccgaaccgggttcccgtaaggggttaccaacgggtacccgtaaacggtccgttaccggtccccccgttaggtacccgtaccgttcccggttacccgttacccccgtacccccggttaccctttcccgaaccggtaccggtaccgttaaccgttacgggaaccggttcccggggtacctccgggg

SEQ ID NO: 402 - DNA, 734 bp, Homo sapiens
  misc_feature: GYAE6OF02JPM8G.19.26.C04.1.454.CMB.1.raw
  modified_base (187)..(187): a, c, t, g, unknown or other
  misc_feature (187)..(187): n is a, c, g, or t
  modified_base (197)..(197): a, c, t, g, unknown or other
  misc_feature (197)..(197): n is a, c, g, or t
  modified_base (280)..(280): a, c, t, g, unknown or other
  misc_feature (280)..(280): n is a, c, g, or t
  modified_base (305)..(305): a, c, t, g, unknown or other
  misc_feature (305)..(305): n is a, c, g, or t
  modified_base (344)..(344): a, c, t, g, unknown or other
  misc_feature (344)..(344): n is a, c, g, or t
  modified_base (358)..(358): a, c, t, g, unknown or other
  misc_feature (358)..(358): n is a, c, g, or t
  modified_base (411)..(411): a, c, t, g, unknown or other
  misc_feature (411)..(411): n is a, c, g, or t
tcagtactctcgtgcacgaccggtgctcgatttagtctagcgactttgggtttgggggggggaggaggagcccacgcactagaagtcggcggtgtttccattcggtgatcagcactgaacacagaggactcaccatggagtttggctgagctgggttttcctcgttgtctcttttaagaggtgtccngtgtcaggtnctacctggtggagtcgtgggggaggcgtggtccagccgtcgggaggtcccgtgacgctctccgtgtcgcagcctcgtgattcnccttgagtagtctttggcatcccgngtacgggtcccgtccaggtcctccgaggaccgaggggtntacggagggtcggnggagtaactttatactcgtaatcgtaggacttagggggtaaacgtaaaagttnttagtaagttagggtagtaaccgcgggttaaacgggacgggggtaaccctttagtacccgtacccgttaacgttaccgtaaccgaaacgggtaacgaaccgttaaacgttaacccgaaacgtaacaacgttacgggtaaggttacttaccgtggtaaaacctaaagttaaccggaacgtaactaccgtagttaaacggcggtaccgggtaacgggaccgtacgggtagtcggttacggttacgtttatacgggttacggagtaacggcggtacggacgtcggaacgttaacctagaaccgttacggttaccgttttaacgggg

SEQ ID NO: 403 - DNA, 841 bp, Homo sapiens
  misc_feature: GYAE6OF02IUGOW.19.26.C04.1.454.CMB.1.raw
  modified_base (710)..(710): a, c, t, g, unknown or other
  misc_feature (710)..(710): n is a, c, g, or t
  modified_base (820)..(820): a, c, t, g, unknown or other
  misc_feature (820)..(820): n is a, c, g, or t
tcagtactctcgtgcacgaccggtgctcgatttagtctagcgactttgggtttggggctgggcctaaggaagcagcacgtggtggtgcctcagccatggcctggaccgttctcctctcggcttcctctctcactggcacacggcttcgtgtcgacccttcccgagttggtggtcgactcgacgccctaccctcagttcgtacaggtccggccccgaggactaggaccggtccgaggtacctttcccgtaggggtgggggaactaaccttaagttttgaagttaaaggttaaaacggtggtcggtacctacgttcggtaacccaaggaccgaagggacggaccgtacgggccccgaacgggtaccccccttaagttaccggtacgggttacctaattaccgtttaatttaaacctttaaaccgggtaccccggtccccgggtacccttacggaacggggtaccttccggtaccggaggacccgtaccgttctaccggtcggttacctaaccgtaacttacgggaccggaaacccgtcccgggtacccccctaacccgtttacggaaaccccgtcaaccggggtaccggtaacggggggttaccggaaccggggtccggggtaacggtcgggaaccggtaccgttaacgttacgttaacgttcggtacggtacggtaggttagggtacgttaaggttcggtacgtcggttanagttgttaggttcgttcgggacggtaacgacgtacgtcgacggtaccgtcgtagacgaccgtacgaccgtaccgtcccgtccgaccgttacacgttccaccccggttacnccccgttactaccgacgtacg

SEQ ID NO: 404 - DNA, 691 bp, Homo sapiens
  misc_feature: GYAE6OF02JBNSD.19.26.C04.1.454.CMB.1.raw
  modified_base (243)..(243): a, c, t, g, unknown or other
  misc_feature (243)..(243): n is a, c, g, or t
tcagtactctcgtgcacgaccggtgctcgatttagtctagcgactttgggtttgggggtcgagggttgagaacctatgaacagttctgtaggggccaccgttctccgtcctcggcctcctctctcgactcgcacaggtcctctcgtcggacctccaatgtggtgactcacgccacctcagtcgtcacgtcgcccaggagacgtaccgcgaggtccttccgtaggtcggggacactaccgtttnaacgtaacgttaaacgtgtacgctacgtacggtaccaggaccaggacgccgtacggccgtacggtccccttagtacgtcggtctacttcttaagttactaacgtccggtaccgcctacggacggtactccgtagcgcgtactcgtacgtgtacctactacgtcgtacgggactaccggcctcctacgtccgtacacggccgtaacggacgtaccggtcgggactcgggacctccggtactactctcgtacgtggtagtcgtagtagtcggaggtacgtacgtcgttgtacgttacgttcgggacggtcggtaacacggtcgtcggaccttccgtacggtcaccggtccgaaccgttccgtacccgccgtaccgtctaaccgtccgttaccggtcccctcccgtcgtaccgacggtacgttccgacggtcggtacggtcggacgtccgg

SEQ ID NO: 405 - DNA, 776 bp, Homo sapiens
  misc_feature: GYAE6OF02FGU8O.19.26.C04.1.454.CMB.1.raw
  modified_base (208)..(208): a, c, t, g, unknown or other
  misc_feature (208)..(208): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtcggccccaggagagacggccaggattcccnggtggggagacaactttgatagtaaaagtgtgcactggtaccagcagaggccaggccaggcccctatactggtcattctattataactaccgtcccggccttacgaggactcccgtgacgcgactctacgtcggacctaccaaacttcgtacggggaaccacccgggaccctacccgtagacccgtacgacggaccggtaacggggttaccggaaacggggtcccgggggtaaggtacgggaaccgggtacccgtaacgtttacgtttaaccggtcggtacggtaacgggttggtacggggtagttaacggttaaggtacgggtacggtactacggttggttacggttacggttttaccggggaccgggttaacgggaaaccgtaagggtaccggttcggtaaccgggttacccggtacgggtttacggaccgtacccgaacggttccgtacccggttcccccggtcggtaccgtaccgttccgttcccgttaccccgtaccccgttccctacccggttaacgacggtaacggttaccgtcgggtacgggtcccgggtcgtaaccggg

SEQ ID NO: 406 - DNA, 727 bp, Homo sapiens
  misc_feature: GYAE6OF02JMU4U.19.26.C04.1.454.CMB.1.raw
  modified_base (238)..(238): a, c, t, g, unknown or other
  misc_feature (238)..(238): n is a, c, g, or t
  modified_base (587)..(587): a, c, t, g, unknown or other
  misc_feature (587)..(587): n is a, c, g, or t
  modified_base (668)..(668): a, c, t, g, unknown or other
  misc_feature (668)..(668): n is a, c, g, or t
  modified_base (698)..(698): a, c, t, g, unknown or other
  misc_feature (698)..(698): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgacctcccatgtggtgactcgacgcccaccctcgagtcgtcagtcggtccccagggacgacgacggaccgtaggtacctttcccgtgggtggggggaanaaccgtaacttttaggaagttaaggttaaaaggttcgtacgacacggtacggtaccaggacgaacgggacggaccgaccgggcccgtaccggaccccttagtaccgttcggtactaacttacgttaattaacgtaacgtacccgtcccggtaccctcgaggtcctccgagacgccgactctcgtaccggcctaccgtaacgtcggtacggaccaccggcctacccgtgacctataccgacgtacggaccgggacggaaccgggaccgggtagtccggacgtacccgtattaacccgttgtacggtacgtgggtacgggtagaaagttaacgggagttaccgggcgttanagtttccggtaggtttacgtacggggacgacggtaacaggtccgtcgtaacgtctaggcacggtacgctccgacctcccgntcctcgtcccgtccacccccgtactcccgngtaccgacgtacgtaccgtggacggtccg

SEQ ID NO: 407 - DNA, 630 bp, Homo sapiens
  misc_feature: GYAE6OF02IK2IV.19.26.C04.1.454.CMB.1.raw
  modified_base (541)..(541): a, c, t, g, unknown or other
  misc_feature (541)..(541): n is a, c, g, or t
tcagtactctcgtgcacgaccggtgctcgattttagtctagcgactttgggtttgggggggtgagggttgagaacctatgaacattctgtaggggccaccgttctcctcctcggcctcctctctcactgcacaggctctgtgacctcccatgtggtgactcagccaccctcagtgtcagtggccccaggagagacggccaggattccctggtggggagactaactttgatagtaaaagtgtgcactaggtaccagcagaggccaggccgacggcccctatactggtcatctattataataccgtccggccctcgaggactccctgagcgactcgtctggcctcaacctcgacgggaaccaccggccaccctggtacccgtcgacgcggtaagggtcgaacgggccggggtagtggacgggtccgaacttagttacctgtacgaggtggtaggagttagtagtacgcgtcagtgtgtagtttcggacgggacggacaaggtctacggtaccggtaccgtaggccgagacccgaagggtcccnccgcccccgtggtccaccttccgtacccgttccccggtccctcccgtaccgacggtacgacgtcgtacggaccggtccgggactccggg

SEQ ID NO: 408 - DNA, 702 bp, Homo sapiens
  misc_feature: GYAE6OF02HLCWA.19.26.C04.1.454.CMB.1.raw
tcagtactctcgtgcacgaccggtgctcgatttagtctagcgactttgggtttggggctgggcctaaggaagcagcactggtggtgcctcagccatggcctggaccgttctcctcctcggcctcctctctcactgcacaggctctgtgaccctcccatgtggtgactcagcccaccctcagtgtcagtcggccccaggacgaggaccggccaggacttccccgtggtgggggagactaactttgaataagtaaaagtgtgacacgtcggtaccagcaggacggccgaggccacggcccctatactggtcatctattataactacccgtccgccctcgacgggtactccctgacgcgactcgtcgtcggcctaccaactcgtagggaaccaccggcccacccgtcgtacccgtacgacgacggacgggtaccgaacgggtccgggggatacgggacgggacccgtaagttacgtttaacgtcggttcgtaagggttcggtagggaagtttaacggtaaggtacggtcggtactagtacggtaggtttcgttttaccggggacgggaacgggtaaccgaaggtccgttacggtaacccttcggttaacggtcgacggtacccgtacggtccgtcccggtcccccgtcgttaccgacccgttccgttacccgtaccccctaccctcccgtaccaccggtaaccgg

SEQ ID NO: 409 - DNA, 857 bp, Homo sapiens
  misc_feature: GYAE6OF02IRNLS.19.26.C04.1.454.CMB.1.raw
  modified_base (454)..(454): a, c, t, g, unknown or other
  misc_feature (454)..(454): n is a, c, g, or t
  modified_base (836)..(836): a, c, t, g, unknown or other
  misc_feature (836)..(836): n is a, c, g, or t
tcagtactctcgtgcacgaccggtgctcgatttagtctagcgactttgggtttggggggtgagggttgagaacctatgaacattctggtaggggccaccgttctcctcctccggccctcctctctcactgcacaggctctgtgaccctcccatgtggtgactcacgacccaccctcgagtcgtacacggtccggacccccagggaacggaacggaccggaccgtacggtactttcccgtaggggtaggggggaacgaactaaacgtttagaacgttaaaggttaaaacggtggttagaccgtaacgtacgggtaccaaggaccacggacggacgacggaccctacggaccctacgtacgttacgactactactaataactaaccgtacccggtcccgaccgtcggacggtacctaccgtcggtacgaccctaactccgtacggttaccgtaccncccgttaacgtccggtaacggggaacctaccccgggaccctacccgttaccgaacccggtacggaacggtccggtaacggggtaacggaaccggggaccgggtacgttacggaaccgggtaaccctaacgtttaacgttacgttaccgggtaggtaccggtttagggggaagggtaaacgttagggttaaacgtacggggttccgttagagggttccggtttaagttttccgggtaacgggggaccgttaggaaacgtacggtacgttccggtaaccgttcgtacggaccgaacccggcgtaaccggtcgaccccgtcccgttacgacttcccttccgtcccggtcccgacccgtcaaccggtaacaccggtacgtaccggnggcggttccgggactaaccgg

SEQ ID NO: 410 - DNA, 760 bp, Homo sapiens
  misc_feature: GYAE6OF02HB187.19.26.C04.1.454.CMB.1.raw
  modified_base (526)..(526): a, c, t, g, unknown or other
  misc_feature (526)..(526): n is a, c, g, or t
  modified_base (583)..(583): a, c, t, g, unknown or other
  misc_feature (583)..(583): n is a, c, g, or t
tcagtactctcgtgcacgaccggtgctcgatttagtctagcgactttgggtttgggggtgagggttgagaacctatgaacattctgtaggtgccaccgttctcctcctcggctcctctctcactgcacaggctctgtcgacctccagtcgtggtgacctcacgccaccctcgagtcgtcgaggtccggaccccaggacgacggaccggccgaggtaccttcccgtggtagggggacgaacgtaacgtttagaacgttaagtaaaacggtgttagacctacgtacggtaaccgagacgaaggacggccgacgggtacccaaccggtaccccgttaagtaaccgtacggtactacgttacttattaacgtaaacgtaccccggtccggtacccgttacggtaggtacctccgtagacggaccgtaaccgtcgttcgtccggtacctaccgaacgttccggaacggtaaccaccggtaccctaccgtacgaccgtacgtacgacggtacggaacggtacggccgggtanaccggtacgccgtaagttactacgtcgacgaggttcgtaggtacgtaggtcgtacgngtacgagttcggttacgttacggttcgacgggacgtacgtacgtcgtacggtacccgtagtaccgtcgaaccgttacgacgtaccgtccgtacccttggaccttaccggtccgttaccgtccccgtaacttcccgtaacgtaccggtacgaccgttacggacgttcggaacccgtgg

SEQ ID NO: 411 - DNA, 870 bp, Homo sapiens
  misc_feature: GYAE6OF02I2PIK.19.26.C04.1.454.CMB.1.raw
  modified_base (513)..(513): a, c, t, g, unknown or other
  misc_feature (513)..(513): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgaccctcccatgtggtgactcacgccaccctcagtgtcgagtcggccccaggagagacggcaggacttccctgggtggggagaactaactttgaataaggttaaaagtgttagcacgtcggtaccgagtacgaggaacggccgaacggccgaaccggccccttaactacgttcggactactacttaatttaattaacgttaaccccggtcccggttacccctacgaacggggactaccccgtgacgccggtaaccttccttaccgtcggtaccttaaccccgtacgttacggtacggggtaaccaaccggggacccctaaccccggttcgacccgtcgtacggcggtaacgggtacgaaacgggaccggggtanacggggacggtaacccgtaccgtttaagtttaccgtacgggttacgggtaccgggttaggggacgggttaagttaacggggtttaacggtaaacgggttcgggtaccgttaaggttcggttaacgggtttttacgggttttccgggggaccgggttaaaccggggtaccggaacgggtaccgttaacggacccgggtttacccggtaccggtaccgaaccgggtacccgtaccgggtacccgttcccgggtcccccgttaccggtccgtaacccgtttccgtaccccgttcccgtaccccttccgtaaccgaccggtaacgtaccgtaagacccggtagggtcccggtaggtaccgg

SEQ ID NO: 412 - DNA, 722 bp, Homo sapiens
  misc_feature: GYAE6OF02FPDDK.19.26.C04.1.454.CMB.1.raw
  modified_base (357)..(357): a, c, t, g, unknown or other
  misc_feature (357)..(357): n is a, c, g, or t
tcagtactctcgtgcacgaccggtgctcgatttagtctagcgactttgggtttggggggtgagggttgagaacctatgaacattctgtagggccaccgttctcctcctcggcctcctctctcactgcacaggctctgtgacctcccatgtggtgactcagccaccctcagtgtcagtggcccccaggagagacggccaggacttccctgtgggggagacaactttgaatagtaaaagtgtgcacgtggtaccagcagacggccaggccacggcccctatacgtggtcatctaattataataccggtccgccctcagggctccctgacgcgactctcgtggctaccactcgtggaacnccggccacccgtcgaccgtcgacgacgtacggggtaccgaacggccggggaatcggacgggacccgtacgttacttacgtcgtacgtacgggttggtcgggtaagtaggtaggtaggtcggttaccgagttcggttagttaacgggttttcgggacggggtaaccggtaaccggtaacggcgttacggtaacccggttcccgttacgggttaccgaaccggttcccgaaacgggtcccgttaccggtcccccgttaccggtacccgtaccttaccggttcccggttacccccgtccccttcccccgttacccgaacggtaccggtacgttaccggtaccggacgggtcccgggtacgtaccgggg

SEQ ID NO: 413 - DNA, 683 bp, Homo sapiens
  misc_feature: GYAE6OF02H1YUT.19.26.C04.1.454.CMB.1.raw
tcagtactctcgtgcacgaccggtgctcgatttagtctagcgactttgggtttgggggtgagggttgagaacctatgaacattctgtaggggccaccgttctcctcctcggcctcctctctcactgcacaggctctgtgacctcccatgtggtgactcagcccaccctcagtgtcagtcggccccaggagaacgacggccgaggactttcccgtggtgggggagacgtaactttgaataagtaaaagtgtagcacgttggtaaccagacagacggccgaggccgacggacccctatacctggtacatactaattaataactacccggtccgccctcacggtactcccgtgagccgactctcgtcggtcctacctaactcgtacggaacgaccgccgtacctacgaccgtacgagcgagggtacgaacggccgggagtcgacggacgtaactacttacgtgtcgtagggtagtaggagtagtagtagcgtcgagttgttgtacgtttcgggaggtaacgggaccgaacgtcgtacggtaccgttacggtacggtacgaccggtacccgaacggtccgtaccggccccgttcggtaccgtacccgttaccgtcccggtttaccccctaccccgtcccgtacccgtacgtacgtacgtaccgtacggtacggtccggtcgtaccgg

SEQ ID NO: 414 - DNA, 678 bp, Homo sapiens
  misc_feature: GYAE6OF02HN4VU.19.26.C04.1.454.CMB.1.raw
  modified_base (546)..(546): a, c, t, g, unknown or other
  misc_feature (546)..(546): n is a, c, g, or t
tcagtactctcgtgcacgaccggtgctcgatttagtctagcgactttgggtttggggggtgagggttgagaacctatgaacattctgtaggtgccaccgttctcctcctcggcctcctctctcactgcacaggctctgtgaccctcccatggtggtgacctcgacgcccaccctcgagtcgtcacggtccggaccccgaggagacggaccgggccgaaggtcttcccgtgggtgggggaactaacctaacgttttgaagttaaaggtaaaacggttggtacgtacctacgtacggtaaccagccgaaggaccgggacctacggacccgaccggtccccttaagtaaccgtggtacagttacttaattaacgtaacgtacccgtacccggccctagacgggtactcccgtagacgtcgtaccttcgtcgcgtctacctactcgacggacctccgaccctaccgtagccgtacacgacggacggaggtaccggacgggatacggacggactcgtaagttcgtgtcgtaggtggtagagtagtagtcgngtacgtgttggtctaggttcgaggtacggacagtcttacgaccgtcgacgtacgacgccgtacgcctccgtcccgtcgactaccgtccgtcctacccgccttaccgacgacgtgtaccgtgacgcgcgtacg

SEQ ID NO: 415 - DNA, 807 bp, Homo sapiens
  misc_feature: GYAE6OF02J0IC9.19.26.C04.1.454.CMB.1.raw
tcagtactctcgtgcacgaccggtgctcgatttagtctagcgactttgggtttgggggggtgagggttgagaacctatgaacattctggtaggggccaccgttctcctcctcggcctcctctctcactgcacaggctctgtcgaccctccatgtggtagacctcacgcccacctcagtcgtcagtcgcccgaggagacgacgcagcttccgtggtgggacactaattgaataagtaaagtgtacacacgtcgtacagcgaggacgccgacggaccgaccggtcccctaatccgtacgtactacttacttaacttaacgtaacttaacccggtccggtacccgtacggacgggtaccctacccgtaggacgtacccgtacgttaccgttcggtaccgtaccttacccgaaaccggttccggtaaccgggtaaccgtaacccgggacccgtaacccggtacggtacccgtacggcggaccgggtaaccgggtacggaaaccgggtccgggaacggtaccggtaccggacgtaacgtttaacgtacgttacgggtacggtacggttaggtacgggtagttacggtaacgtacggtacgtacgaggttacgttacgtttcggttccgggacgggtaaccggacgtacgtacggtcggttaccgtccggttacggacggaaccctacgggtacctccggtacccgtcccgtaccgtcctaccggtcccgtcccggttaccccgtccccgttaaccgtacccgtacggtaccgtaaccggtccggttaaccggcggcccggttacggaaccgg

SEQ ID NO: 416 - DNA, 830 bp, Homo sapiens
  misc_feature: GYAE6OF02JLZL6.19.26.C04.1.454.CMB.1.raw
  modified_base (68)..(68): a, c, t, g, unknown or other
  misc_feature (68)..(68): n is a, c, g, or t
  modified_base (186)..(186): a, c, t, g, unknown or other
  misc_feature (186)..(186): n is a, c, g, or t
  modified_base (206)..(206): a, c, t, g, unknown or other
  misc_feature (206)..(206): n is a, c, g, or t
  modified_base (292)..(292): a, c, t, g, unknown or other
  misc_feature (292)..(292): n is a, c, g, or t
  modified_base (363)..(363): a, c, t, g, unknown or other
  misc_feature (363)..(363): n is a, c, g, or t
  modified_base (448)..(448): a, c, t, g, unknown or other
  misc_feature (448)..(448): n is a, c, g, or t
  modified_base (471)..(471): a, c, t, g, unknown or other
  misc_feature (471)..(471): n is a, c, g, or t
  modified_base (601)..(601): a, c, t, g, unknown or other
  misc_feature (601)..(601): n is a, c, g, or t
tcagtactctcgtgcacgaccggtgctcgatttagtctagcgactttgggtttgggctgggagaggancccagcactagaagtcggcggtgtttccattcggtgatcagccacgtgaacacagacggactccaccatggagtttgggctgacgtccgtggttttccctcgttgcttctttaaaggngttcgtcctagtgtcaggtnaccgtacgttggtggagttcggtggggggacgccggtggtccgaacgtccggtgggtacgtccccgtgaacgcctccttcgtcggngcgactcctgtaggtaccttccgacccgtttgaagtccgtccggttggtactacttccgctttcgggcccnccgtcggcctacgaggacggtaacggtcgaggtaacggtgggtaccggtagttaccgtaataacgttcaaagtcgtaaacgggtntaaagggtaaaagtttaaaactnttaaggttaagcggttaacgacgtttccggaagggtacgttaccttacgtacgtaccgtacgtcgtaaccgacggtaacgaaaccgttaaaccgtccgtaaaaccgttaacggaacccgttaaacgggtntaaacccgtttagccggttaaaagtaaccgtaaccgggttaaagttacccgaaacggtttaggaaccgtacggtaaccgggtaacggaccgggtaacgttaccgggttagttaccggtttaacgttcggttttaaccggaaccgggttaaggtaccggtacgggttccggttaaaccgggtcggttaaacccggttaaacccgtaacccggtttaccggtttaaaccgg

SEQ ID NO: 417 - DNA, 798 bp, Homo sapiens
  misc_feature: GYAE6OF02GD8I6.19.26.C04.1.454.CMB.1.raw
  modified_base (345)..(345): a, c, t, g, unknown or other
  misc_feature (345)..(345): n is a, c, g, or t
tcagtactctcgtgcacgaccggtgctcgatttagtctagcgactttgggtttggggggtgagggttgagaacctatgaacattctgtaggggccaccgttctcctcctcggcctcctctctcactgcacaggctctgtgacctcccatgtggtgactcagccaccctcagtgtcagtggccccaggagacgacggccaggtacttcccgtggtgggggagactaacgttttgaattaaggtaaaagtgtcgacacgtacggtaccagcaggacggccacggccgacggcccctactacgtggtcagttacctattaataacttacccggtccggtcccctacgngggactccctgacgcgactctcgtgcctccaacttcgtacgggaaccaccggcctacccgtcgaccgtctacggggtacgggtaccggaacggtccggggatacgggacggtccgaacttcgttaacgtggtccgtaggtcggtaggggtaacttagggtaacggttacgggacggtacgtagttgggtacgtttacggtttaccggggtacggggaacgggtacccgaacggttaccgtaccgggtaacccggttacgggttaaccggtccggtaaccggtccccgggttaaagggtccccgttacccggtaccccccgggtttacgtccccgttaccgttacccggtttcccggtttccccccgtacccccgttccccggtacccttaaccggaccgggttaccgttaccggtaccggggtaccggtccggggtccgttacggggaccggg

SEQ ID NO: 418 - DNA, 663 bp, Homo sapiens
  misc_feature: GYAE6OF02GNRKO.19.26.C04.1.454.CMB.1.raw
  modified_base (177)..(177): a, c, t, g, unknown or other
  misc_feature (177)..(177): n is a, c, g, or t
  modified_base (195)..(195): a, c, t, g, unknown or other
  misc_feature (195)..(195): n is a, c, g, or t
  modified_base (315)..(315): a, c, t, g, unknown or other
  misc_feature (315)..(315): n is a, c, g, or t
  modified_base (345)..(345): a, c, t, g, unknown or other
  misc_feature (345)..(345): n is a, c, g, or t
tcagtactctcgtgcacgaccggtgctcgatttagtctagcgactttgggtttgggggggagaggagccccagcactagaagtcggcggtgtttccattcggtgatcagcactgaacacagaggactcaccatggagtttgggctgagctgggttttcctcgttgcttcttttaagnggtgtccagtgtcaggtncactggtggagtcgtgggggaggcgtggtccagccgtggggacgttccctgagacctctcctgtgcagcctctggattcaccttcgagttacgtctttggctatccacgttcgggtcccnccacggcctccgaggacgaaggggctaggnggtgggtgcaggttatatcatatgagtggtaagtaaatattaagttagtggactacgtccggtaggaacgggcctagttaccacctacttcctaccgagaacgtaacctaaacttacccgaaagtaaccacgtagttacggaactcgtagaacctaaagtacgtaaacgacgtaccgttaggacgacggtcggtaaccggggaccgtacggtcgtacgttacggttacgttaacgtggtacggacggtaacgggcggtacggtaccgtacggtaacctaacccggttaactaccgttaccgttacggttttaaccggg

SEQ ID NO: 419 - DNA, 732 bp, Homo sapiens
  misc_feature: GYAE6OF01CSSUF.29.36.D03.1.454.CMB.1.raw
  modified_base (122)..(122): a, c, t, g, unknown or other
  misc_feature (122)..(122): n is a, c, g, or t
  modified_base (204)..(204): a, c, t, g, unknown or other
  misc_feature (204)..(204): n is a, c, g, or t
  modified_base (219)..(219): a, c, t, g, unknown or other
  misc_feature (219)..(219): n is a, c, g, or t
tcagatagagtactcacgaccggtgctcgatttagctgcgtcacgatctctcttgggatctcaggaggcagctctctcggaatatctccaccatggcctgggctctgctcctctcacctctnactcagggcacaggatcctgggctcagtctgccctgactcagcctcctcgtgtccgggtctcctggacagtcagtcaccgtntcctgcagtgaaccngcagtgacgttggtgcttataaccgtgtctctcggtaccagcacgtccccaggccacgacgccccaaactcagtcgtattttcgacgttcaagtaacgtccggtcctcgaacgggttcctagacgttcgtcttcgtcgtcggtacctaagtcgtacggacgtacgtccgtaacgggtccttacccgtagttaacgtttaacgttccgtacgttcgggggtaccttaccgtaacggtaaccgttacggtaaccgggtaaccggttaacgggtaccgttaacggtaaacgtttacgtttaacgttacggtaccgtaacggtaccttaccggtaaacgttaacgtaaaccgtaaacggggttaaccctaaacgttaaccgtttacgttaccggttaaccgtttaaccgggtaaaccgttccgggtaaacccgtaaacggttcccgtaaccggttacccgttaacgggtacctaaccggtaaccccggtaacggtaccccgtaaacccggttaccgg

SEQ ID NO: 420 - DNA, 436 bp, Homo sapiens
  misc_feature: GYAE6OF01EC2DY.29.36.D03.1.454.CMB.1.raw
  modified_base (364)..(364): a, c, t, g, unknown or other
  misc_feature (364)..(364): n is a, c, g, or t
  modified_base (425)..(436): a, c, t, g, unknown or other
  misc_feature (425)..(436): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcaggggtccctgatcgcttctctgggtccaagtctggcagcacggcctccctgattatctctgggctccagactgaggacgaggctgaatattattgcagctcatatacaagggcaacacttatgtcttcggaactgggaccaaagtcaccgtcctaggtcagcccaaaggccaaacccnctgtcactctgttcccgccctcctcagtactctatctgagcgggctggcaaggcgcatagnnnnnnnnnnnn

SEQ ID NO: 421 - DNA, 515 bp, Homo sapiens
  misc_feature: GYAE6OF01D0JKO.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactcatgattttgacgtcagtaatcggccctcaggggtccctgatcgcttctctgggtccaagtctggcagcacggcctccctgattatctctgggctccagactgaggacgaggctgaatattatgcagctcatatacaagggacaacacttatgtcttcggaactgggaccaaagtcaccgtctaggtcacgaccaacggccaacccactcgtcaccttctcgttccccgccctccctctcgttaccc

SEQ ID NO: 422 - DNA, 515 bp, Homo sapiens
  misc_feature: GYAE6OF01A5CAE.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtcccgggtctcctggacagtcagtcaccgtctcctgcagtggaaccagcagtgacgttggtgcttataaccgtgtctcctggtaccagcacgcccccaggcacacgcccccaaactcatgtattttgacgtcagtaactcggccctcacgggtccctgactcgcttctctgggtccaagtctggcagcacggcctcctgattatctcgtggctccagtactgaggacgaggctagaatattattgcagctcatactacgaaggacaactacttatgtcttacggactcggaccaagtccaccgtctacgtcacgacccaacggcccaacccgtac

SEQ ID NO: 423 - DNA, 557 bp, Homo sapiens
  misc_feature: GYAE6OF01CI74I.29.36.D03.1.454.CMB.1.raw
  modified_base (226)..(226): a, c, t, g, unknown or other
  misc_feature (226)..(226): n is a, c, g, or t
  modified_base (232)..(232): a, c, t, g, unknown or other
  misc_feature (232)..(232): n is a, c, g, or t
tcagatagagtactcacgaccggtgctcgatttagctgcgtcacgaggctctctcggaataatctccaccatggacctgggcctcgtgctcctcctcaccctcctcactcagggcacaggatcctgggcttcaggtctgccctgactcagcctccctccgtgtcccgggtctcctggacagtcagtcaccgtctccgtgcaggtggaaccagcaggtgacgttggngcttanaaccgtgtctcctggtaccaggcacgccccaggccacacgccccaaactcatgtattttgacgtcagtactcggccctcgacgggtccctgatcgcttctcgtggtccagtctggcagcacggcctcctgacttatcgtctgggctccagtactcggaggacgaggctagaattattagtgctagtctcatatacgaaggacaactacttatcgtcgttacggaccgtgggaacctaagtcctaccgtactaggtccacgacccgaaggcccaaccctactcgtcctactccgtacgttccccgacctcccgtcgtacgttaccg

SEQ ID NO: 424 - DNA, 581 bp, Homo sapiens
  misc_feature: GYAE6OF01DNAZM.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctctggtaccagcagccccaggcacacgccccaaactcatgtatttttgacgtcagtaatccggccctcgacgggtccctgactcgcttctcgtggtccaagtctgcagccacggcctcctgtattactcctcgtcgggctccgagtacgtgacggacgaggctagtaattattattgactagcttactataacgtaacgaacgggaactaacactttaagtcgttaccgttacggaaacgtcgggaaacctaaacggtccctaacccggttccgtaacggttacccgaacggtaccccaaacgggtcccccaaaccccgtaacccg

SEQ ID NO: 425 - DNA, 516 bp, Homo sapiens
  misc_feature: GYAE6OF01B0SLJ.29.36.D03.1.454.CMB.1.raw
  modified_base (432)..(432): a, c, t, g, unknown or other
  misc_feature (432)..(432): n is a, c, g, or t
  modified_base (444)..(444): a, c, t, g, unknown or other
  misc_feature (444)..(444): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacacgcccccaaactcatgtatttttgacgtcagtaatcggcctcaggggtccctggatcgcttctctgggtccaagtctggcagcacggcctccctgattatctctgggctccagactggaggacgaggctagaatattatgcagctcatanaacaaggacaanacttatgtcttacggaacgtcgggaacaaagtccaccgtcctaggtacacgacccaacggcccaaccctacg

SEQ ID NO: 426 - DNA, 576 bp, Homo sapiens
  misc_feature: GYAE6OF01D9WD1.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacacgcccccaaactcatgatttttgacgtcagtaatcggccctcgagggtccctgactcgcttctctgggtccaagtctggcagcacggcctccctgacttatctcgtgggcctccgagactgaggacgaggctagaattattaattgacagcctacgtaattaataacgaaacgggaacaaactactttaatagttcgttacgggaaaccttacggggaaccctaaaggttccaacccgttcccgtaacgggttaccaacgtcccccaaaagggtccccaaaacccccgtaaccg

SEQ ID NO: 427 - DNA, 548 bp, Homo sapiens
  misc_feature: GYAE6OF01C5E7G.29.36.D03.1.454.CMB.1.raw
  modified_base (303)..(303): a, c, t, g, unknown or other
  misc_feature (303)..(303): n is a, c, g, or t
  modified_base (371)..(371): a, c, t, g, unknown or other
  misc_feature (371)..(371): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagccctccctccgtgtccgggtctcctggacagtcagtcaccgtctcctgcactggaaccagcagcgatgtcggtgttataactttgtctcctgtaccaacaacaccaggccgacggccccccgactcattaattangatgtcattaacgccggccctcgacggggtccctgactcgcttctctggctccgaagtctggacaacnctcgccctcctcgaccctatctcgtcgggcctccgaggctgacgatggacgtgtatttatactgctgctctatttcgacacggccacccgctactgtacgtattccggtcgggacgggtacgggaacccaacggtccgtacggtacccgttaccgtagggtaccagtccgtaaccgg

SEQ ID NO: 428 - DNA, 503 bp, Homo sapiens
  misc_feature: GYAE6OF01A98NE.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcgagggtccctgatcgcttctctggtccaagtctggcagcacggcctccctgattatctcgtgggctccagactgaggacgaggctgaatattatgcagctcatatacaagggacaacacttatgtacttacggaacgtggaccaagtcaccgtctagtcagacccaacgccaaccctacg

SEQ ID NO: 429 - DNA, 641 bp, Homo sapiens
  misc_feature: GYAE6OF01DZMFW.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgccccaggcacacgacccccaaactcatgtattttgacgttcagtaactccggccctcgacggggtccctgactccgtctttctcgtcgggtacctaagtcgtggcacgccgaccggtcccttcccgtgtaacttactcctcgtcgggcctccgagacgtggaacggacgaggtacgtagtaaattatttagtcgacagtctactaattaagtaacgaagggaactaactacttagtcgttacgttacggaacgtacgggaacctaacgtccgtaccgttaccgtacggaccgaccggtacccgaacgggacccccaaaccccgtacgttccgtacccgtacccgttcccgttacccggttacccccgtcccctttaccctccgtaacgttaaccc

SEQ ID NO: 430 - DNA, 450 bp, Homo sapiens
  misc_feature: GYAE6OF01AT2PF.29.36.D03.1.454.CMB.1.raw
  modified_base (437)..(450): a, c, t, g, unknown or other
  misc_feature (437)..(450): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcagccccccaggcacagcccccaaactcatgatttttgacgtcagtaatcggccctcaggggtccctgatcgcttctctgggtccaagtctggcagccacggcctccctgattatctctgggctccagactgaggacgaggctgaatattattgcagctcatatacaaggacaactacttatgtacttcggaactgggaccaaagtcaccgtctaggtcacgacccaaggcccaacccactgtcactctcgtcccgccctcctcacgtactctactctgacggcggctcggacgaacggcgacatagnnnnnnnnnnnnnn

SEQ ID NO: 431 - DNA, 576 bp, Homo sapiens
  misc_feature: GYAE6OF01BEFYU.29.36.D03.1.454.CMB.1.raw
  modified_base (266)..(266): a, c, t, g, unknown or other
  misc_feature (266)..(266): n is a, c, g, or t
tcagatagagtactcacgaccggtgctcgatttagctgcgtcacgatctctcttgggggatctcaggaggcagctctctcggaatatctccaccatggcctgggctctgctcctcctcaccctcctcactcagggcacaggatcctgggctcagtctgccctgactcagccctccctcgtgtccgggtctcctggacagtcagtcaccgtctcctgcagtggaaccagcagtgacgttgtgcttataaccgtgtctcctggtaccngcacgcccccaggcacacgacccccaaactcatgtatttttgacgtcagtaacgtccggccctcggacgggtccctgatcgtcttctcgtcggtacctagtcgtggcacggcaccggcccttcctgtacttatctcgtcgggtcctccgagacgtggacgggacgaggtctagaacttattagttcgctacgtctacaagtaataacgaagggaacaactacttagtcgtacgttacggaacgtcgggaacctaaacggtccacccgttacgtacggtaccgacgacccgaacggcccaaccccgtaccg

SEQ ID NO: 432 - DNA, 444 bp, Homo sapiens
  misc_feature: GYAE6OF01EXNY7.29.36.D03.1.454.CMB.1.raw
  modified_base (423)..(423): a, c, t, g, unknown or other
  misc_feature (423)..(423): n is a, c, g, or t
  modified_base (426)..(426): a, c, t, g, unknown or other
  misc_feature (426)..(426): n is a, c, g, or t
  modified_base (429)..(444): a, c, t, g, unknown or other
  misc_feature (429)..(444): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcaggggtccctgatcgcttctctgggtccaagtctggcagcacggcctccctgattatctctgggctccaggctgacgatgacggtgattattactgctgctcatttgcaggccacccgcactgtgatcttcgggcgagggaccaagctgaccgtcctagtcagctcgaaggctcgcccctggtcactctccgttccccgcctcctcacgtactctatctgacgtcgggctggcaggcncanagnnnnnnnnnnnnnnnn

SEQ ID NO: 433 - DNA, 544 bp, Homo sapiens
  misc_feature: GYAE6OF01B3EAK.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgcccccaggcacacgcccccaaactcatgtattttgacgtcagtaactcggccctcgacgggtcctgatcgtcttctcgtcggtccaagtcgtggcagccgacggcctcctgtattatctcgtggcctccgagactggaggacgaggctagaattattacttgctagctcaatataacgaagggacaactacttagtcgtcgttacggaacgtcgggaaccaagtccgacccgttccgtaacggtccaacgacccgaacgcccaaccccgtacg

SEQ ID NO: 434 - DNA, 671 bp, Homo sapiens
  misc_feature: GYAE6OF01CUD7M.29.36.D03.1.454.CMB.1.raw
  modified_base (230)..(230): a, c, t, g, unknown or other
  misc_feature (230)..(230): n is a, c, g, or t
tcagatagagtactcacgaccggtgctcgatttagctgcgtcacgatctctcttggggatctcaggaggcagctctctcggaatatctccaccatggcctgggctctgctcctcctccaccctcctcactcagggcacaggatcctgggctcagtctcgccctgactcacgcctccctcgtcgtccggtctccgtggacagtcagtcaccgtctcctgcagtcggaaccngcagtgtacgttgtgtcttaagtaaccgtgtctcgtggtaccagcaccgccccaggcaacaccgacccccaaactcatcgtatttttacgacgtactaagtaactccggccctcgacgggtcctgtactccgtcttctcgtcggtaccaagtcgtgcgtagccgacgtccctaccgtgtaacttacgtcctcgtcgggtcccttacgaacggtaccgtacggaacgggaaccggtacggtaccgtaagtaaacgtttacgttttagttcgactaacggtcctaaccgtaataacgtaacgaaacgggtaaacctacgttaacgttacgttacgtaccgttaaaccggtacgtaacgggtaaaccaaacggttacccgtaacccgttaccgtaacggtacctaaccggaaccccgtaaaccgaccccgaaaccccgttaacg

SEQ ID NO: 435 - DNA, 639 bp, Homo sapiens
  misc_feature: GYAE6OF01ENUO4.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagccctcctccgtgtccgggtctcctggacagtcagtcaccgtctcctgcagtggaaccagcagtgacgttggtgcttataaccgtgtctcctggtaccagcacgcccccaggccacacgcccccaaactcatgtattttgacgtcagtaatccggcctcgacgggtccctgactcgcttctcgtgggtccaagtctggcagccacggccctcccgtgtacttactctcgtcgggccttccgagtacgtggacgggacggagtccgtaggtaaacttagtttacgttgacgtagtccttacgtaacttaacgtaaaccgaaacggggaacctaaaccgttaactttaagttccgttaccgttaaccgggaaaccgttacggggtaaaccctaaaacggttccgaaccccgggttacccgtaacgggttaccgaaccggtaaccccgaaaccgggtccccaaaacccccgtacg

SEQ ID NO: 436 - DNA, 550 bp, Homo sapiens
  misc_feature: GYAE6OF01DC6MS.29.36.D03.1.454.CMB.1.raw
  modified_base (450)..(450): a, c, t, g, unknown or other
  misc_feature (450)..(450): n is a, c, g, or t
tcagatagagtactcacgaccggtgctcgatttagctgcgtcacgatctctcttggggatctcaggaggcagctctctcggaatatctccaccatggcctgggctctgctcctcctcacctcctcactcagggcacaggactccgtgggctcagtctgccctgactcacgccctccctcgtcgtccgggtctcctggacagtcagtcaccgtctcctgcagtggaaccagcaggtgacgttgtgcttataaccgtgtctcctggtacagcacgccccaggcacacaccccaaactcatgtattttgactcagtaactcgcctcgacgggtcctgactcgtcttctcgtggtccaagtctgcagccacggcctcctagtacttatcctcgtcggtcctccgacggctagacgagtacggtacgtagtaatttactacttgtcgttgccttntacgtttgccgtacggccacccggctacgtgtacgtagttccgttcgggacggtacgggaccgacgcgtacgtacccgtaccgtaggtcacgcctaccgg

SEQ ID NO: 437 - DNA, 617 bp, Homo sapiens
  misc_feature: GYAE6OF01EG820.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagccctccctccgtgtccgggtctcctggacagtcagtcaccgtctcctgcagtggaaccagcagtgacgttggtgcttataaccgtgtctcctggtaccagcagccccaggcacacgcccccaaactcaatgtatttttgacgtcaagtaacgtcggccctcgaggggttccctgactcgtcttctcgtgggtaccaagtcgtggcacgcaccggcctccgtgtattactctcgtgggctaccagactggaggacgaggcgtagtaaattattagtgacgtagctacaattaataacgaagggaactaactacttaagtcgttacgttacggaacgtacgggaacctaaacgtccgaccgtaccgtaggtaccaaccggtacccgaaaccgggtacccctaaaccccgacgttccgtacctaacccttcccgtacccgtttacccccaacccgttcccttactaacgttaacccg

SEQ ID NO: 438 - DNA, 540 bp, Homo sapiens
  misc_feature: GYAE6OF01EI6BV.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgccccaggcacacgcccccaaactcatgtattttgacgtcagtaactccggccctcgacggggtccctgactcgcttctcgtggtccaagtctggcagcacggcctcctgattactctcgtcgggctccgagactggaggacgaggctagaattattatgcagctacatataacgaaggacaactacttatgtacgttacggaacgtcggaacctaagtccaccgtcgtaggtcacgacccgaacggacccaacccactcgtaccactctccttaccccaccctcctcacgtacc

SEQ ID NO: 439 - DNA, 626 bp, Homo sapiens
  misc_feature: GYAE6OF01AD9Y0.29.36.D03.1.454.CMB.1.raw
  modified_base (230)..(230): a, c, t, g, unknown or other
  misc_feature (230)..(230): n is a, c, g, or t
  modified_base (316)..(316): a, c, t, g, unknown or other
  misc_feature (316)..(316): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagccctccctccgtgtcccgggtctccgtggacagtcagtccaccgtctcctgcagtggaaccngcagtgacgttggtgcttataaccgtgtctcctggtaccagcacgcccccaggccacacgcccccaaactcatgtattttgacgtnagtaactccggccctcgacggggtccctagactcgtcttctcgtcgggtccaagtctggcaggccaccggccctcccgtgtacttacgtccgtcgtcgggtcctaccgacggtcttaggacgtagtcggtacggttgtaacttttacgttacttcgtacgttcgtccttacgttagttttccggaccgtaacgggtccccacccggtcctaccgttggttacgtacgttccgggttccggggaccgggtacgggaacccgtaacggtccgtacggtacccggttacgtacggtcgacgtccgtaacccgg

SEQ ID NO: 440 - DNA, 543 bp, Homo sapiens
  misc_feature: GYAE6OF01CBYQR.29.36.D03.1.454.CMB.1.raw
  modified_base (262)..(262): a, c, t, g, unknown or other
  misc_feature (262)..(262): n is a, c, g, or t
  modified_base (473)..(473): a, c, t, g, unknown or other
  misc_feature (473)..(473): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctcgtgtccggtctcctggacagtcagtcaccgtctcctgcagtcggaaccagcagtgacgttggtgcttataccgtgtctctgtaccngcacgccccaggcacaccgaccccaaactcatcgtattttgaccgttacagtaactccggcctcgacgggtcctgactcgtcttcgtcgtcggtaccagtcgtgcacgccgacgtcctccgtgtacttactctcgtggcctacgagtacgtgaggacggtagctagtaattagttatgcagtctagtataacacgaaggactaactacttntacgtcgtacggtaacgtacggtaactaacgtctaccgtctacgacaccgaccgaaccgcccaacctacg

SEQ ID NO: 441 - DNA, 613 bp, Homo sapiens
  misc_feature: GYAE6OF01AEMQ5.29.36.D03.1.454.CMB.1.raw
  modified_base (226)..(226): a, c, t, g, unknown or other
  misc_feature (226)..(226): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccngcagtgacgttggtgcttataaccgtgtctcctggtaccagcacgcccccaggccacacgacccccaaactcatgtatttttgacgtcagtaatcggcctcgacgggtcctgactcgtcttctcgtcgggtccaagtctggcacgccgaccggtccctcccgtagtactttactccgttcgtcgggtccctaccgacgtacgtggacgggacggaaggtcctaggtaattattattgctagtcctacaattacgtaacgaacgggaacctaactacttaatcgttaccgttacgggtaaacgtacgggaacctaaacggtcccgtaacccggttaccgttacggtacccgaccgaaccccgaacggtcccccaaaccccgttaaccg

SEQ ID NO: 442 - DNA, 541 bp, Homo sapiens
  misc_feature: GYAE6OF01CQ4G4.29.36.D03.1.454.CMB.1.raw
  modified_base (273)..(273): a, c, t, g, unknown or other
  misc_feature (273)..(273): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagcgatgtcggtgttatactttgtctctgtaccaacaacaccaggcgacggcccccgatcaataatttangatgtcattaacgccgccctcgacggggtccctgactcgcttctctggctccaagtctgcaacactcgccctcctgaccattcctcgtcgggcctccgaggtctagacgtagtggacggtagtattacttacgtgtctgtctctattcgctacggccacccgctacgtgtagtacgttcgttcggacggacggaccagtcgtcgaccgtcgtagtcgacgctacgacgtcctccgtccccgtcgtaccacttccgtccgtcccgtccc

SEQ ID NO: 443 - DNA, 571 bp, Homo sapiens
  misc_feature: GYAE6OF01BIU6P.29.36.D03.1.454.CMB.1.raw
  modified_base (563)..(563): a, c, t, g, unknown or other
  misc_feature (563)..(563): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccggtctcctggacagtcagtcaccgtctcctgcagtggaaccagcagtgacgttggtgcttataaccgtgtctcctggtaccagcagcccccaggcacacgcccccaaactcatgatttttgacgtcagtaatcggccctcgaggggtccctgatcgcttctcgtggtccaagtctggcagcacggcctccctgatttactctcgtcgggcttccagtactggaggaccggaggccgtagtaaattatttattcgacagtcctactataataacgaagggaccaactacttatgttacgttacggaacgtcgggaacctaaacgtccaccgtccgtaggtcacgaccccgaacggcccaaccccacgtcgtaccacttcctaccgttaccccctacccttcccctntcgtaccc

SEQ ID NO: 444 - DNA, 733 bp, Homo sapiens
  misc_feature: GYAE6OF01COVPA.29.36.D03.1.454.CMB.1.raw
  modified_base (234)..(234): a, c, t, g, unknown or other
  misc_feature (234)..(234): n is a, c, g, or t
  modified_base (262)..(262): a, c, t, g, unknown or other
  misc_feature (262)..(262): n is a, c, g, or t
tcagatagagtactcacgaccggtgctcgatttagctgcgtcacgatctctcttggggatctcaggaggcagctctctcggaatatctccacatggcctgggctctgctcctcctcaccctcctcactcagggcacaggactccgtgggctcagtctgccctgactcacgccctccctccgtcggtccgggtctccgtggacagtcagtccaccgtctcctgcagtcggaaccngcagtgtacgttgtgtcttagtaccgtntctcgtgtaccagcaccgccccaggcaccaccgaccccaactcagtgttagttttcgacgtactagtaacgtccggacctcggacgggtcctgtactcgtcttcgtcgtcggtctaagtcgtcgcgacgccgaccggtccttcccgtagttacttacttccgttcgtcgggtaccctaccgaacggtacgtacgggaacgggtaaccggtaacgggtacgttaacgtaaacgttttaagtttaacgttcgggacctaacgtaccgttactaaacgttaacgtaaaccggtaaacgggtaaacccttaacgtaaaccgttttaacggttacggtttaacccggttaccgggtaaaaccggttaaccggggaaaccctaaaaccgggttacccgtaaaccccggtttaccgtaaacgggttccccgaaaccgtaccccggaaaacccgggtccccctaaaacccccggtaacg

SEQ ID NO: 445 - DNA, 563 bp, Homo sapiens
  misc_feature: GYAE6OF01CZMP5.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgcccccaggcacacgcccccaaatcatgtattttgacgtcagtaactcggccctcgacggggtccctgatcgctttctcgtgggtccagtcgtggcagcacggcctccctgacttactctcgtgggctccagacgtggaggacggaggctagaattattattgacacgtctacaatagtaacgaagggaacaactacttagtcgttacttacggaacgtagggaacctaaacgtacctaccgtacgtacggtacacgacccgaaccggcccaacccactctaccacttcctccgttaccccaccctcctctacgtacc

SEQ ID NO: 446 - DNA, 447 bp, Homo sapiens
  misc_feature: GYAE6OF01CPX2Q.29.36.D03.1.454.CMB.1.raw
  modified_base (435)..(447): a, c, t, g, unknown or other
  misc_feature (435)..(447): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcaggggtccctgatcgcttctctgggtccaagtctggcagcacggcctccctgattatctcgtgggctccagactgaggacgaggctgaatattattgcagctcatatacaagggacaacacttatgtcttacggactgggaccaagtcaccgtcctaggtcacgcccaaggcccaacccactcgtcactctcgtccccgccctcctcagtacctctactctgacgcgggctcggcgaacggcgcatacgnnnnnnnnnnnnn

SEQ ID NO: 447 - DNA, 669 bp, Homo sapiens
  misc_feature: GYAE6OF01CEX08.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcacctcctcactcagggcacaggatcctgggctcagtctcgccctgactcacgccctcccgtccgtgtcccgggtctccgtggacagtcagtccaccgtctcctgcagtcggaaccagcaggtgacgttggtcgtacttaactaccgtgtcttccgtcggtaaccagccgaccgaccccgaggaccaacgaccgaacccccaaactctagtcgttaatttttcgaacgttacaacggttaacgtcccggaccgtcggtaccgggtcctgacgtccggtcttcgtcggtacggtaccgaacgttcgtcgcgacggccgaccggtcccgtccctagtactttacgtccgtcggtcgggtaccttcgaacggtaccggtgggaacggaacggaggtacgttagaaagtttacttagtcgatacgtcttaacaagttaacgaacgtaacggaacctataaccgttagttccgttaccgtacggtaacggtacggaacttaacggtacccgtaaccgtacgtacggaccacggaacccgaaccgacccacccgtaacg

SEQ ID NO: 448 - DNA, 561 bp, Homo sapiens
  misc_feature: GYAE6OF01EPHSX.29.36.D03.1.454.CMB.1.raw
  modified_base (436)..(436): a, c, t, g, unknown or other
  misc_feature (436)..(436): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctcctccgtgtccggtctcctggacagtcagtcaccgtctcctgcagtgaaccagcagtgacgttggtgcttataaccgtgtctcctggtaccagcacgcccccaggccacacgccccccaaatccatcgtatttttcggacgttcagttaatccggccctcgacggggtccctgactcgcttctcgtggtccaagtctggcagcacggcctctgattatctcgtggctccagcgtagaggacgaggtctagtaattatttatgacngtctacataactacgaaagggacaactacttatcggttacgtacggtaacgtacgggaacctaaacggtccctaccgtaccgtacggtaccacgtaccccgaacggacccctaaaccccgtaccg

SEQ ID NO: 449 - DNA, 661 bp, Homo sapiens
  misc_feature: GYAE6OF01CFY6W.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctcgtgtccggtctcctggacagtcagtcaccgtctcctgcagtggaaccagcagtgacgttggtgcttataaccgtgtctcctggtaccagcacgcccccaggccacacgacccccaaactcatgtatttttgacgttcagtaactccggccctcgacggggtccctgactcgtcttctcgtcgggtcctaagtctggcagccgaccggcccttcccgtgtactttactccgttacgtcgggtccctccgaaggtaccgtggaacgggtacggacgggtcctaagtaactttaagtttagttcgactaacggtccttacgtaagttaacgtaaacggaaacgggtaacctaaccgttaactttaacgttcggttaccgttaaccgggtaaccgttacgggaaaccctaaacggttcccgtaacccggttaccgttaacgggtaccaaccggacccccgtaaacgggaccccctaaacccccgtaccg

SEQ ID NO: 450 - DNA, 613 bp, Homo sapiens
  misc_feature: GYAE6OF01DJS73.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtatcctggtaccagcacgccccaggccacacgcccccaaactcatgtattttgacgtcagtaactcggccctcgacggggtccctgactcgcttctcgtgggtaccaagtctggcagtcaccggcctccctgtacttactctcgtgggcctcagtactggaggacgaggtctagtaattattagttgacagtctactaataacgtaacgaagggtaactaactactttaatcgtacgttaccggaacgtacggaaacctaaacgtacctaccgttaccgtacggtaccaccggtaccccgaaacggtacccccaacccgtacgttccgtacctaccttacccgttccgttcccccgacccctttccctaccgtacgtttaacccg

SEQ ID NO: 451 - DNA, 781 bp, Homo sapiens
  misc_feature: GYAE6OF01A88ER.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgtcttataaccgtgtcctcctggtaccagcacgccccaggcacacgccccaaactcatgtattttgacgtcaagtaactccggccctcgacggggtcctagactcgtcttcgtcgtcggtccaagtcgtggctacgcaccggccttccgtgtactttactcgttcgtcggggtcctccgacggtcgtacgaacgtagttacggtaccgggttagtaacttttaacttacgttcgtccgttcggtaccttaccgttaagttttccgacgtaacccgggtacccgtaccccggtacttaacggttcgggttaccgttaacggtttccccggggtttaccgggggtaacccggggaaaccgggggtaaacccctaacgggtaccccggttaaccgggttaaccccccgggttacgggtttaaacccgggtaccgtaacccgggtacccgtttaacccgggaaaccggttccccccgggttaccccggtaaccccccccggtttccgggttaccccttaaacccggtttcccccgtttacccggtttacccccccctttaaccccccggg

SEQ ID NO: 452 - DNA, 605 bp, Homo sapiens
  misc_feature: GYAE6OF01BR7AC.29.36.D03.1.454.CMB.1.raw
  modified_base (588)..(589): a, c, t, g, unknown or other
  misc_feature (588)..(589): n is a, c, g, or t
  modified_base (593)..(593): a, c, t, g, unknown or other
  misc_feature (593)..(593): n is a, c, g, or t
  modified_base (597)..(597): a, c, t, g, unknown or other
  misc_feature (597)..(597): n is a, c, g, or t
  modified_base (600)..(600): a, c, t, g, unknown or other
  misc_feature (600)..(600): n is a, c, g, or t
  modified_base (603)..(603): a, c, t, g, unknown or other
  misc_feature (603)..(603): n is a, c, g, or t
  modified_base (605)..(605): a, c, t, g, unknown or other
  misc_feature (605)..(605): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcacgcccccaggcacacgcccccaaactcatgtatttttgacgtcagtaatcggccctcgaggggtccctgactcgcttctcgtgggtaccaagtctggcagcacggcctcccgtgtattactctcgtgggctccagctggaggacgaggctagtaatatttatggacagctacatatacgaaggacaacgtacttaatcgttacgttacgggtaacgtagggaaccctaaagtccgaccgtaccgtaaggtaccacgtacccgaacggacccaaaccccacgtcgtaccacgttaccgtccgttccccgacccttccctacctaaggttaccttctaacttcgtacggaacggtccgggtcgtaccgggaccgaaacgggtcccgtaaccgtagttaaacggctaaccgcgtactactacacgtactctcgtacgacgacgctcgtacactcgcgtanngacnactncanctngn

SEQ ID NO: 453 - DNA, 629 bp, Homo sapiens
  misc_feature: GYAE6OF01EELRI.29.36.D03.1.454.CMB.1.raw
  modified_base (216)..(216): a, c, t, g, unknown or other
  misc_feature (216)..(216): n is a, c, g, or t
  modified_base (339)..(339): a, c, t, g, unknown or other
  misc_feature (339)..(339): n is a, c, g, or t
  modified_base (343)..(343): a, c, t, g, unknown or other
  misc_feature (343)..(343): n is a, c, g, or t
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtncttataaccgtgtctcctggtaccagcacgccccaggcacacgacccccaaactcatgtattttgacgtcagtaactccggccctcgacgggtccctgtctcgtcttctcgtcggtccagtcnggcngcacgcctcctgtattactctcgtcggcctccgagtacgtaggacggacgtaggtctagtaacttattatcgacgacgtctactaataacgtaacggaagggtaactaactactttagtcggttaccgttacggtaacgtacgggtaaacctaaacgtacccgtaaccgttccgtaacggtacccgaacggaaccccgaaccggtacccctaaaccccgtacgttccgtaccctaaccgttcccgttcccgttacccccgacccctttcctccctacggttaaccc

SEQ ID NO: 454 - DNA, 772 bp, Homo sapiens
  misc_feature: GYAE6OF01B1HME.29.36.D03.1.454.CMB.1.raw
  modified_base (242)..(242): a, c, t, g, unknown or other
  misc_feature (242)..(242): n is a, c, g, or t
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagccctccctccgtgtccgggtctcctggacagtcagtcaccgtctcctgcagtggaaccagcagtgacgttggtgcttataaccgtgtcctcctggtacngacgacgacccgccccgaggaccaccgaccccgaacccctaactctagttacgttttacgttttacgacgttacgtaacgttaccgtcccggtccccgtacggggtacccgggttccgtacgtaccgtccgttcctttcgtccggttaccggtaaccgtacggtcggtcggacgaccgacccggtacccggtcccttccgtagttaactttactccgttcggtccggtaccctacgacgtacgtagggaacggacggtagtacgtaattaactttacgttagtccgacgtacttccgtaataagttaacaaaccgggaacgtaacctaacgtttacgttacggttaccgttaccggttaacggtaaccgggtaacggtaaaccctaaccgggtcccttaaccgtacggtccggaccgtaaccccgaaccgtaaccccggaaccccctaaccgtcccgtttacgtaccccgtacctttcccggttaaccccccgtttaccccccacccttcccggttaacccgttaacccg

SEQ ID NO: 455 - DNA, 596 bp, Homo sapiens
  misc_feature: GYAE6OF01AWGPZ.29.36.D03.1.454.CMB.1.raw
  modified_base (225)..(225): a, c, t, g, unknown or other
  misc_feature (225)..(225): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctcgtgtccgggtctcctggacagtcagtcaccgtctcctgcagtggaaccngcagtgacgttggtgcttataccgtgtctctggtaccagcacgccccaggcacacgaccccaaactcatgtattttgacgtcagtaactccggcctcgacgggtcctgactcgcttctcgtcggtccaagtctggcacgcctaccggtcctcccgtagtactttactccgttacgtcgggtccctaccgacgtacgtaggacgggacgaggtacttaggtaactttattagttgactagaccttacgaattaacgtaacggaaggtaacctaactacgtttatcgttacgttacggaaacgtcgggaacctaaaggtccgaacccgttcgtaacggtccaacggaccccaacggtccccaaaccccgtacg

SEQ ID NO: 456 - DNA, 684 bp, Homo sapiens
  misc_feature: GYAE6OF01A8DMX.29.36.D03.1.454.CMB.1.raw
  modified_base (201)..(201): a, c, t, g, unknown or other
  misc_feature (201)..(201): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccngcagtgacgttggtgtcttaataaccgtgtcctccgtggtaccagccacgccccaggccacacgacccccaaactcatgtattttgacgtctagtaactccggtccctcgacgggtcctgactctcttctcgtggtccaagtcctggctacgccacggccctccgtacgcctactccgtccgtcgggtacctccgacgggtctacggaacgtagtacggtacggttagtaacgtttaacgttacgtcgtacgtcgtacttacgttacgttacggaccgaacgtcccgaacccgtacgtacgttcgtacgtaacgtttccgggttaccgggaccgggtaacgggtaacccgtacggtcccgtacgggtaccccgttaccgggttacggtaccgtaacggttaccgaccggtaacgtcccggttaccccgtacccccgttacggtacccttaccttcccggttccccgttacccccgtacccccg

SEQ ID NO: 457 - DNA, 701 bp, Homo sapiens
  misc_feature: GYAE6OF01C1XMM.29.36.D03.1.454.CMB.1.raw
tcagatagagtactcacgaccggtgctcgatttagctgcgtcacgatctctcttggggatctcaggaggcagctctctcggaatatctccaccatggcctggctctgctcctcctcacctctcactcgaggcacaggatccgtgggctcagtctcgccctgactcacgtccctcccgtcgtcggtccggtcctcgtggacagtcagtccaccgtctccgtgcgaggtacgaaccagacgtaggtcggtacggttggtcgtacttaacgtaccgtcgtcctcgtacgtaccacgaccaccgccccaggccaacaccgaccctaactctagtcgttacttttcgacgttacgtacgtacgtccggtaccgtcggtaccgggttcctgtactccgtacgttcgtcggttacggaccgtacgtcgtacgacgtacgtccggtaccgtcccgttaaccgtgttacttacgtccgtcggtaccgggtcaaccgtacgtacggtaggaacgggtacggtacgtacgtaaagttaacttacgttgtacgactacgcttaacgaacttaagaaaccggtaacggtaacctaacgtttacgttagttaccgtaccggttaacggaaccggttaaccggaacgtaacggtacccgtaccgttaacggtaccgtaaccgacccggaaccgtaaccccaccaaacccggttccg

SEQ ID NO: 458 - DNA, 728 bp, Homo sapiens
  misc_feature: GYAE6OF01AMPSU.29.36.D03.1.454.CMB.1.raw
  modified_base (215)..(215): a, c, t, g, unknown or other
  misc_feature (215)..(215): n is a, c, g, or t
tcagatagagtactcacgaccggtgctcgatttagctgcgtcacgatctctctcggaatatctccaccatggcctgggctctgctcctcctcaccctcctcactcagggcacaggatcctggctcagtctgccctgactcagcctccctccgtgtccggtctcctggacagtcagtcaccgtctcctgcagtcggaaccagcagtgacgttggtncttataaccgtgtctcctggtaccagccacgcccccaggccacacgcccccaaactcatgtattttgacgtcagtaactccggccctcgacgggtccctgactcgtcttctctcggtccaagtctgcagcacggcctcctgtacttactctcgtgggcctccgagtacgtggaacggacgaggtcttaagtaacttagtttacgttcgactacggtacctactaacgttaacgtaaccggaaacgggtaaccctaaacgttacctttaagttaccggtttaccgtttaaccggggtaaaccgttaccgggggtaaacccttaaaacgggttcccgtaacccggttacccgttaaccgggtacccgtaaacccgggtacccccgtaaaaccgggtacccccctaaaacccccgtacggtttaccggttacccctaacccggtttaccccgttaccccggtttaacccccccgttaacccccgttttaccccgtacccgtaacggtttaaccccc

SEQ ID NO: 459 - DNA, 695 bp, Homo sapiens
  misc_feature: GYAE6OF01EWI5I.29.36.D03.1.454.CMB.1.raw
  modified_base (217)..(217): a, c, t, g, unknown or other
  misc_feature (217)..(217): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagccctccctccgtgtccgggtctcctggacagtcagtcaccgtctcctgcagtggaaccagcagtgacgttggtncttataaccgtgtctccgtggtaccagccacgcccccaggccacacgacccccaaatcatgtattttgacgtcagtaactccggccctcggacgggtccctgactcgtcttctcgtcggtccaagtctggcagccacggtccctcctgtacttactctcgtcgggcctaccgagacgtaggacggacggacggtctaagtaatttattagttcgactagtccttactaattaacgtaaccggaaagggaacctaaacttacgtttaacgtcggtttaccgttaccggggtaaacgttaccggggtaaaccctaaacggttcccgtaacccggttacccggttaacgggtacccgtaaacccggaacccccgtaaaccgggtaaccccctaaacccccgtaccgttacggtacccctaacccgttcccgtttaccccggttcccccctacccctttccctaccgtaaccgtttaacccc

SEQ ID NO: 460 - DNA, 815 bp, Homo sapiens
  misc_feature: GYAE6OF01C34VB.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcacctcctcactcagggcacaggactccgtgggctcagtctcgccctgactcacgccctccctccggtggtccgggtctccgtggacagtcagtccaccgtctccgtgcaggtcggaaccagcgtaggtcggtacggttggtcgtacgtttaacgtaaccgtgttcctaccgtacggtaccacggccgaccgacccccgagggacccaacccgaacccgaacccccctaaaactccgtaacgtttacggtttaacgttttttacggaaccggtttacgtaaacggtttaaccgttcccgggtaccccgttaccgggtaaccgggggttcccttacggtaaccgtttcccgggttacccttttcccggttaccgggtttaccggggttaacccgtaaacggtttccggtacgggaccgaacgggtacccgtaacccgggtcccttacccgtacggttaactttacgttccgttaccgggtacgggtccctaccgaacggtaaccggtgggaacgggacgggtacggtacgttaagtaactttagttacgtcgacgtacgtactacgtaactaacgtaaacggaacggtaacctaacgttaacttacgtacggttaccgttaacgggtaaccgtaacgggtaacctaacgtcccgtaaccggtacgtacgtaccgacgacccgaaccgcccaacccgtacg

SEQ ID NO: 461 - DNA, 639 bp, Homo sapiens
  misc_feature: GYAE6OF01EX570.29.36.D03.1.454.CMB.1.raw
  modified_base (229)..(229): a, c, t, g, unknown or other
  misc_feature (229)..(229): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctcagtctcgccctgactcacgcctcctccgtgtccgggtctcctggacagtcagtcaccgtctcctgcagtcggaaccngctaggtcgtacggttggtgtcttacgtaccgtgtctccgtaggtaccagcaccgccccaggccacaccgaccccaaactcagttcgttattttcgacgtacaacggttaacgtccggacccgtcggtacgggtcctgtacttcgtcttctcgtcgggtacctaaggtcgtcggcacggtccgaccgtcccttccgtagtactttactcgtcggtcggtacctcgtaagtacgtacggaggtacgaggcgttaagtaattagttacgtcgacgaacgtcctaacgtaagttaacgtaacggaaacggtaacctaacgtactttaacgttcggttaccgtaacggtaacgtcgggaaacctaacggtcctacccgtacgtacgtaccacgaacccacgaccccaccgtacg

SEQ ID NO: 462 - DNA, 768 bp, Homo sapiens
  misc_feature: GYAE6OF01EI8QF.29.36.D03.1.454.CMB.1.raw
  modified_base (745)..(745): a, c, t, g, unknown or other
  misc_feature (745)..(745): n is a, c, g, or t
  modified_base (757)..(757): a, c, t, g, unknown or other
  misc_feature (757)..(757): n is a, c, g, or t
tcagatagagtactcacgaccggtgctcgatttagctgcgtcacgatctctcttggggatctcaggaggcagctctctcggaatatctccaccatggcctgggctctgctccctcctccaccctcctcactcgacgggcacgaggactccgtgggctctagtctcgcctgactcacgccctcccgtccggtcggtccgggtcctccgtggactacgtcacgtccaccgttcctccgtgcgaggtacggaaccgagacgtaggtcgtacgggttggttcgtacgtttaacgtaccggttcgtccgttaccggtacggtaccgacgaccgacccggcccccgaaggacccaaccctaacccgacccccctaaaagtcctaagtttacggtttacttttacggaccgttacgtaacgtaccgtcccggtccgtaccgggtaccgggttcctagtcgttccgttcttaccgtcggtacggttaccgacggttcgacgggtaccacggtaccggtacccggtcccttaccgttaagttacctttaccggtccgtcgggtcggtacccctacgggaacggtaccgtaaggggaccgggaaggtacggtacgttaagttaacttagtttaccgtgaaccgtcgtacctaacgtaagttaaccgtaaaccggaaacggttaaccttaagttacgttacgttacgttaccgaagggtaccgtaacggactaacggtcctacgtcgtacgtaccncgaaccccgacnccccaaccgtc

SEQ ID NO: 463 - DNA, 686 bp, Homo sapiens
  misc_feature: GYAE6OF01EC2ZX.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggactccgtgggctcagtctcgccctgacctcacgccctccctcgtcggtccggtctccgtggacagtcagtccaccgtctccgtgctaggtacggaaccaggcgaggtcggtacggttggtcgtacttaacgtaaccggttgtccttccgtacggtaccacgccgaccgccccaggccaccaccgaccccctaaactcattgtacttttcgacgtacagtaacgtccggtaccctcggtacgggtcctagacgtcgtcttcgtcgtcgggtacctaagtcgtcggcacggccgaccggtcccttccgtagtaactttacgtccgttcggtccggtacctaccgtaacggtacgttacgggaacgggtaccggtacgggtaccgttaaggttaaactttacggtttaagttcgacgtaacgtactaacgtaagtaaacgtaacggaaacgggtaacctaacttacgttattcggttaccgtacggtaacggtacggaacctaacggtcaccgttacgacgtaccacgacccaacgcccaacccgtccg

SEQ ID NO: 464 - DNA, 697 bp, Homo sapiens
  misc_feature: GYAE6OF01AFY48.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctcgtgtccgggtctcctggacagtcagtcaccgtctcctgcacgtggaaccagcagcgatgtcggtgttatacttgtctctgtaccaacaacaccaggcgacgccccatctatattatgatgtatatagcgcctcgacggtcctgatcgtcttctcgtcggtctaccgtagtcgtcggacaacctacgtcgtcccctcccgtacgacctacgttccgttacgtcgggtaccctacccgacgggtcctacgggtaacgtaacgtacgggtaccgggttagttaacgtttaacttaccgtggtccgttcggtacctttacggttacgtttcggaccggtaaccggacccgtacccggtccgtacgtttggtacgtacggtttcccgttaacgggggaccgggtaaacgggtaacctaacgggtccgttaaccgggtccgtttacccgagggttaccgtacgtcccggaaccggtaccggttacccgtccccggttcccccggttacggtccccttaacccgtcccgtttcccggttcccccgtacccccg

SEQ ID NO: 465 - DNA, 559 bp, Homo sapiens
  misc_feature: GYAE6OF01BT73R.29.36.D03.1.454.CMB.1.raw
  modified_base (335)..(335): a, c, t, g, unknown or other
  misc_feature (335)..(335): n is a, c, g, or t
  modified_base (528)..(528): a, c, t, g, unknown or other
  misc_feature (528)..(528): n is a, c, g, or t
  modified_base (533)..(559): a, c, t, g, unknown or other
  misc_feature (533)..(559): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcacgcccccaggcacacgccccaaatcatgtatttttgacgtcagtaatcggccctgacggggtccctgatcgcttctcgtgggtaccaagtctggcacgccgacggcctcccgtgattatcttcgtcgggccttaccaggactggaggacgaggtctagaattattattgcagctacgattaacgtaacgtaacggaactaactnttagtcgttacgttaccggaagtacgggaacctaagtccgtaacccgtcgtaacgtccacgacccgaacggacccctaaacccacttcgtacttacccgtcgttaccgtacccctacccttccctacgtaactacctcttactcgtacgcggccgggtctacgggaccgtaacggacctactacggttaagcngtacnnnnnnnnnnnnnnnnnnnnnnnnnnn

SEQ ID NO: 466 - DNA, 772 bp, Homo sapiens
  misc_feature: GYAE6OF01EBW5U.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcacgcctccctcgtgtccggtctccgtggacagtcagtcaccgtctccgtgcaggtacggaaccagcagttcgacggttggtgtacttaactaaccgtgtcctcgtaggtaccagcaaccgccccgaaggaccacaccgacccctaaagtcattgttattttcgacgtcaagtaacgtccggtcctcggacgggtcctgactcgtcttactcgtcggtacctagtcgtcggcacgcgaccggtcctaccgtagtacttcgtacgttcgtcggctacgacgtacgtgggaacggacggtacgggtactaggtaaatttacgtttaacgtacgtacgtaacgtaccttaagtaaacgttaacgtaaaccggtaaacggggtaaaccttaaaccttaacggtttaagtttacggttaaccggttaaccgggtaaaccggtaacgggtaaacccttaaacggtccccgttaaccggttacccgttaacgggtaaaccgacccggtaaaaccccgtacccgggtaaaaccccctaaacccctacggttacccggttaaaaccccttccccggttacccgtttccccggttaccccccgtaaccccctttacgtaaccgtttaaccggttaaaccccg

SEQ ID NO: 467 - DNA, 833 bp, Homo sapiens
  misc_feature: GYAE6OF01C7N71.29.36.D03.1.454.CMB.1.raw
  modified_base (812)..(812): a, c, t, g, unknown or other
  misc_feature (812)..(812): n is a, c, g, or t
tcagatagagtactcacgaccggtgctcgatttagctgcgtcacgatctctctcggaatatctccaccatggcctgggctctgctcctcctcaccctcctcactcgagggcacgaggactccgtgggctcagtctcgccctgactcacgccctcccgtcgtcgtccggtctccgtggacagtcacgtccaccgttctcctgacgaggtacggaaccagcgaggtcgtacggtttggtacgtacctttaacgtaccggttcgtccttaccgtacggtaccacgaccaacccggcccccgaaggaccaacccgtaaccccgtaacccccctaaaacttccgtaagtttacggtttaacgtttttaccggaccgttaacgtaaaccggttaaccgttccccgggtccccgttacggtaccggggttccctacggtacgttcccgttaccgttttccgtcggttacgggtaccctaaggttccgtacggtccgacgtcccgtacccgggtcccctttaccgtagttaacctttcgttcccgtaccggttacgggtcctaccggtacgtacggttagggacggtacggtacggtacgttagtaaactttagttacgtacgactacgtcgtaactaacgtaaacgaaccgtaaacggtaacctaacgttaacgtttacggttaccgttaacggttaccggaaacgttaccggaaacgttaaccgttaccgtaccggttacgtaacggtaccgaccgacccgtaaccgtacccctaaccctacgttccgtacccttcccgttcgttacccgttaccccnccttaccctggtacccttacg

SEQ ID NO: 468 - DNA, 658 bp, Homo sapiens
  misc_feature: GYAE6OF01DXHBL.29.36.D03.1.454.CMB.1.raw
  modified_base (232)..(232): a, c, t, g, unknown or other
  misc_feature (232)..(232): n is a, c, g, or t
  modified_base (260)..(260): a, c, t, g, unknown or other
  misc_feature (260)..(260): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctcagtctgccctgactcacgcctccctccggtcgtcccggtctccgtggacagtcagtccaccgtctcctgcagtcgaaccngcaggtgacggttgtgtcttactacgtntctctcgtacacgcaccgccccgaggaccaacaccgacccctaaactctagttcgttactttttcgacgttacgtaagtaacgtccggaccgtacggacgggttcctgtactcgtcttcgtcgtcggtacctaagtcgtgcacgccgacgtcccttccgtagtacttacgtccgtcggtcggtcctacgacgtacgtcggaacgggacgtacggtagtaagttaatttacgttagttacgacgtaacgtccttaactaagttaacgtaaacggaacggtaacctaacgttaacttagttcgttaccggttacgtaaacggtaaccgggtaacctaaacgtccgaaccggttacgtaccggtacgaacccgtacccgaacccgtaccctaacccgtacg

SEQ ID NO: 469 - DNA, 550 bp, Homo sapiens
  misc_feature: GYAE6OF01AH56E.29.36.D03.1.454.CMB.1.raw
  modified_base (241)..(241): a, c, t, g, unknown or other
  misc_feature (241)..(241): n is a, c, g, or t
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccngcacgcccccaggcaccacgcccccaaactcatgtatttttgacgtcagtaactccggccctcgacggggtccctgactcgcttctcgtggtccaagtctggcagcacggcctcctgtattatctcgtgggcctcgagactaggaggacgaggtctagaattattattcgacagctactatataacgaacggacaactacttatcgttacgttacggaactacgggaacctaacgtccaccgtcctaggcacgacccgacggcccacccactcgtcctactcttccgtcccaccctcctcgtacgtacc

SEQ ID NO: 470 - DNA, 612 bp, Homo sapiens
  misc_feature: GYAE6OF01BH470.29.36.D03.1.454.CMB.1.raw
  modified_base (244)..(244): a, c, t, g, unknown or other
  misc_feature (244)..(244): n is a, c, g, or t
  modified_base (434)..(434): a, c, t, g, unknown or other
  misc_feature (434)..(434): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttaataaccgtgtctccgtcggtaccngcacgccccaggccacacgaccccaaactcatgtacttttgacgtacagtaacgtcggcctcgacggggtccctgactcgtcttctcgtcggtacaagtcgtgcagcacgcctcctgtaacttactctcgtcgggtctaccgagacgtggaacggacgaggtctagtaattagttattgactacgtctanaactaataacgaaaggtacaactacttagtcgtacgttacggaacgtacggaacaaacgttccgaccgttaccgtacggtaccgacggtaaccccgaacggaccctaaaccccgtacgtccgtacctaaccgttccgttaccgttaccccctaccctcccgttaacgtacggttaccc

SEQ ID NO: 471 - DNA, 685 bp, Homo sapiens
  misc_feature: GYAE6OF01BXSDH.29.36.D03.1.454.CMB.1.raw
  modified_base (253)..(253): a, c, t, g, unknown or other
  misc_feature (253)..(253): n is a, c, g, or t
  modified_base (328)..(328): a, c, t, g, unknown or other
  misc_feature (328)..(328): n is a, c, g, or t
tcagatagagtactcacgaccggtgctcgatttagctgcgtcacgatctctcttggggatctcaggaggcagctctctcggaatatctccaccatggcctgggctctgctccctcctcaccctcctcactcagggcacaggatccgtgggctcagtctcgccctgactcacgcctccctccggtcggtccgggtctcctggacagtcagtccaccgtcctcctgcaggtcggaaccagcagtgtacgttggtncttataaccgtgtctcctggtaccagccgacgcccccaggccaacaccgaccccaactcatgtattttgacgtanagtaactccggccctcggacggtcctgactcgtcttctcgtcggtacctagtcgtggcagtccgaccgtccctaccgtagttactacgtcgttcgtcgggtccctaccgaacgtacgtcggaacgggacgtacggacgtaaggttaattaacgtttacgttcgacggtacggttactacgtaacttaaacggtaacgaaaccggtaacctaacttaacgttattcccggttacggttaaaccgggtaacccggtacgggtaaaaccccgtaaacggttccccgtaaacccgggttcccggttaacgtacccgaacccggaaccccgtaacccgggaacccccctaacccgttacccg

SEQ ID NO: 472 - DNA, 767 bp, Homo sapiens
  misc_feature: GYAE6OF01E0FJD.29.36.D03.1.454.CMB.1.raw
tcagatagagtactcacgaccggtgctcgatttagctgcgtcacgatctctctcggaatatctccaccatggcctgggctctgctcctcctcacccctcctcactcaggcacaggatcctgggctcagtctgccctgactcagccctccctccgtcgtccggtctcctggacagtcagtccaccgtctcctgcagtcggaaccagcagtgacgttggtgtacttataaccgtgtcctccgtaggtaccagccacgccccgaggcaccaccgacccccaaactcatgttattttcgacgttcaagtaacttcggcccgtacgtcgggtccctgtactccgtcttcgtcgtcggtacctaagtcgtcgcgacgaccgaccggtcctcctagtacttacgtcgtcgtcggtcctaccgagtacgtaggaacggacgtaggtcgtaagtaatttacgttagtcggactacgtccttaacgaacgttaaacgtaaccgaaacggtaacctaaaccttacgttaacgttcggtttaaccggtaaccgggtaaccgttaaacgggtaaaccctaaacggttccccgttaaacccgtacccgttaaccgggaccctaaaccccgggtaaaccccgtaaacccgggtaaacccccccttaaaccccggtaaccgtttccccgggttaaaccctaaccccgtttcccccgtttaaccccccgttaccccccgttaacccccgttacccgtttaaacccgaacccgttttaaaccccg

SEQ ID NO: 473 - DNA, 679 bp, Homo sapiens
  misc_feature: GYAE6OF01BXYAZ.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgtacgttggtgtctttaacgtaaccgtgttcctccgtggtaccagcacgccccaggcaccaccgaccccaaactcatagtattttgacgtcagtactccggcctcgacggggtcctgagtcgtcttctcgtcggtccaagtcgtggcacgccaccggtcctccgtagtattactcgtcgtcggcctccgaacgtacgtgggacggacggaggtacttaagaactttaatttagttacgacgtaggtccttactaataacgtaaacgaacgggtaacctaaacttacgtttacgtacgtttaccgttaccggtaaccgggtacgggaaaccgtaacggttaccgtaccggttaccgttaaccgggtactaacccggaacccgtaaacccggtaccccaaccccgttacgtccgttacctacccttccgttaccccggttccccgtacccgttaccctcgtaacccgtttacccg

SEQ ID NO: 474 - DNA, 695 bp, Homo sapiens
  misc_feature: GYAE6OF01B8DKY.29.36.D03.1.454.CMB.1.raw
  modified_base (194)..(194): a, c, t, g, unknown or other
  misc_feature (194)..(194): n is a, c, g, or t
  modified_base (206)..(206): a, c, t, g, unknown or other
  misc_feature (206)..(206): n is a, c, g, or t
  modified_base (235)..(235): a, c, t, g, unknown or other
  misc_feature (235)..(235): n is a, c, g, or t
tcagatagagtactcacgaccggtgctcgatttagctgcgtcacgatctctctcggaatatctccaccatggcctgggctctgctcctcctcacccctcctcactcagggcacaggatcctgggcctcagtctcgccctgactcacgcctccctcgtgtcccgggtctcctggacagtcagtccaccgtctctncagtcggaaccngcagtgacgttggtgtacttaataccgtntcctccgtaggtaccagcacgcccccaggccacacgacccccaatcattcgtatttgacgtctacgtacgtccgtccctgtaccgggtcctaggtactcgtccttcgtccgttacgggtacctaggttcgtacggcacgccgaaccgggtccctaccgttagtaacgtttctccgtcgtcgggccttaccggaagtcgtagggacggtacggtagtactagtaattagtttatcgacgacgtctacgtaataacgtaacggaacgggaaccttaacctagttacttaacggtttacccggttaccggtaacgtaccgggaaaccgttaacgtaccgtaccgttaccgtaaccggtacacccgggtaacccgtaaacggaccccctaaccctaggttacccgtcccttaaccgttcccgtacccgtttaccccctacccgtacccttccgcgtttaacccg

SEQ ID NO: 475 - DNA, 657 bp, Homo sapiens
  misc_feature: GYAE6OF01BM21C.29.36.D03.1.454.CMB.1.raw
  modified_base (215)..(215): a, c, t, g, unknown or other
  misc_feature (215)..(215): n is a, c, g, or t
  modified_base (220)..(220): a, c, t, g, unknown or other
  misc_feature (220)..(220): n is a, c, g, or t
  modified_base (241)..(241): a, c, t, g, unknown or other
  misc_feature (241)..(241): n is a, c, g, or t
  modified_base (309)..(309): a, c, t, g, unknown or other
  misc_feature (309)..(309): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctcgtgtccggtctcctggacagtcagtccaccgtctcctgcagtcggaaccagcagtgacgttggncttanaccgtgtcctccgtggtaccngccacgccccaggcacacgaccccaaatcatgtattttgacgtcagtactccggcctcgacgggtccngtactcgtcttctcgtcggtactagtcgtcggacacgtaccgacggtccctaccgtgtaactttacgtccgttcggtaccggtcctaccgacggtaccgtagggaacggtacggtaacggtcgtaagtaaacgttactttacgttacgaccgtacgtcttacgtaacgttaacgtaacggaacgggtaacctaaacgttacgtttagtccgtacgttacggaacgttacgggaaccttaacgtccgtaccgtcgtacggtacgtaccgacccgtacggacccctaaccgtaccgtcggtacctaccgtccttacccgtccccgtacctccgtaccgtacgttaacccg

SEQ ID NO: 476 - DNA, 876 bp, Homo sapiens
  misc_feature: GYAE6OF01BBJMR.29.36.D03.1.454.CMB.1.raw
  modified_base (230)..(230): a, c, t, g, unknown or other
  misc_feature (230)..(230): n is a, c, g, or t
tcagatagagtactcacgaccggtgctcgatttagctgcgtcacgatctctctcggaatatctccaccatggcctgggctctgctcctcctcaccctcctcactcgaggcacaggatccgtgggctcagtctcgccctgactcacgccctccgtcgtcgtccggtctcgtggacagtcacgtcctaccgtctccgtgcaggtacggaacagcgtagtcggtacgttggtntacttaacgtaaccgtcgttcctccgtacggtaccacgccgaccgacccccgacggaccaacccgaacccgaaccccctaaaacgtactacgtttacgtttacgtttttacggaccgttaacgtaaccggtaaccggttcccgggtacccggttaccgggtaccggggttccctacggtaccgttccggttccgtttaccgttaccgggttaccgggttaacctaacgggttccgtacgggtaccgtacggtacccggtacccgtccccgttaccgtttacgttaaccgttaccgttcccgttacgggtacccggtaccgtaccggaacggttacgggtacggggaaccgggtaacggtacggttaacttaacggttaaatttacgttacgtcggtactaaccggtacttaacggtaacgttaaacgaaaccggtaaacggttaacctaacgtttaaccgttacggttccgttaaccggttaaccggtaaccggtaaccggtaaaccgtacgtacccgttaaccggtaccggtaacggtaacccacccgggtaaacccgaccggtaacccctacgtacgtcccgtaccttacccgttccgttacccccttaccccgtacccttaccgtaacgttacccgttacccg

SEQ ID NO: 477 - DNA, 764 bp, Homo sapiens
  misc_feature: GYAE6OF01DBJP7.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcacctcctcactcgagggcacaggatccgtgggctcagtcctgccctgactcacgccctccctcgtcggtccgggtctccgtggacaggtcagtccaccgttctcctgcgagtcggaaccaggcagtgtacggttggtacgtctttaacgtaaccgtgtaccttccgttacggtaccaggccaccgacccccgacgggacaaccgaaccgacccccaaaactccgtaagttcgttacgttttttacggaccgttaactaaggtaacgtcccgggtaccccgtcgggtacggggttcccctggtaacgttccgttccgttacgttccgttacgggtaccctaaggttcggcggtacgaacggccgtaaccggtccccgttccgtagttaaccttcgtttccgtcgtaccggggctttacccgaggtaaccgttagggacggaccggtaggtacgttacggtaatttaacgttgttacgtcgacgttactacgtaattacgtaaacggaaggtaacctaacgttaacgtttacgtacggttaccgttaacggggaaccgttacgggaaacccttaaacgggtcccctaacccgggttaccgtaacggtacccggaaccggtacccaaaccggccccgtaacccgtacccg

SEQ ID NO: 478 - DNA, 731 bp, Homo sapiens
  misc_feature: GYAE6OF01DMOU6.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctcgtgtccgggtctcctggacagtcagtccaccgtctcctgcagtcggaaccagcagtgtacgttggtgtcttaagtaaccgtgtcctcctggtaccagcacgccccaggccacaccgaccccctaaactcatgtattttcgacgtctaagtaactcggccctcgtacgggtccctagtactcgtccttcgtccgtacggtacctaagtcgtgtacacgaccgtacggtccctcctagtacttacgtctcgtcggtcctaccgacgacgtaggacggacgacgtctaagtaattatttagctactacgtcctaacgtaattaacgaaccgtaaacgggtaacctaaaccgttaacgtttaacgttaccgtttaccggtttaaccgggtaaaccgggtacggggtaaaacccttaaaccggttacccgtaaccccggttaaccggtaaccgttaccgaaacccggaaaccccggtaaaccccgggaaccccctaaaacccccgtacgttaccgttaaccctaccgtttaccccgttacccggttaacccccctaccccgttaccctacgtaaaccgtttaccc

SEQ ID NO: 479 - DNA, 677 bp, Homo sapiens
  misc_feature: GYAE6OF01EG5VH.29.36.D03.1.454.CMB.1.raw
  modified_base (223)..(223): a, c, t, g, unknown or other
  misc_feature (223)..(223): n is a, c, g, or t
  modified_base (319)..(319): a, c, t, g, unknown or other
  misc_feature (319)..(319): n is a, c, g, or t
tcagatagagtactcacgaccggtgctcgatttagctgcgtcacgatctctcttggggatctcaggaggcagctctctcggaatatctccacatggcctggctctgctcctcctcaccctcctcactcagggcacaggatcctgggctcagtctgccctgactcagcctccctccgtgtccgggtctcctggacagtcagtccacgtctctgcagtggaaccngcagtgacgttgtgtcttagtaaccgtgtcctccgtggtaccagccacgcccccaggcacacgacccccaaactcatgtattttgacgtcagtaancggtcctcgacgggtcctgactcgtcttcgtcgtcggtccaagtctgcgagccgaccggtccctccctagtacttactcgttcgtcgggtaccttaccaacggtacgttacgggacgggtaccgggacggtacttaaggtaaacgtttagtttaagttcgtacgtaacggtccttaacgtaaacttaacgtaaccgaaacgggtaacctaaaccgttaacgtttacgttacggttaccgtttaacccgggaacgtttaccggggaaacccttaaacggtcccgtaacccggttacccggttaaggttaccccgaacggtaacccccgaaacggtaccccctaaccccgttaacccggg

SEQ ID NO: 480 - DNA, 469 bp, Homo sapiens
  misc_feature: GYAE6OF01AVFKH.29.36.D03.1.454.CMB.1.raw
  modified_base (459)..(469): a, c, t, g, unknown or other
  misc_feature (459)..(469): n is a, c, g, or t
tcagatagagtactcacgaccggtgctcgatttagctgcgtcacgagtctctcctggacagtcagtcaccgtctcctgcagtggaaccagcagtgacgttggtgcttataccgtgtctcctggtaccagcacgccccaggcacacgccccaaactcatgatttttgacgtcagtaatcggccctcgagggtccctgatcgcttctctgggtccagtctggcagcacggcctcctgattatctcgtgggcctccagactggacggacgaggctgaattatttagtgcagctcatataacgaaggaccaactacttatgtcttacggactagggaaccaaagtccaccgttcgtacggtcacgacccaacggaccccaacccgtactcgtactaccgtcttcgttcccccgcccttcctcacgttacctcttactctagcggcggctggcgaaggcacatnnnnnnnnnnn

SEQ ID NO: 481 - DNA, 817 bp, Homo sapiens
  misc_feature: GYAE6OF01D4BTT.29.36.D03.1.454.CMB.1.raw
  modified_base (231)..(231): a, c, t, g, unknown or other
  misc_feature (231)..(231): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctcagtctgccctgactcacgccctccctcgtgtccgggtctccgtggacagtcagtccaccgtctcctgcagtcggaaccngcgagtgacggttggtcgtactttaacgtaaccggttgtcctaccgtcggtaccagccaccgcccccgaaggcccaaccaccgaccccctaaaactcctaagtgtttacgtttttcggaccgttactaacgttaacgtcccgggtaccccgtaccggtaccggggtcccttacggcgttaccgtcccgtttccgtacccggttcggggttaccctaaacggttccggtacggtaccgaacggacccgtaacccgggtccccttacccgttagtaaccttttacgtcccgtttcggtccggggtaccccttacccgaaggttaccgtaagggaaccgggtaccggtaacgggtacgttaaggttaactttaaagtttgttaccgggaacttacgggtaccttacgtaaacgttaaacgaaacggaaacgggtaaccttaacgtaacgttttacgttacgtccgggtttaaacggttaaccggtaaaccgggttaacccgaaacgttacccgtacccgggttaacctaccggggtaaccctacccggaaaccccggaaccccgttaacccccaaccccgttaacccgg

SEQ ID NO: 482 - DNA, 695 bp, Homo sapiens
  misc_feature: GYAE6OF01EGAJG.29.36.D03.1.454.CMB.1.raw
  modified_base (199)..(199): a, c, t, g, unknown or other
  misc_feature (199)..(199): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcacgccctcctccgtgtccgggtctccgtggacngtcagtcaccgtctcctgcagtcggacagcagtgacgttggtgtcttagtaaccgtgtctccgtgtaccagcaccgccccaggccaccaccgacccccaaacgtcagttgttacgtttttcggaccgttactaagttaacgtcccggtcccctccggtacggggttcctaggtactccgtcttccgttcgtcgggtacctaacggtcgtggactacgccgtacccggtccctccgtagtacttcgtctcgtcgggtcctacgaagtacgtaggacggacggacggcttagtaagtttatttacgttcgactaggtactacgtaactaacgtaaccgaaagggtaacctaaacgttacgttacgttaccggttcgttaaccgggtaaacgttaaccggggtaaaccttaacggttacccgtaacccggttaccggttaaccgggtacccgaacccggaaccccggaaaccgtaacccccgtaaacccgttaccccgg

SEQ ID NO: 483 - DNA, 647 bp, Homo sapiens
  misc_feature: GYAE6OF01ET8WJ.29.36.D03.1.454.CMB.1.raw
  modified_base (185)..(185): a, c, t, g, unknown or other
  misc_feature (185)..(185): n is a, c, g, or t
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagccctccctccgtgtccggtctcctggacagtcagtcaccgtntcctgcagtcggaaccagcagtgacgttgtgcttaactaccgtgtctccgtggtaccagccacgccccaggcaccgacgacccccaaactcattagttattttcgacgttacgtaagttaacgttcggcccgtcgtacggggtccctagtactcgtcttctcgtacggtacctaagttcgtggacacgccgaccgtcctcccgtagtacttactcgtcggtcggtcctacgtacgtacgtaggacggtacgacgtacgtagtaacttagttactagactacgtctagtaataagtacgaacggaactaacgtatttacgtacgttacgtacggtaacgtacggaaaccgttaacgtaccgaaccgttcgtaacgtaccaccggacccgaacgtaccctaaccctagtccgtacctaccgtccgtacccgtttacccccaccgtttacctacgtaccgttacc

SEQ ID NO: 484 - DNA, 881 bp, Homo sapiens
  misc_feature: GYAE6OF01B2XFA.29.36.D03.1.454.CMB.1.raw
  modified_base (177)..(177): a, c, t, g, unknown or other
  misc_feature (177)..(177): n is a, c, g, or t
tcagatagagtactcacgaccggtgctcgatttagctgcgtcacgatctctctcggaatatctccaccatggcctgggctctgctcctcctcaccctcctcactcagggcacaggactcctgggctcagtctgccctgactcacgtccctccctcggtcgtccggtctccgtggacngtcacgtcacctctctgcagtacgaaccagcagtcgtagttggtctacttaactaccgtgtccttcgtacgtaccgacgcacccgccccgaggccaaccgtacccgaccccctaaactcgtagttacgttacgttttacggacgtacgtaacgttacgtcccggtcccgtacggtaccgggtacctgtactccgttacctttcgtaccggttaccggtacctacggttcgtacggacgacgacccggtacccggtcccttaccgttagtactttacgtccgttcgggtacgtcccgtaacctaacggtaccggtacggggaaacggtaccgggttaacggtccgttaaagttaacggttttacttaacggttaccgacggtttacgtacccttaaacgttaacggtaaaacgtaaaccggggaaacggttaaaccctaaaccgttttacggtttaacggtaccggtttaaccgggttaaaccggtaaacccggggtttacggaaaaccccgttaaaccgggttaccccgttaccgggtttaaaccggtacgggtaaacccccggaccggttaaaacccccggaaaccgggttaaccccccctaaacccggttacggtttacacccccgtttaacccgttacccgttttcccccgtaaaccccccttaaccccgtttcgttaaccgggttaaacccttaacccgg

SEQ ID NO: 485 - DNA, 674 bp, Homo sapiens
  misc_feature: GYAE6OF01B6LHW.29.36.D03.1.454.CMB.1.raw
  modified_base (226)..(226): a, c, t, g, unknown or other
  misc_feature (226)..(226): n is a, c, g, or t
  modified_base (274)..(274): a, c, t, g, unknown or other
  misc_feature (274)..(274): n is a, c, g, or t
  modified_base (423)..(423): a, c, t, g, unknown or other
  misc_feature (423)..(423): n is a, c, g, or t
tcagatagagtactcacgaccggtgctcgatttagctgcgtcacgatctctcttggggatctcaggaggcagctctctcggaatatctccaccatggcctgggctctgctcctcctcacctcctcactcaggcacaggatccgtggctcagtctcgcctgactcacgcctccctcgtcgtccggtctcgtggactagtcacgtcaccgtctctgacagtacgaacngcgtagtgtacgttggtgtacttacgtacgtgtctccgtacggtaccncgcaccgcccgagaccacgaccgaccccaactcactgttactttacgacgtagtagtaccgtccggcctacggtacggtcctgacttcgtctcgtcgtacggtaccgtagtcgcgtacacgccgaccgtccctaccgttgtactttacncgtacgtcgggtaccctacgacggtaccgagggaacggacgtcggtaccgtaagtatttacgttacttcgaactccgttaacgtacctaaacgttaacgtaaaccggaacggttaaacctaaccgttaacgtttaggttaccggtttaaccgtaacggtaaccggtaaccggtaaacccaacggttccccgtaaccggtaccgttacgtaccgaacccgaacccgtaacccggaacccctacccgttaccg

SEQ ID NO: 486 - DNA, 529 bp, Homo sapiens
  misc_feature: GYAE6OF01CJDCR.29.36.D03.1.454.CMB.1.raw
  modified_base (308)..(308): a, c, t, g, unknown or other
  misc_feature (308)..(308): n is a, c, g, or t
  modified_base (498)..(498): a, c, t, g, unknown or other
  misc_feature (498)..(498): n is a, c, g, or t
  modified_base (501)..(501): a, c, t, g, unknown or other
  misc_feature (501)..(501): n is a, c, g, or t
  modified_base (504)..(529): a, c, t, g, unknown or other
  misc_feature (504)..(529): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcacgcccccaggcacacgacccccaaactcatgtatttttgacgtcagtaatcggccctcgacggggtccctgactcgctttctcgtgggtccaagtctggcagccacggcctccctagtattactcgtcgtcgggccttccagacctggaggacgaggctgaattattattgcagctnaatataacgaaggacaactacttatgtaccgttacggaacgtagggaacctaacgtaccaccgtctaacggtccacgacccaacggacccaaccctacgtacgtccaacttccgttccgtcccgtacccttcctacgtactaccgtactacgtctcggcgcgggtctcggacgacggtcacgtatacgancgntcnnnnnnnnnnnnnnnnnnnnnnnnnn

SEQ ID NO: 487 - DNA, 690 bp, Homo sapiens
  misc_feature: GYAE6OF01BDP6U.29.36.D03.1.454.CMB.1.raw
  modified_base (627)..(627): a, c, t, g, unknown or other
  misc_feature (627)..(627): n is a, c, g, or t
  modified_base (650)..(650): a, c, t, g, unknown or other
  misc_feature (650)..(650): n is a, c, g, or t
  modified_base (653)..(653): a, c, t, g, unknown or other
  misc_feature (653)..(653): n is a, c, g, or t
  modified_base (661)..(661): a, c, t, g, unknown or other
  misc_feature (661)..(661): n is a, c, g, or t
  modified_base (663)..(663): a, c, t, g, unknown or other
  misc_feature (663)..(663): n is a, c, g, or t
  modified_base (665)..(665): a, c, t, g, unknown or other
  misc_feature (665)..(665): n is a, c, g, or t
  modified_base (667)..(667): a, c, t, g, unknown or other
  misc_feature (667)..(667): n is a, c, g, or t
  modified_base (671)..(671): a, c, t, g, unknown or other
  misc_feature (671)..(671): n is a, c, g, or t
  modified_base (675)..(675): a, c, t, g, unknown or other
  misc_feature (675)..(675): n is a, c, g, or t
  modified_base (677)..(678): a, c, t, g, unknown or other
  misc_feature (677)..(678): n is a, c, g, or t
  modified_base (684)..(686): a, c, t, g, unknown or other
  misc_feature (684)..(686): n is a, c, g, or t
  modified_base (690)..(690): a, c, t, g, unknown or other
  misc_feature (690)..(690): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcacgcccccaggccacacgaccccaaactcattgtattttgacgtcagtacgtccggccctcgacggggtccctgtactcgtccttcgtcgtcgggtacctaggtcctggactacgccgaccggtcccttcccgtagtactttcgtccgtcggtcggtcctccgagaccgtggacggacggagtacgtagaactttattagttgccagtcctacgtaattaacgtaacggaacggtaactaacgtacgtttacgtcggtttaccgttaacgggtaaccggtaaccggtaaaccgttaaaccgtaccgttaaccccggttacgttaaccggtacccgtaaccgaacccgtaaaaccggacccccctaaacccggtaccttaccgtaaccccgtacgtttccccgttcccggtacccccgttccccttaccgtaccgtaccgttacctacgttccgtcgtaccgacggggtcccgtagtcgggtacgtaccgacgtacgngtaacgcagcgtgccagtcgacncgncgtgactncncncngcgnctcncnnctctcnnngtgn

SEQ ID NO: 488 - DNA, 585 bp, Homo sapiens
  misc_feature: GYAE6OF01ETAC0.29.36.D03.1.454.CMB.1.raw
  modified_base (265)..(265): a, c, t, g, unknown or other
  misc_feature (265)..(265): n is a, c, g, or t
  modified_base (521)..(521): a, c, t, g, unknown or other
  misc_feature (521)..(521): n is a, c, g, or t
  modified_base (526)..(526): a, c, t, g, unknown or other
  misc_feature (526)..(526): n is a, c, g, or t
  modified_base (529)..(530): a, c, t, g, unknown or other
  misc_feature (529)..(530): n is a, c, g, or t
  modified_base (532)..(532): a, c, t, g, unknown or other
  misc_feature (532)..(532): n is a, c, g, or t
  modified_base (535)..(536): a, c, t, g, unknown or other
  misc_feature (535)..(536): n is a, c, g, or t
  modified_base (538)..(538): a, c, t, g, unknown or other
  misc_feature (538)..(538): n is a, c, g, or t
  modified_base (549)..(549): a, c, t, g, unknown or other
  misc_feature (549)..(549): n is a, c, g, or t
  modified_base (554)..(554): a, c, t, g, unknown or other
  misc_feature (554)..(554): n is a, c, g, or t
  modified_base (561)..(561): a, c, t, g, unknown or other
  misc_feature (561)..(561): n is a, c, g, or t
  modified_base (563)..(563): a, c, t, g, unknown or other
  misc_feature (563)..(563): n is a, c, g, or t
  modified_base (565)..(565): a, c, t, g, unknown or other
  misc_feature (565)..(565): n is a, c, g, or t
  modified_base (575)..(575): a, c, t, g, unknown or other
  misc_feature (575)..(575): n is a, c, g, or t
  modified_base (577)..(577): a, c, t, g, unknown or other
  misc_feature (577)..(577): n is a, c, g, or t
  modified_base (581)..(581): a, c, t, g, unknown or other
  misc_feature (581)..(581): n is a, c, g, or t
tcagatagagtactcacgaccggtgctcgattttagctgcgtcacgagtcgtctcctggacagtcagtcaccgtctcctgcagtggaaccagcagtgacgttggtcgcttaagtaaccgtgttctccgtggtaccagccgacgcccccaggcacacgtaccccaatcatgtattttgacgtcagtaatcggccctgagggtccctagagtcgcttcgcgtgggtaccaagtcgtggaccagcacggcccttcctgacttatctgnggcctcgacgactgtacggagagtcctagaattacttattgccagcctagaattacgtaacaaggggtaccaacgtgtttacgtgtccccttagggaacgtacgggaacaaaagtccgtaaccgtctaagggtctaacggccccaaagggtccccaacccgtacgtcgtaacctacttccttacgtccccgtaccctcctagtactacctacgttactctaggacggtcggcctagggctaaggccgacaatgacngtacnganntntgnngngtcagtgacgngacgngtacgancncncgcgtagacngnacgngccg

SEQ ID NO: 489 - DNA, 759 bp, Homo sapiens
  misc_feature: GYAE6OF01CXGCZ.29.36.D03.1.454.CMB.1.raw
  modified_base (250)..(250): a, c, t, g, unknown or other
  misc_feature (250)..(250): n is a, c, g, or t
  modified_base (541)..(541): a, c, t, g, unknown or other
  misc_feature (541)..(541): n is a, c, g, or t
tcagatagagtactcacgaccggtgctcgatttagctgcgtcacgagctctctcggaatatctccaccatggcctgggctctgctcctcctcaccctcctcactcgagggcacaggatccgtgggctcagtctcgccctgactcacgtccctcccgtcggtcgtccgggtctccgtggacagtcagtcaccgtctccgtgcgtagcggaaccagcgaagtgtacggttggtatacttaacgtaccggttntcctccgtacgggaccacggccaccggaccccgaggaccaccgaacccaaccctaactacgattagttactttcggaactacgaacggtttacgcccggtaccgtacggtaccggtcctggtactcggttacttccggtcggttacggaacgtaacggttcggtacggaccgaacgaccggttaacccggtaccccttcggtttaacgtaacttttaaccgtccgttccggggtttaccgggtaaccctacccgggaaacggtaacggttaaggggacggggttaaaccgnggttaacgttaaacgtaaatttagtttacgacggactaacgtactaactaagtaaaccaacggaaacgtactaactacttaggtctaacggttaccgaaacgtacggtaaacctacggtcccgtacgtacgtacgacgtaacccgaacccaacggacccctaactctaccggttaccaacgtttcccaccgttcccctaaaccggtcattaagtcccc

SEQ ID NO: 490 - DNA, 839 bp, Homo sapiens
  misc_feature: GYAE6OF01CNNDN.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcgagtctcgccctgactcacgcctcccgtcgtcgtccggtctcgtggacagtcacgtcaccgtctccgtgacgtaggtacggaaccagcgtagtacggtaccggttggtagtactttaagtaaccgtcgttacctccgttacggtaccacgccgaccgacccccgaggaccaacgtaacccgaaccccctaaaactcctaacgttagttaacgtttttacggaaccgttacgtaacggtaaccgttcccggtcccgtacgggtaccgggtccctaggtactccgtccgtttacgtcgtcggggtacctaaggtcgtcggccgacgtacccgtcccggtacccttaccgtgttaacgttaccttccggttcggttaccggtccgtaccggtaacggtacgtacggggaaccggaacgggtaacggtaccgttaaggtaaactttaagttaccggttacgacctacgtttacctaattaacgttaaaacgaccggttaaaacgggaacctaaacgtttaaccgtttaggttacgtttaccgggttaaacggaaccggttaacggaacccgttaaacgttccccgttaccgtaacgtaacggttacgaaccccgacccggtaaaccggaaccccctaaccgtaccgttacggacccttaccgtttacccgttaccccgttaccccttacccgtaaccgttccgttaaaccgttaccg

SEQ ID NO: 491 - DNA, 762 bp, Homo sapiens
  misc_feature: GYAE6OF01A2A53.29.36.D03.1.454.CMB.1.raw
  modified_base (192)..(192): a, c, t, g, unknown or other
  misc_feature (192)..(192): n is a, c, g, or t
  modified_base (198)..(198): a, c, t, g, unknown or other
  misc_feature (198)..(198): n is a, c, g, or t
  modified_base (204)..(204): a, c, t, g, unknown or other
  misc_feature (204)..(204): n is a, c, g, or t
  modified_base (542)..(542): a, c, t, g, unknown or other
  misc_feature (542)..(542): n is a, c, g, or t
tcagatagagtactcacgaccggtgctcgatttagctgcgtcacgatctctctcggaatatctccaccatggcctggctctgctcctcctcaccctcctcactcaggcacaggatcctgggctcacgtctgccctgactcacgtccctccctcggtcgtccggtctccgtggacagtcagtcaccgtctccngcgagngaaccngcagtgacgttgtctacttaactaccgtgtcctccgtcggaccagccaccgcccccaggaccaacacccgaccccctaaatacctagtacgttacgtttttcgaacgttactaaacgttaaccgtcccggtaccccgttcggtaacccggggttccctacgtacgttccgtccgtttcctaccggttcggtaacctacggttccggacggtacaccgcccgtaacccgggtccccttacccgtgttaactttccgttccgtacgggtccggtcctaccgacgtacggtaggaacggacggtaaggtacgtaagttaacgtttagttactcgggtaacncgttacctaactaagtaaaccgtaaacggtaaacggtactaaccttaacgtttaggtccgtaaccgttaacgggaaccgtaccggggtaaacctaaacggttccggtaaccgttaccgttaaccggtacccgaccgtaaccccggacgaccccctaacgtccgtaccgtaccctacgttcccgtacccgttaccccgtcctacccgtcctacgttacccg

SEQ ID NO: 492 - DNA, 756 bp, Homo sapiens
  misc_feature: GYAE6OF01CZSES.29.36.D03.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (580)..(580): a, c, t, g, unknown or other
  misc_feature (580)..(580): n is a, c, g, or t
tcagatagagtactcacgaccggtgctcgatttagctgcgtcacgagctctctcggaatatctccaccatggcctgggctctgctcctcctcaccctcctcactcgagggcacaggatccgtgggctcagtctcgccctgactcacgtccctccctccggtcggtccggtctccgtggacagtcagtctaccgtctcgtnacgaggtcgaaccngcagtcggtacgttggtacgtacttaacgtaaccgttgtccgttccgtacggtaaccacgaccgaccggcccccgaaggaccaaccgaacccgaaccccctaaaactctagttacgtttacgttttcgaccgttaacgtacggttaaccgtcccggtacccgttacggtaccggggttccctaggtacgtccgttcctttcgtccggtcggtaccgtacgtcgtcggcgtaccgccgtaccggtcctaccgtacgtacctacgtccgtcgggtcggtccctacggaggtccgtacggaacggtagtacggtacgtacttacgttacttcgtcgtacgtcgtctagttcgtacgacgaccggtaccnccgtacgttcgtacgtacggttaccgttaccgggtacggggtaccggaacggtaaccgtacggttaccgtacccgggtaccgttaccggtagtaccgacgtaccgtacggtcccggttacccgtccccgttacccgtcggttaccctaccgtttacccgtcccgtcccctaacccg

SEQ ID NO: 493 - DNA, 688 bp, Homo sapiens
  misc_feature: GYAE6OF01DU6UH.29.36.D03.1.454.CMB.1.raw
  modified_base (211)..(211): a, c, t, g, unknown or other
  misc_feature (211)..(211): n is a, c, g, or t
  modified_base (504)..(504): a, c, t, g, unknown or other
  misc_feature (504)..(504): n is a, c, g, or t
  modified_base (512)..(512): a, c, t, g, unknown or other
  misc_feature (512)..(512): n is a, c, g, or t
tcagatagagtactcacgaccggtgctcgatttagctgcgtcacgatctctctcggaatatctccaccatggcctgggctctgctcctcctcaccctcctcactcgagggcacaggatcctgggctcagtctcgcctgactcacgccctcccgtcgtcggtccggtctccgtgacagtcacgtccaccgtcctcctgacaggtacgaaccngctaggtgtacgttggtctacttaacgtaccgttgtcctcgtacggtaccacgcaccgaccccgaggccaaccgaaccaacccgtaaactctaacgttcgttacgtttacgacgtactaacggtaccgtccggtaccgtcggtaaccgggttccacgttcgtccgtctttaccgtggttaccggtaacgacgttcgtacggaccacgtaccctaccgggccttccgtagtaacttctcggtaccgtcgaccgttcgacgtacggtagacgggtacgtagtccgtaagtacttntagtcganacgttctaagtaactagaaaccgagtaactacgtaacttgaccgttacgtacgtaacgtaccgaacgttacgtacctaccgacggtaacgtccaaccgggtaccaaaccggtccctactacgtcctaacccgtcttaaccccggttcctacccctacgtaccctgtacccgttacc

SEQ ID NO: 494 - DNA, 784 bp, Homo sapiens
  misc_feature: GYAE6OF01A5ZGO.29.36.D03.1.454.CMB.1.raw
  modified_base (151)..(151): a, c, t, g, unknown or other
  misc_feature (151)..(151): n is a, c, g, or t
  modified_base (161)..(161): a, c, t, g, unknown or other
  misc_feature (161)..(161): n is a, c, g, or t
  modified_base (190)..(190): a, c, t, g, unknown or other
  misc_feature (190)..(190): n is a, c, g, or t
  modified_base (232)..(232): a, c, t, g, unknown or other
  misc_feature (232)..(232): n is a, c, g, or t
tcagatagagtactcacgaccggtgctcgatttagctgcgtcacgatctctcttgggatctcaggaggcagctctctcggaatatctccacatggcctggctctgctcctcctcacctcctcactcaggcacaggactcgtggctcagtcncgcctgactnacgccctcctcgtgtccggtcttacccgnggacctagtccgtaagttccaacccggtttctcccgtcgaanacggtaccggaaaccagtccgaggttcgccggtttggtcggtacctttacgtaaccgttcggttccttcggtcgttaaccgacgtccgacgcccccagggacccaccgaaccgaccccctaaacgtaccctagttacggttactttttacggacgttaacgtaagttaacgtcccggtaaccgtttcggaaccggggtttacccctaggtaaccgttccgtacgtttacctccggttacggtttacctaaaccggtttcacggggtaactccggtaaccgtcccggtaccccgttcccgttacgttaccgttaacttccgttcgtcggttacctcgtaacgtacgtgggtaaccggacggttacggtcctaacggtaactttaagttcgttacgtcgaaccgttctaacgtacttaaccgtaaggtaaacccggaataaccgttacgttaacgtacgtacgttaaccgttaaccggtacggtaaccctaacggttaccaccggtccttaaacggtccgaacccgtaccgaacccgtaacccaccgtaacccg

SEQ ID NO: 495 - DNA, 692 bp, Homo sapiens
  misc_feature: GYAE6OF01B80GN.29.36.D03.1.454.CMB.1.raw
  modified_base (450)..(450): a, c, t, g, unknown or other
  misc_feature (450)..(450): n is a, c, g, or t
tcagatagagtactcacgaccggtgctcgatttagctgcgtcacgagtcgtctcttggggatctcaggaggcacgctctctcggtaatatctccaccatggcctgggctctcgcgtcctcctcaccctcctcactcaggcacaggatccgtgggctcagtctgcccgtgactcgacgcctcctccgtgtccgggtctctggacacgtcagtctaccgtctacctgacaggtcgaaacctgacgagttggtaccgttggtacgtacgtttaacgtaaccggttacgtcgttacccgtacgggttaaccacgtaccaccggacccccaggcctaaccaccggaccccccaaacttcgattacggttactttttcgaccgtacgtaacgtaacgtccggtccgtacggtaccgggttacctgtaacgtcgtcttcgtactcgggtccaagtcncggacacgtccgtaccggtcctaccgtagtacttacgtccgtacgtcggcctacgacgtacgtaggacgaccggtagtacgtaagtaacgtttaattcgttagacacgtactactaacgtaacgtaacggaacgtaacactaacggttacgttcgtacgtaacggtaccggtacggaaacccgtaagttcccgaacgttccgaacggttacaccgtacccgaaccgacccgtaaccgtaccg

SEQ ID NO: 496 - DNA, 778 bp, Homo sapiens
  misc_feature: GYAE6OF01D1F4K.29.36.D03.1.454.CMB.1.raw
tcagatagagtactcacgaccggtgctcgatttagctgcgtcacgagctctctcggaatatctccaccatggcctgggctctgctcctcctcaccctcctcactcgaggcacaggatcctgggctcagtctcgccctgactcacgccctcccgtccgttcgtccggtcctcgtgacagtcacgtcaccgtctcctgcagtacggaaccagcagtcgtacgttggtcgtacttactaaccgtgtcctccgtcggtaccacgaccgaccgccccgacggaccaccgacccgaacccccctaaactactattacgttagtttttacggaccgttactaacggttaaccgtcccggtcccgtacgggtaccgggttccctacgtacgtccgttccttcgttccgtcggtacctacgtcgtacggcgacggccgtaccgtcccgttccgtagttacttacgtccgtcggtcggtaccgtaccgacgtacgtacgggacggtacggacggtacttaagttaatttaacgttacgtacgacgtacgtaccgttaataaacgtaacgtaaaccggaaggtaacccttaacttacgtttacgttcgggttaaccggttaacggtaaccgggttaccggtaaaccgttacggtacccgtaccgttacccggttagacccgaacccgtaacccgtaaccccggaaaccccctacccgtacgttccccgttaacgtccccttacccgttacccccttacccctacccttccttacgtacccgttaacccg

SEQ ID NO: 497 - DNA, 757 bp, Homo sapiens
  misc_feature: GYAE6OF01BV0F0.29.36.D03.1.454.CMB.1.raw
  modified_base (216)..(216): a, c, t, g, unknown or other
  misc_feature (216)..(216): n is a, c, g, or t
  modified_base (259)..(259): a, c, t, g, unknown or other
  misc_feature (259)..(259): n is a, c, g, or t
  modified_base (646)..(646): a, c, t, g, unknown or other
  misc_feature (646)..(646): n is a, c, g, or t
tcagatagagtactcacgaccggtgctcgatttagctgcgtcacgatctctcttggggatctcaggaggcagctctctcggaatatctccaccatcggcctgggctctgcctcctcctccaccctcctcacgtcgagggcacgaggtactccgtgggctcagtctcgccctgactcacgtccctcccgttcggtcgtccgggtcctccgtaggacncggtcacgtcctaccgtcctcgtgacgtacggtacggaaccgngcgtaacggttggtaccggttggtcgttactttaacgtaaccgttcgtccgtccgtaggtaccagccgaccgccccgaggcccaaccgacccgaacccctaatctagttgttacgttttacggacgtacgtaacgttaccggtcccggtaccgttacggtaccgggttcctcggtaacttccggttccttccgttcgggtaccggttacctaacggttcgtacggacgacggtacccaccggttccccttacgttagtaccgtttactccggttaccggtacggtccctaaacggtccggttacgtaccggtacgttaacggttcggttacggttattaaccgttttactacggtcgttacgtcttaacgttcgtacgttcgacccncgggtacccaccgtcgtacgtcgttacggtcgtccgggtaccgggacggtaaccgtcgtacggtcccgttaaccgtcccgtacggttaagcgtaaccggtcgtaacccggg

SEQ ID NO: 498 - DNA, 781 bp, Homo sapiens
  misc_feature: GYAE6OF01A1OVM.29.36.D03.1.454.CMB.1.raw
  modified_base (156)..(156): a, c, t, g, unknown or other
  misc_feature (156)..(156): n is a, c, g, or t
  modified_base (230)..(230): a, c, t, g, unknown or other
  misc_feature (230)..(230): n is a, c, g, or t
  modified_base (604)..(604): a, c, t, g, unknown or other
  misc_feature (604)..(604): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcgagggcacaggactccgtgggacctnacgtctcgccctgactcacgccctccctcgtcggtccggtctccgtggacacgtcacgtccaccgttctccgtnaccgaggtaccgaaccagcgaggttggtaccggttggtgtaccttaacgtaaccgttcgttaccgttccgtacggttaccgacgccgaaccgtcccccgaggaccctaaccgaaccccgtacccctaaactacccgtagttacgtttacgttttaaccggtacttaccgtaacggttaaccggcccgttaccggttaccggacccggggtttacccgtacgttacgttaccgtttccgttcccgttccgggtaaccggttaccgtaacggttcgttaacggccgtacgaccgtcccgtcccgtactagttacttctacgtccggcgttaccactacggacacggacgggacgaccgtagtattacgttaacttntaccggactcgtaccggtactaacgttaaccgaaacgtaacggaacctttaacgtaacttccggttattaccgggtaacggttaacggtaaacccgtaaccgtaaaccgtaccggtacccggtacgttaccgacgttaaaccccgaccggtaaacccgacccttaccggtaaacccg

SEQ ID NO: 499 - DNA, 761 bp, Homo sapiens
  misc_feature: GYAE6OF01DKUHF.29.36.D03.1.454.CMB.1.raw
  modified_base (268)..(268): a, c, t, g, unknown or other
  misc_feature (268)..(268): n is a, c, g, or t
tcagatagagtactcacgaccggtgctcgatttagctgcgtcacgatctctctcggaatatctccaccatggcctgggctctgctcctcctcaccctcctcactcagggcacaggatcctgggctcagtctgccctgactcacgccctcctccgtgtccgggtctccgtggacagtcagtccacgtctcctagcacgtaggaaccctagcgtaggtacgtacgttgggtactacgttaataccggttggtcctaccgtacggtaccgngacgaccgaccccgaggccaaccgtaaccggacccccctaaagttaccgaatttacggttaatttttaccggaaccgttacgtaaacggttaaccggtttccggtaccccggttacgggtaaccgggttcccgtaacggtaacgtttccggttccgttttaaccgtcggtttacggaaccgtagtccgttcgggactacggtaccgtaccgggtacctccgtagtaccttacgtctcgggtccgtcgtaccggagttaacgtacggtaggtacggagtacgtagtaaattacgttaggtactacgtacgtactaccgaagttacgtaacgaagggttaacacggttaacttcgtaccgttaacgtacggtacggtaacggaacctaagttaccgaccgttaccggtctaacccggtggacccaaccggtcccaacccttaacgcgttaacccgcttaccggtaccttccccaacttcccgtaagtcgtaaccc

SEQ ID NO: 500 - DNA, 768 bp, Homo sapiens
  misc_feature: GYAE6OF01DR5ZH.29.36.D03.1.454.CMB.1.raw
  modified_base (319)..(319): a, c, t, g, unknown or other
  misc_feature (319)..(319): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcgaggcacgaggactccgtgggctcagttctcgaccctgacctcgaccgtcccttcccgttccggtcggttcccgggttctaccgtcggactacgtcacgtccaccgttcctcctagctaggtaccggaaccagcaaggttgtacggttggtactacttaacgtaccgttcgtcctccgttacggtaccncggaccaccggacccccgacggaccaaccgaaccccgaacccctaaacttctaaggtttacgttacgtttttacggaccgttacgtaacggttaaccgtcccggtacccgtacgggtaccgggtacctcggtcttaccgtcgttcgtaccggttcggtacctaacgtcgcggacacggtccgaccgttcccgtcgtagttacttaccgttccgtcgtacgggtacctccggtacgtacgtcgggaacggacggtacgttacgtagttaagtttacgttacgtgaacgtactaccggtaattacgtaaagtaaccgtaacggtaactaccgtttaattaccgttaggttccgtaaaccgggtaccggtaacgggaaccttaaccggttccgacccgttacggtaaccggaccctaaccggaccccgaaacccgtccccgaacgttacccg

SEQ ID NO: 501 - DNA, 777 bp, Homo sapiens
  misc_feature: GYAE6OF01BZ72Q.29.36.D03.1.454.CMB.1.raw
  modified_base (569)..(569): a, c, t, g, unknown or other
  misc_feature (569)..(569): n is a, c, g, or t
tcagatagagtactcacgaccggtgctcgatttagctgcgtcacgatctctctcggaatatctccaccatggcctggctctgctcctcctcaccctcctcactcgagggcacgaggactccgtgggctcagtctcgccctgactcacgccctcccgtccgtcggtccggtcctccgtgacacgtcagtcctacccgtctccgtgcgaacgtacggaaccagacaggtcggtacggttggtacgtacgttaacgtaaccgttcgtccttccgttacggtaaccgacgaccgacccgaccccgacggtaccaaccgaacccgtaaacccccaaactcgtattaggttagttttacgacggtactaacggtaacgtcccggtcccgtacggtaccgggtccctggtactccgtctttccgtacggtccggtaccgtagtacgtcggaccgacgcccgtaccgtccttccgtagttactttacgtccgttaccggtcggtaccgtaccacgtacggacgggacggacggtacgtacgtaagtaaacttagttaacgtcaaccgtacgactaanaaccgttaaagtaaccgaacggtaaaccttaacgttaacgtttacgtcggttaccgtaacggaaccgttaacgggaaaccttacgtacccgtaccgttaccggtaacgtacccgaaccgtaaacccgacccggtaacccctaccctaactccgttaacctccctacgttacccgttaacccctccgtttaacccacgtttaaaccgtc

SEQ ID NO: 502 - DNA, 708 bp, Homo sapiens
  misc_feature: GYAE6OF01EFQYE.29.36.D03.1.454.CMB.1.raw
  modified_base (227)..(227): a, c, t, g, unknown or other
  misc_feature (227)..(227): n is a, c, g, or t
tcagatagagtactcacgaccggtgctcgatttagctgcgtcacgagctctctcggaatatctccaccatggcctgggctctgctcctcctcaccctcctcactcagggcacaggactcctgggctcagtctgccctgactcagcctccctcgtgtccgggtctcctggacagtcagtcaccgtctcctgcagtggaaccagcaatgacgttggtgcttataccgtntcgtcctggtaccagccacgcccccaggcacacgacccccaaatcattgtatttttgaccgtacagtaacgtccggccctcgacggggtccctgactccgcttctcgtcggtccagtctcggcagccgaccggcctcctagtacttagtcctcgtgggtcctaccgagtacgtggaggaccggaggaccttaggaaactttagttaagtttcgacgtaacggtccttacctagttaaacgtaaccggaacggggtaacctaaacccgttccgtttaacgttcggttacctttaccgggaaaccgttccgggtaaaccaacgttacccggtaacccgttaccgtaacccggggttaccaaccgggtacccccgtaaaccgggtaccccctaaaaccccccgtacggttacccgtaccccgtaaccttacccgttcccggtttccccccgacccctttaccgttacccgtacggtttaacccc

SEQ ID NO: 503 - DNA, 820 bp, Homo sapiens
  misc_feature: GYAE6OF01BYEO9.29.36.D03.1.454.CMB.1.raw
  modified_base (170)..(170): a, c, t, g, unknown or other
  misc_feature (170)..(170): n is a, c, g, or t
  modified_base (199)..(199): a, c, t, g, unknown or other
  misc_feature (199)..(199): n is a, c, g, or t
  modified_base (229)..(229): a, c, t, g, unknown or other
  misc_feature (229)..(229): n is a, c, g, or t
  modified_base (263)..(263): a, c, t, g, unknown or other
  misc_feature (263)..(263): n is a, c, g, or t
  modified_base (269)..(269): a, c, t, g, unknown or other
  misc_feature (269)..(269): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcgaggcacaggactccgtgggcctcagtctgccctgactcncgccctcctcgtcgtccggtctcgtgacngtcagtccaccgtctcctgcaggtcgaccngcagtgacgttggtgcttagtaccgtctctccgngtaccngccaccgccccgagccacgaccgacccctaaactctagttgttacgtttttcggaccgttacgtaacgttaaaccgtccgtaccccgtacggtaccgggggttcccctaggttaaccgttcccggttcctttaccgttaccgtccggtacccttaccctaaacgggttccgttaccgggaacctaaacccgtaccttcccggtacccccgttccctacccggaaccctttacttccccggtaccgggttacccgggtacccgtaccggttaccgggaccgtacgggttaaccggttacggttacgggttaacccggttcgttttaaacggttttaccttaccggtttacggtccgtttaaccgttacccggtttaccttagggttttacccgcccggtaaccggtaccccgttaaccccggcgtttacccggtttcgaaccgggtttccgtcccggggttacccggggacccgggtaaggtaacccccggtaagtccccggttacccggtaaacccggttcgggtttaaaccgccgttaacggtaccccgg

SEQ ID NO: 504 - DNA, 890 bp, Homo sapiens
  misc_feature: GYAE6OF01E27TM.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctccaccctcctcacctcacgggcacaggactcctgggctcagtctcgccctgactcagcctccctccgtgtccgggtcctcctggaccagtcagtccaccgttcctcctagctacggtacggaacctacgacgtaggtacggttacggtttgggtacgtaccgtttaacgtaacccggttgttccccgttaccggttacggtaaccacggtacccgacccgaccccccgaggaccgaacctacccggtaaccccccaaacttccagtttacggtttacgttttttaccggaccggttacgttaaaccggtaccggtaccccggtaccccgtaccgggttaacccgggggttccttacggtaccgtttccgtacccgttttcccgtacgggtttaccgggtacccttaacgggtcgttaccgggactaacggccgtaacccggtccccttaccgttagtactttccgtcctcgggttcgtacccttaccgacgttcgaacggtacggaaccggtacggtacgtaacgtaatttaacgtttacgttcggaacccgttagtaccgttaacgtacgtaaacgttaaaccggaaaaccgggttaacctaacccggtttactttaacggttcgtttaaacccggtacccgggttaaaaccggtaccggtaaaccgtaaacccggtttcccgttaacccggttaaacccggtttaaccggacccggttaaacccgggaaacccccgttaacccggaaaccccccctaaaccgtttaccccgg

SEQ ID NO: 505 - DNA, 502 bp, Homo sapiens
  misc_feature: GYAE6OF02GPJBE.29.36.D03.1.454.CMB.1.raw
  modified_base (226)..(226): a, c, t, g, unknown or other
  misc_feature (226)..(226): n is a, c, g, or t
  modified_base (419)..(419): a, c, t, g, unknown or other
  misc_feature (419)..(419): n is a, c, g, or t
  modified_base (441)..(441): a, c, t, g, unknown or other
  misc_feature (441)..(441): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccngcagtgacgttggtgcttataaccgtgtctcctggtaccagcagcccccaggcacacgcccccaaactcatgattttgacgtcagtaatcggccctcagggtccctgatcgcttctctggtccaagtctggcagcacggctccctgattatctctgggctcagctgagacgaggctagaatatattgcagctnatatacaagggacaacacttangttcttacggactgggaaccaagtcaccgtctacggtcacgaccaacggacccaccctacg

SEQ ID NO: 506 - DNA, 657 bp, Homo sapiens
  misc_feature: GYAE6OF02IH5F5.29.36.D03.1.454.CMB.1.raw
  modified_base (213)..(213): a, c, t, g, unknown or other
  misc_feature (213)..(213): n is a, c, g, or t
  modified_base (303)..(303): a, c, t, g, unknown or other
  misc_feature (303)..(303): n is a, c, g, or t
tcagatagagtactcacgaccggtgctcgatttagctgcgtcacgatctctctcggaatatctccaccatggcctgggctctgctcctcctcaccctcctcactcaggcacaggatcctgggctcagtctgccctgactcagcctccctccgtgtccgggtctcctggacagtcagtcaccgtctcctgcagtggaaccagcagtgacgttgngcttataaccgtgtctcctggtaccagcagcccccaggccaacacgacccccaaactccatgtatttttgacgtcagtaatcggaccctnagggtccctgactcgcttctctgggtcaagtctggcagcacggcctccctgattactctcgtgggccttccgagtactggacggtacgaaggctaggaaattattagttgcctaagctacaattacgtaacgtaaagggaacaaaccgtaaccttttatacggttactttacccgggaaaactttcggggaaaccctaaaaagggttccctaaaccggtacccgttaaggggtacccaacggtaccccgaaccgggtaacccccaaaccccccgtacgttacgttaccccgaacgtttcccgttacccgggtttcccccgaccccctttacccgttaccgtaacgtttaacccg

SEQ ID NO: 507 - DNA, 512 bp, Homo sapiens
  misc_feature: GYAE6OF02GYKCZ.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcaggggtccctgatcgcttctctgggtccaagtctggcagcacggcctcctgattatctctgggctccagactgaggactaggctgaatattattgcagctcatatacaagggacaacacttatgtcttcggaactgggaccaaagtcaccgtcctagtcacgcccaaggcccaaccccactcgtcactctcgttccccgccctcctccagtacc

SEQ ID NO: 508 - DNA, 529 bp, Homo sapiens
  misc_feature: GYAE6OF02IWBEB.29.36.D03.1.454.CMB.1.raw
  modified_base (514)..(514): a, c, t, g, unknown or other
  misc_feature (514)..(514): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgccccaggcacacgcccccaaaactcatgatttttgacgtcagtaatcggccctcgacggggtccctgatcgcttctcgtgggtccaagtctggcagcacggcctccctgatttatctcgtgggctccgagactgaggacgaggctagaattattattgcagctacatatacgaaggacaacacttatgtacttacggaactggaacctaagtcaaccgtctagtcacgacccgaaggcccaacccatcgtaccacttctcgttccccnccctcctcagttacc

SEQ ID NO: 509 - DNA, 510 bp, Homo sapiens
  misc_feature: GYAE6OF02HJ4N3.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactcatgattttgacgtcagtaatcggccctcaggggtccctgatcgcttctctgggtccaagtctggcagcacggcctccctgattatctctgggctccagactgaggacgaggctgaatattattgcagctcatatacaagggacaacacttatgtcttcggaactcggacaaagtcaccgtcctaggtcacgcccaaggcccaacccactcgtccactctcgtccccacctcctctagtacc

SEQ ID NO: 510 - DNA, 527 bp, Homo sapiens
  misc_feature: GYAE6OF02J03TV.29.36.D03.1.454.CMB.1.raw
  modified_base (362)..(362): a, c, t, g, unknown or other
  misc_feature (362)..(362): n is a, c, g, or t
tcagatagagtactcacgaccggtgctcgatttagctgcgtcacgatctctcttggggatctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagcgatgtcggtggttatactttgtctcctggtaccaacaacacccaggccgacggcccccgactcataatttatgatgtcattaagcggcctcgacgggtccctgactcgcttctctgctcagtctggcaacnctgcctcctgaccatctctcgggcctccgaggctgacgatcggacggtgattatactgcttgctctatttcgcgtacggtccacccgtcacgttcgtcgtacttcgttccggggacggtaacgggaaccacggtccgtacggaccccggttaccgtacgggtccg

SEQ ID NO: 511 - DNA, 527 bp, Homo sapiens
  misc_feature: GYAE6OF02I486T.29.36.D03.1.454.CMB.1.raw
  modified_base (469)..(469): a, c, t, g, unknown or other
  misc_feature (469)..(469): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagccccaggcacagcccccaaactcatgatttttgacgtcagtaatcggccctcgagggtccctgatcgtttctctggctccaagtctggcaatgcggcctccatgaccatctctggactccaggctgaggacgaggctgattattagtgctgctcatatataagcagtgtactacgtttaaggggtgttcgggcggagggaccaagcgtagaccgtcgtgggtcncggacccaagggcctcgcccccgtcggtccaccttcctccgttaccccacccttcccg

SEQ ID NO: 512 - DNA, 434 bp, Homo sapiens
  misc_feature: GYAE6OF02F1MSZ.29.36.D03.1.454.CMB.1.raw
  modified_base (424)..(434): a, c, t, g, unknown or other
  misc_feature (424)..(434): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcaggggtccctgatcgcttctctgggtccaagtctggcagcacggcctccctgattatctctgggctccagactgaggacgaggctgaatattattgcagctcatatacaagggacaacacttatgtcttcggaactgggaccaaagtcaccgtctagtcagcccaaggccaacccactgtcactctcgttcccgccctcctcagtactctatctgacgcgggctggcaaggcgcatagnnnnnnnnnnn

SEQ ID NO: 513 - DNA, 503 bp, Homo sapiens
  misc_feature: GYAE6OF02JCCTL.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctcctccgtgtccggtctcctggacagtcagtcaccgtctcctgcagtggaaccagcagtgacgttggtgcttataaccgtgtctcctggtaccagcagcccccaggcacacgccccaaactcatgattttgacgtcagtaatccggccctcgagggtccctgatcgcttctctggtccaagtctgcagcacggcctcctgacttatctctgggctccgagctgaggacgaggctgaatattatgcagctacatatacaagggacaacgtatatgtcttacggaactgggaaccaagtcacgtctacggtacacgcccaacggcccaccctacg

SEQ ID NO: 514 - DNA, 508 bp, Homo sapiens
  misc_feature: GYAE6OF02GD0UJ.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctcgctcagtgtccgggtctcctggacagtcagtcaccatctcctgcactggaaccagcagcgatgtcggtggttataactttgtctcctggtaccaacaacacccaggcgacggccccccgatcataatttatgatgtcattaagcggccctcgagggtccctgatcgcttctctggctcaagtctggcaacactcgcctccctgacccatcctctcgggcctccgaggctgacgatgacgtgattattactgctgctctatttgctagccacccgcactgtgacttcgttcgggcggaacgggaccaaggccgtacggacccgttccgtaggtaccg

SEQ ID NO: 515 - DNA, 547 bp, Homo sapiens
  misc_feature: GYAE6OF02I2ZIW.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctcagtctgccctgactcagcctcctccgtgtccgggtctcctggacagtcagtcaccgtctcctgcagtggaaccagcagtgacgttggtgcttataaccgtgtctcctggtaccagcagcccccaggcacacgcccccaaactcatgattttgacgtcagtaatcggccctcgacggggtccctgactcgcttctcgtggtccagtctggcaacactcgcctcctgaccatctcgtcggctccgaggctgacgagtagacggtgtattagttactgactgcttcgtatttcgctacggccacccggcactgtcgtacttccggtttcgggaccgggacgggtaacccgaacgtccgttacggacccggttccgtacgggttcgacgtcgtaaccgg

SEQ ID NO: 516 - DNA, 535 bp, Homo sapiens
  misc_feature: GYAE6OF02IZMZD.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagccccaggcacacgcccccaaactcatgatttttgacgtcagtaatcggccctcgacggggtccctgatcgcttctctggtccaagtctggcagcacggcctccctgattatctctcgggctccagactggacggacgaggctagaattattattgcagctcatatacgaaggacaacacttatgtacttacggaacgtacgggaacaagtcaccgtacgtagtcacgcccaacggcccaaccccactcgtaccactccttcgttacccctaccctcctacctacgttacc

SEQ ID NO: 517 - DNA, 430 bp, Homo sapiens
  misc_feature: GYAE6OF02ILXN6.29.36.D03.1.454.CMB.1.raw
  modified_base (423)..(430): a, c, t, g, unknown or other
  misc_feature (423)..(430): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcaggggtccctgatcgcttctctgggtccaagtctggcagcacggcctccctgattatctctgggctccagactgaggacgaggctgaatattattgcagctcatatacaagggacaacacttatgtcttcggaactgggaccaaagtcacgtcctaggtcagcccaaggccaaacccactgtcactctcgttcccaccctcctcagtactctatctgagcggctggcaagcgcatagnnnnnnnn

SEQ ID NO: 518 - DNA, 624 bp, Homo sapiens
  misc_feature: GYAE6OF02JWAC9.29.36.D03.1.454.CMB.1.raw
  modified_base (243)..(243): a, c, t, g, unknown or other
  misc_feature (243)..(243): n is a, c, g, or t
tcagatagagtactcacgaccggtgctcgatttagctgcgtcacgatcgtctcttggggatctcaggaggcagctctctcggaatatctccaccatcggcctggctctgctcctcctcacctcctcgactcgacgggcacaggatcctgggctcagtctcgccctgactcagccctcctcgtgtccggtctcctggactagtcagtcaccgtctcctgcagtggaacctgcagtgacgttggncttactaccgtgtacctcctaggtaccagccacgccccaggacaacgacgaccccaaactcgaagtcgtactttgactcagtactccgcctcgacgggtcctgactcgtcttctcgtcggtccaagtcgtcgcacgcgtacggcccttcccgtagtacttactccgtacggtcgggcctaccgagtacgtggtaacgggacgtacggtacgtacggaattacttagttgacgtagtactaccgtaagtactaacggaacgggactaaacgtacttacgtacggttaccttacggtaaccgttcgggaaacctaacggtacccgtaccggttccgtaaccggttacgaccggttacccgaaccggtccccaaccccgtaccg

SEQ ID NO: 519 - DNA, 518 bp, Homo sapiens
  misc_feature: GYAE6OF02GVN32.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcacggggtccctgatcgcttctctgggtccaagtctggcagcacggcctccctgattatctctgggctccagactggaggacgaggctagaattattattgcagctcatatacgaagggacaactacttatgtacttacggactgggaccaagtcaccgtctagtcacgcccaaggcccaacccactcgtacactctcgttccccgccctcctccagtacc

SEQ ID NO: 520 - DNA, 554 bp, Homo sapiens
  misc_feature: GYAE6OF02GPWH4.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctcgtgtccgggtctcctggacagtcagtcaccgtctcctgcagtggaaccagcagtgacgttggtgcttataaccgtgtctcctggtaccagcacgcccccaggccacacgcccccaaactcatgatttttgacgtcagtaatccggccctcgacgggtccctgactcgtcttctctggtccaagtctggcagcacggccctcctgattactctcgtcgggcctccgagactggaggacggaggctagaattattattgcagctctatatacgaagggacaactacttagtcgttacgttacggtaacgtacgggaacctaaacggtcctaacccgtaccgttacggtccgacgacccgaacgaccccaacccgtacccg

SEQ ID NO: 521 - DNA, 545 bp, Homo sapiens
  misc_feature: GYAE6OF02GOXC6.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgcccccaggcacacgcccccaaactcatgtatttttgacgtcagtaatccggccctcgacggggtccctgactcgcttctctgggtccaagtctggcagcacggcctccctgacttatctcgtcgggcctccgagactggacggacgaggctagtaattattattgcagctcaatataacgaagggacaacacttatcgttcttacggaacgtcggaaccaagtccaccgtctagtcacgacccaacggcccaacccactcgtaccactccgttcgttccccgccctcctccagttaccc

SEQ ID NO: 522 - DNA, 546 bp, Homo sapiens
  misc_feature: GYAE6OF02G32RH.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctcgtgtccggtctcctggacagtcagtcaccgtctcctgcagtggaaccagcagtgacgttggtgcttataaccgtgtctcctggtaccagcacgcccccaggcacacgcccccaaactcatgatttttgacgtcagtaatcggccctcgacggggtccctgactcgcttctcgtggtccaagtctggcagcgaccggccctccctgtacttatctcgtgggctccagactggaggacgaggctagaattattatgcagctcatataacgaaggaacaactacttatacgtcgttacggtaacgtcgggaacctaagtaccgtacccgttaccgtacggtacgaccgacccgaacggaccccaaccctaccg

SEQ ID NO: 523 - DNA, 616 bp, Homo sapiens
  misc_feature: GYAE6OF02G3YYM.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgccccaggcacacgcccccaaactcatgtatttttgacgtcagtaactcggccctcgaggggtccctgactcgcttctctgggtccaagtctggcagcacggcctcctgacttactctcgtgggcctccgagacgtggacggacggaggctagtaaattagtttagttcgactagtctactaataagtaacgaaagggactaaactaccttattacggttaccgtttacgggaaacgtacgggtaaccctaaaggtcctaacccggttacgtaacgggtcaccggacccgtaaacggcccctaaaccccacgttcgtaccctaccgttccgttaccgtttacccccacccttcccttaccgtacgttaccc

SEQ ID NO: 524 - DNA, 525 bp, Homo sapiens
  misc_feature: GYAE6OF02HC406.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagccccaggcacacgcccccaaactcatgatttttgacgtcagtaatcggccctcaggggtccctgactcgcttctctgggtccaagtctggcagcacggcctcctgattatctctgggctccagactggaggacgaggctgaattattattgcagctcatatacgaagggacaactacttatgttcttacggaactgggaaccaaagtccaccgtccgtagtcagacccaacggcccaacccactcgtcacttcctcgttcccgcccttcctctacgtacc

SEQ ID NO: 525 - DNA, 561 bp, Homo sapiens
  misc_feature: GYAE6OF02FXWF8.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgcccccaggcacagcccccaaactcatgtatttttgacgtcagtaatcggccctcgacggggtccctgactcgcttctcgtcgggtccaagtctggcagccacggcctccctgtattactctctgggcctccgagctggaggacgaggctagtaattattatgcagctactatataacgaagggaacaactacttatcgttacgttacggaacgtacggaacctaacgtaccaccggttacctaggtcacgacccgaacggacccaaccctactcgtacctacgttcctccgttccccaccctcctacctactacc

SEQ ID NO: 526 - DNA, 515 bp, Homo sapiens
  misc_feature: GYAE6OF02G8WIN.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactccatgatttttgacgtcagtaatcggccctcgagggtccctgatcgcttctctggtccaagtctgcagcacggcctcctgacttatctcgtgggcttccagactgaggacgaggctagaatattatgcagctcatatacgaagggacaacattatgtcttacggacgtcgggaaccaagtccaccgtactacggtcacgcccgaacggcccaaccccgtacg

SEQ ID NO: 527 - DNA, 573 bp, Homo sapiens
  misc_feature: GYAE6OF02F1MJT.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacacgccccaaactcatgattttgacgtcagtaactcggccctcgacgggtccctgtactcgcttctctgggtccaagtctgcagcacggcctcctgtattactcgtcgtcggtctccgagtactggagacggaggctagaacgttattagttgacagtctacattaatacgaaggaactaaacgtacttaagtcgttacgttacggaacgttacgggaacctaaaggtccgtaacccggttaccgtacggtaccgtaaccggaccccgaaacggtaccccgaaccccgtaccg

SEQ ID NO: 528 - DNA, 851 bp, Homo sapiens
  misc_feature: GYAE6OF02H6CGK.29.36.D03.1.454.CMB.1.raw
tcagatagagtactcacgaccggtgctcgatttagctgcgtcacgatctcgtcctggacagtcagtcaccgtctcctgcagtggaccagcagtcgacgttggtgcttataaccgtgtctcctggtaccagcagcccctaggccacgagccccaaagttcaattggaactttttggaacgttcgagtaatcggacccttgacggggttccctagattccgtctttcgtcgtacgggttacccaaggtttcctagggtacctaacggtccgtaaccggggttccccttacccgttaggtaaccttttaacgttccggttaccgttcgggggtaccttaccccgtaaggtacccgttacggtaacgggtaccgtaacgggttaccgttaaccgggtaactttaaccgtttaacgtttcgggaaccttaacgggtccctttacgaacgttaacgtaaccgaacgggtactaacgttacttttaacggtcggttaaccgtccgggtaaactcggggtaaacctaaacggttcccgtacggtaccgttaacggtcgtaacggaccctaaacgggtccctaaaccccgtgtttaccgtaccgactttccggtaccttcccggtacctttacgcctaacgttaccgtactacggttacgtggtaccggtccggtacttacgggtaccgtaaacgggtcgtaccgtagttacgtacgacgttacgtcgtacgtccgttacgcgtcgtaacgtaccgtagtacccgtttagacccgttggaacctgttaacgtaaccgggttctaacgtacccggttagttaccggtaccttagttacccggtcgtaccgtaggttacccg

SEQ ID NO: 529 - DNA, 439 bp, Homo sapiens
  misc_feature: GYAE6OF02H3OT8.29.36.D03.1.454.CMB.1.raw
  modified_base (264)..(264): a, c, t, g, unknown or other
  misc_feature (264)..(264): n is a, c, g, or t
  modified_base (394)..(394): a, c, t, g, unknown or other
  misc_feature (394)..(394): n is a, c, g, or t
  modified_base (406)..(406): a, c, t, g, unknown or other
  misc_feature (406)..(406): n is a, c, g, or t
  modified_base (424)..(439): a, c, t, g, unknown or other
  misc_feature (424)..(439): n is a, c, g, or t
tcagatagagtactcacgaccggtgctcgatttagctgcgtcacgagtctctcctggacagtcgagtcaccgtctcctgcagtggaaccagcagtgacgttggtgcttataaccgtgtctcctggtaccagcagcccccaggcacagcccccaaactcatgatttttgacgtcagtaatcggccctcagggtccctgatcgcttctctgggtccaagtctggcagcacggcctccctgattatctctgggctccaggctgacgntgacggtgattattactgctgctcatttgcaggcacccgcactgtgatcttcggcggaggaccaagctgaccgtctaggtcagctcaagctcgcccctggcactctcgtcccgccctcctcacgtctctntctgacgcggcnggcaaggcgacatagcgnnnnnnnnnnnnnnnn

SEQ ID NO: 530 - DNA, 517 bp, Homo sapiens
  misc_feature: GYAE6OF02HB16I.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagccccaggcacagcccccaaactcatcgatttttgacgtcagtaatcggcctcaggggtccctgactcgcttctctgggtccaagtctggcagcacggcctcctgtacttatctctgggctccagactgaggacgaggctgaatattatgcagctcatatacaaggacaactacttatcgtacttcggaactcgggaaccaagtcaccgtctacgtcacgcccaaggcccaacccactcgtaccactcctcgttcccaccctcctacactacc

SEQ ID NO: 531 - DNA, 517 bp, Homo sapiens
  misc_feature: GYAE6OF02GESD8.29.36.D03.1.454.CMB.1.raw
  modified_base (504)..(504): a, c, t, g, unknown or other
  misc_feature (504)..(504): n is a, c, g, or t
  modified_base (513)..(513): a, c, t, g, unknown or other
  misc_feature (513)..(513): n is a, c, g, or t
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcgagggtccctgatcgcttctctgggtccaagtctggcagcacggcctccctgattatctcgtgggctccagactgaggacgaggctagaatattattgcagctcatatacaagggacaacgtacttagtgtcttacggaactagggaccaaagtcaccgtcctacgtcacgcccaacggccaacccactcgtcactctcgttcccnccctcctcntacc

SEQ ID NO: 532 - DNA, 635 bp, Homo sapiens
  misc_feature: GYAE6OF02F8LF7.29.36.D03.1.454.CMB.1.raw
  modified_base (273)..(273): a, c, t, g, unknown or other
  misc_feature (273)..(273): n is a, c, g, or t
tcagatagagtactcacgaccggtgctcgatttagctgcgtcacgagctctctcggaatatctccaccatggcctgggctctgctcctcctcaccctcctcactcaggcacaggatcctgggctcagtctgccctgactcagcctccctccgtgtccggtctcctggacagtcagtcaccgtctcctgcagtggaaccagcagtgacgttggtgcttataaccgtgtctcctggtaccagcacgcccccaggcacacgacccccaaatccatntattttgacgtcagtaatccggccctcgtacgggtccctgactcgtcttctcgtcggtcctaagtcgtggcagccaccggcctccctgtacttactctcgtcgggtcctcgtacgcgtgacggacgaggactagtaattagttatgcagtctactaatactaacgaagggtaaccaactaacttagtacgtacgttaccggaacgttacgggaacctaaacgtccgtacccgttaccgtacgttaccgacggtaccccgtaacggtaccccctaaaccccgtacgttaccggtaaccctacccgttacccgttaccgggttaccccccctacccgttcccttacccgtaccgtttaaccccg

SEQ ID NO: 533 - DNA, 585 bp, Homo sapiens
  misc_feature: GYAE6OF02HMGPV.29.36.D03.1.454.CMB.1.raw
  modified_base (227)..(227): a, c, t, g, unknown or other
  misc_feature (227)..(227): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctccgtgtccggtctcctggacagtcagtccaccgtctcctgcagtcggaaccngcagtgacgttggtgcttataacgtgtctctggtacagcacgccccaggcacacaccccaaactcatgtatttgactctagtactccggcctcgcggtcctgactcgtcttctcgtcggtactaagtcgtaggcacgtccgaccgtccctccgtagtactttatccgtcgtcggcctaccgagtacgtaggaggacggtacgtactaaggtaattaagttacgtcgacgtacgtaccttactaattaaacgtaacgaaacggaacctaaactacgttagtacgttaccgttaacggaacgtacggaacctaaagtcctaaccgtcgtacgacacgtaccgaacgtacccaaccctacg

SEQ ID NO: 534 - DNA, 651 bp, Homo sapiens
  misc_feature: GYAE6OF02GY2JJ.29.36.D03.1.454.CMB.1.raw
  modified_base (228)..(228): a, c, t, g, unknown or other
  misc_feature (228)..(228): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagccctccctcgtgtccgggtctcctggacagtcagtccaccgtctcctgcagtcggaaccngcagtgacgttggtgcttataaccgtgtctcctggtaccagcacgcccccaggcacacgcccccaaactccatgtatttttgacgtcagtaatccggccctcgacgggtccctgactcgtcttctcgttcgggtacctaaggtctcggcaggccgaccggtccctaccctggtaactttacgtccttcggtcgggtccctaccgagtacgttacggacgggaacggacgggtcctaggaaactttagtttacgttgacaggtccttacaacttaacttaaccggaaagggtaaccaaaccgttaacttagttaccgtttaccgttaacggtaaccggtaacgggtaaccctaaacggtcccgtacccgttaccgtaacggttccgaacggtacccccgaaacggacccccaaccccgtacccg

SEQ ID NO: 535 - DNA, 565 bp, Homo sapiens
  misc_feature: GYAE6OF02GJ2NT.29.36.D03.1.454.CMB.1.raw
  modified_base (216)..(216): a, c, t, g, unknown or other
  misc_feature (216)..(216): n is a, c, g, or t
  modified_base (546)..(546): a, c, t, g, unknown or other
  misc_feature (546)..(546): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtncttataaccgtgtctcctggtaccagcacgcccccaggcacacgcccccaaactcatgtatttttcgacgtcagtaactccggccctcgacggggtccctgactcgctttctcgtcggtccaagtctggcagcacggcctcctgacttactctcgtggcctaccgagtactgacggacgaggctagtaatattattgcagctacatacgtaacgaagggactaactacttatcgttacgtacggaacgtcggaacctaacgtccaccgtacgtacgtccacgacccgaacggaccccaaccctacgtcgtaccacttccgtccgtccccnccctacctccgacgttacc

SEQ ID NO: 536 - DNA, 583 bp, Homo sapiens
  misc_feature: GYAE6OF02ISDS8.29.36.D03.1.454.CMB.1.raw
  modified_base (215)..(215): a, c, t, g, unknown or other
  misc_feature (215)..(215): n is a, c, g, or t
  modified_base (311)..(311): a, c, t, g, unknown or other
  misc_feature (311)..(311): n is a, c, g, or t
  modified_base (318)..(318): a, c, t, g, unknown or other
  misc_feature (318)..(318): n is a, c, g, or t
tcagatagagtactcacgaccggtgctcgatttagctgcgtcacgatctctcttggggatctcaggaggcagcactctcgggacgtctccaccatggcctgggctctgctcctcctcagcctcctcactcagggcacaggatcctgggctcagtctgccctgactcagcctcgctcagtgtccgggtctcctggacagtcagtcaccatcctccngcactggaccagcagcgatgtcggtggttataactttgtctcctggtaccaacaaccacccaggccgaccggccccccgactaccaattaatttangtatgtntagttaacgccgtcctcgacgggtccctgtatccgtctttctcgtcggctaccaagttcgtagaccaacgtcgtcgtccctccctcgacctactcctcgtcggcctccgacggtcctggacgtagtacgtacggttagtaatttacttacgtgtcgttcgcttactatttcgcgtaccggcctacccgctactcggtacgtacgttcggtcgggaccgggtaacggtaccgacggtccgtacggtacccgttaccgtaggtaccg

SEQ ID NO: 537 - DNA, 606 bp, Homo sapiens
  misc_feature: GYAE6OF02HHXFR.29.36.D03.1.454.CMB.1.raw
  modified_base (242)..(242): a, c, t, g, unknown or other
  misc_feature (242)..(242): n is a, c, g, or t
  modified_base (342)..(342): a, c, t, g, unknown or other
  misc_feature (342)..(342): n is a, c, g, or t
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtcctcctggtaccngcacgccccaggccacacgcccccaaactcatgtattttgacgtcagtaactccggccctcgacggggtccctgactcgtcttctcgtcgggtccagtcncggcacgcgacggccctcccgtgtactttactcttcgtggcctccagactggacggacggaggctaggtaattattagttgacagtcctacaataacgtacgaaagggaccaactacttagtcgttacgttacggaacgttacgggaacctaaggtcctaacccgtcgtaacggtccgacgacccgtaacggaacccaaccccgtactcgtaccctaccgttccgttcccgttacccctccccttaccgttacctacgttaccc

SEQ ID NO: 538 - DNA, 443 bp, Homo sapiens
  misc_feature: GYAE6OF02GKG6E.29.36.D03.1.454.CMB.1.raw
  modified_base (419)..(419): a, c, t, g, unknown or other
  misc_feature (419)..(419): n is a, c, g, or t
  modified_base (424)..(425): a, c, t, g, unknown or other
  misc_feature (424)..(425): n is a, c, g, or t
  modified_base (427)..(443): a, c, t, g, unknown or other
  misc_feature (427)..(443): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcagcccccaggcacacgcccccaaactcatgatttttgacgtcagtaatcggccctcaggggtccctgatcgcttctctgggtccaagtctggcagcacggcctccctgattatctctgggctccagactgaggacgaggctgaatattattgcagctcatatacaagggacaacacttatgtcttacggaactgggaccaaagtcaccgtctagtcagcccaaggcccaacccactgtcactctcgtcccgcctcctcagtactctatctgagcggctggcaaggccgnatagnncnnnnnnnnnnnnnnnnn

SEQ ID NO: 539 - DNA, 652 bp, Homo sapiens
  misc_feature: GYAE6OF02IYOAG.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcgagggcacaggatcctgggctcagtctgccctgactcagccctccctccgtgtccggtctcctggacagtcagtcaccgtctcctgcagtcgaaccagcaggtgacgttggtgcttataccgtgtctcctggtaccagcacgcccccaggccacaccgacccccaactcatcgtattttcgacgtcagtactccggccctcgacgggtccctgactcgtccttcgtcgtcggtacgtagtcgtggcagccgaccgtccctccgtgtacttacgtcctcggtcggcctacgacgtacgtggacggacggtaggtcgtagtaacttacgtttatacggactaacgtccttaacgtaagttaacgtaaaccggaagggtaaccttaaacgtaacgtttagttaccgtttaccggttaacgggtaaccggtaaccgggtaacccgtaaacggttcccgtaacccggttaccgttacgggtacccgaaccggtaccccggaaacggtacccccctacccgtacccgg

SEQ ID NO: 540 - DNA, 718 bp, Homo sapiens
  misc_feature: GYAE6OF02H42WX.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctcagtctcgccctgactcagccctccctccgtgtccgggtctccgtggacagtcagtcaccgtctcctgcacgtcggaaccagcgagcgatggtcggtggttattaactttgtctccgtaggtaaccaacaaccacccgaggccgaccggccccccgactcaagttaattatgtatgtactaagttaacggccgtcctcggacggggtccctagtactccgtctttcgtcgtcggctaccgaacgttccgtacgaccaactacctcgtccccttcccgtacgaccctacgttccgttaccggtcggggtccttaccgacgggtacctaggaaccgtaagtacgggtaacgggttagtaacgttttaacgtttacgtacggttccgttcggtaccttacgtttaacgttttcggaccgtaccggacccgtacccgtacgttaccgttcggttacgtccggttttaccgggttccggggaaccggggtacggggtaaaccccgtaacggtcccggttacccggtaaccccggttaccgtacggggtacctaccggtacgttaaccccggg

SEQ ID NO: 541 - DNA, 676 bp, Homo sapiens
  misc_feature: GYAE6OF02HVH6L.29.36.D03.1.454.CMB.1.raw
  modified_base (243)..(243): a, c, t, g, unknown or other
  misc_feature (243)..(243): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcaggcacaggatccgtgggctcagtctcgccctgactcagcctccctcgtgtccggtctccgtggacagtcagtcaccgtctcctgcagtcggaaccagcagtcgacgttggtntcttataaccgtgtctcctggtaccagcacgccccaggccaacaccgaccccaaacgtcatgttattttcgacgttactaagtaacgtccgccctcgacgggtcctgactcgtcttcgtcgtcggtacctaaggtcgtggactacggccgaccgggtcccttaccgtagtactttactcgttcgtcgggtctaccgtaacgtacgtcggaacgggaccgtaggtacctaggttaaacttagtttacgtcgtacgtaacggtccttactaaacgttaacgtaaaccgaaagggtaaccctaaacgttaactttagtaccgttaccggttacggtaaacccggtagggtaaaccctaacggtacccgtaacccggttccgtaacggtacccggtaaccgtaaccccggtaaacgacccccgtaaaccctaaccgg

SEQ ID NO: 542 - DNA, 539 bp, Homo sapiens
  misc_feature: GYAE6OF02FUKZE.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcagcccccaggcacagcccccaaactcatgatttttgacgtcagtaatcggccctcgaggggtccctgatcgcttctctgggtccaagtctggcagcacggcctccctgattatctctggctccgagactgaggacgaggctgaatattattgcagctcatatacaagggacaactacttatcgtacttacggaactgggaacctaaagtccaccgttccgtaggtaccacgacccaacggacccaaccccactacgtccacgttcctcgttccccacccttcctactacgttaacc

SEQ ID NO: 543 - DNA, 718 bp, Homo sapiens
  misc_feature: GYAE6OF02J2SGF.29.36.D03.1.454.CMB.1.raw
  modified_base (235)..(235): a, c, t, g, unknown or other
  misc_feature (235)..(235): n is a, c, g, or t
  modified_base (486)..(486): a, c, t, g, unknown or other
  misc_feature (486)..(486): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctcagtctcgccctgactcacgccctccctcggtcgtccgggtctccgtggacagtcagtcaccgtctcctgcaggtacggaaccngccagtggacgttggtcgtacttataaccgttcgtccttccgtcgtaccagccaccgccccgaggccaccgaccgacccccaaactccattacgttacgttttacgacgtcaagttaaccgtccggtcccctacggtacggggtccctagtcgttcctcgtttacctcggttacgggtacctaagtccgtggcgacgccgaccggtccctaccgtagtactacgttcctacggtcggtccaccgacgtacncgggtacggacgtcggtacttaacgttaattacgttactcggactacggtctaacttaaacgtacgtaaaccggacggtaaaccctaagttacgttaacgttcggttaccgttaaaccgggttaccggtaaccgggtaaaccgttaacgtaacccgttaaccgggttacccgtaacggttacccgaaacccggtaccccgtaaacccggaccccccttaaacccgttacccg

SEQ ID NO: 544 - DNA, 636 bp, Homo sapiens
  misc_feature: GYAE6OF02GKEOT.29.36.D03.1.454.CMB.1.raw
  modified_base (198)..(198): a, c, t, g, unknown or other
  misc_feature (198)..(198): n is a, c, g, or t
  modified_base (348)..(348): a, c, t, g, unknown or other
  misc_feature (348)..(348): n is a, c, g, or t
  modified_base (373)..(373): a, c, t, g, unknown or other
  misc_feature (373)..(373): n is a, c, g, or t
  modified_base (438)..(438): a, c, t, g, unknown or other
  misc_feature (438)..(438): n is a, c, g, or t
tcagatagagtactcacgaccggtgctcgatttagctgcgtcacgagctctctcggaatatctccaccatggcctgggctctgctcctcctcaccctcctcactcaggcacaggatcctggctcagtctgccctgactcagcctccctccgtgtccggtctcctggacagtcagtcaccgtctcctgcagtggaaccngcagtgacgttggtgcttataaccgtgtctcctggtaccagcacgccccaggcacacgcccccaaactcatgtattttgacgtacagtaactccggccctcgacggggtccctgactcgtcttccgtcgtcgggtaccaagtctggaccngcacggtccctcctagtactttacncttcgtcgggcctaccgagtacgtggtacggacgcggctaggtaattacttattcgactagctanatactaacgaaggactaaactactttatacgttccgttacggaacgtacggtaaccgtaaacgtccgtaacccgttccgtaacgtccacgtaccccgaaccggtaccccaaaccccgtacgttaccgacccgttaccttacccgtttaccccgttacccccgtacccccttaccccggttaccgttaacccttacccg

SEQ ID NO: 545 - DNA, 762 bp, Homo sapiens
  misc_feature: GYAE6OF02GKZLK.29.36.D03.1.454.CMB.1.raw
  modified_base (125)..(125): a, c, t, g, unknown or other
  misc_feature (125)..(125): n is a, c, g, or t
  modified_base (198)..(198): a, c, t, g, unknown or other
  misc_feature (198)..(198): n is a, c, g, or t
  modified_base (213)..(213): a, c, t, g, unknown or other
  misc_feature (213)..(213): n is a, c, g, or t
tcagatagagtactcacgaccggtgctcgatttagctgcgtcacgagctctctcggaatatctccaccatggcctgggctctgctcctcctcaccctctcactcagggcacaggatcctgggctnagtctgcctgactcagcctcctccgtgtccggtctcctggacagtcagtcaccgtctcctgcagtcggaaccngctagtgacgttggntacttactaaccgtgtctcgtaggtaccagccacgcccaggcacgaccgacccctaaatcatgtatttcgactagacgtaacgtccggtcctcggtacgggtcctgtacgtccgtcttcgtcggttacggtacctaaggtctggacctacggccgtaccggtccctcgtagtaactttacgtccgttcggtcggtaccctacgtacggtaaccgttagggaaccggtacggtaaccggtattaaacggtaactttaagtttaccggtaaggtaccgtaacggttacccttagtaaacgttaaccggttaaaaccgaacgggtaaaccctaaacgttaacgtttaacgtcggtttaacccggttaaaccgggaaccgttaaccggggaaaaccttaaaccggttcccgtaaacccggtttaccggtaaacgtaccgtaaccggtacccggaaaacccggtcccctaaaccccgttcgtaacccggttacctaaccgttcccggtttaccgttaccccgtcccctttaacgttacccgtacgtttaacccg

SEQ ID NO: 546 - DNA, 601 bp, Homo sapiens
  misc_feature: GYAE6OF02FQXB5.29.36.D03.1.454.CMB.1.raw
  modified_base (216)..(216): a, c, t, g, unknown or other
  misc_feature (216)..(216): n is a, c, g, or t
  modified_base (287)..(287): a, c, t, g, unknown or other
  misc_feature (287)..(287): n is a, c, g, or t
  modified_base (336)..(336): a, c, t, g, unknown or other
  misc_feature (336)..(336): n is a, c, g, or t
  modified_base (393)..(393): a, c, t, g, unknown or other
  misc_feature (393)..(393): n is a, c, g, or t
tcagatagagtactcacgaccggtgctcgatttagctgcgtcacgagctctctcggaatatctccaccatggcctgggctctgctcctcctcacccctcctcactcagggcacaggatcctgggctcagtctgccctgactcagcctccctccgtgtccgggtctcctggacagtcagtcaccgtctcctgcagtggaaccagcagtgacgttggncttataaccgtgtcctcctggtaccagcacgccccaggcacacgacccccaatcattgtattttcgacgtnagtactcggccctgcgggtcctgactcgcttctcgtcgggtaccagtcnggcagcgaccgtcctcctgtacttctctcgtcggtcctccgagactggacggacggngtctagtaattattagttcgctagtctataagtactaaacgaacggtaactaactacgtttatacgttaccggttacggtaacgtaacggtaacctaacgtcctaacccgttccgtaacgtccgacgacccgaaccggaccccaaacccgttctacgtaccctacgttcccttcccgttacccctacccgtccctacgttacctaccc

SEQ ID NO: 547 - DNA, 568 bp, Homo sapiens
  misc_feature: GYAE6OF02F8MPR.29.36.D03.1.454.CMB.1.raw
  modified_base (284)..(284): a, c, t, g, unknown or other
  misc_feature (284)..(284): n is a, c, g, or t
  modified_base (447)..(447): a, c, t, g, unknown or other
  misc_feature (447)..(447): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctcctccgtgtccgggtctccgtggacagtcagtcaccgtctcctgcagtcggaaccagcagtgacgttggtgcttatacgtgtctcctggtaccagtcacgcccccaggccacncgaccccaactcattcgtatttttcgacgtctaagtacgtccggtccctcgacgggtcctaggctcgtcttcgtcgtcggtctaacgtcgtggcacgcaccggtcctcgtagtattactctcgtcggctccagtacgtagacggacggacgcgtagtaacttnttatcgactgtctactaacttacgtaacggtaacgaacctaactacgttactcggttacgtacggacgtacggaaccaacgtcgaccgtactacgtcaccgaccacggtacccacctaccg

SEQ ID NO: 548 - DNA, 806 bp, Homo sapiens
  misc_feature: GYAE6OF02HRLDR.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagccctccctccgtgtccgggtctccgtggacagtcagtcaccgtctcctgcagtggaaccagcagtgacgttggtgcttataaccgtgtctctcggtaccagcacgccccaggcacacgacccccaaactccatgtattttcgacgtctaagtactcggccctcgacggggtccctagtactcgtcttcgtcgttacgggtacctaagtccgtcggcacggcccgaccgggtccccttcccgttacggtaacttttaccgttcccgttcggttcgggggtacccttcccggtaacggtaccgttacggggaaaccggggtaaccgggtaacggggtaccgttaagggttaaacgttaacgtttttaacgtttacgggaccgttaccgggtacctttacgtaaacgtttaacgttaaaaccgggtaaaacggggtaaacccttaaaacccggttaaactttttaacggttaccgggttttacccgggttttaaaccgggtaaaccggttaacccgggggtaaaccccgttaaaacgggttaccccgttaaccccggttaacccgggtttaaccgggtacccgtaaacccgggtaacccccggaaacccgggtaaccccctaaaccccccggttaacccgg

SEQ ID NO: 549 - DNA, 616 bp, Homo sapiens
  misc_feature: GYAE6OF02FZXT7.29.36.D03.1.454.CMB.1.raw
  modified_base (226)..(226): a, c, t, g, unknown or other
  misc_feature (226)..(226): n is a, c, g, or t
  modified_base (456)..(456): a, c, t, g, unknown or other
  misc_feature (456)..(456): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctcgtgtccgggtctccgtggacagtcagtcaccgtctcctgcagtggaaccngcagtgacgttggtgtcttataaccgtgtctcctggtaccagccacgcccccgaggccaccaccgaccccaaactcatgtattttgacgtcaagtacgtccgccctcgacgggtcctgactcgtcttcgtcgtcggtcctaagtcgtgcacgccgaccggtccctccgtgtattactccgtcgtcgggtcctaccgagtacgtggacggacggacggtacgtagtaattnttatcgactacgtactactaataactaacgaaacggtaactaaacgttacgttagttcgttacgttacggtacggtaacggtaaaccgtaaccggtaccgtaaccgttaccggttacggtccgtaaccggacccgtaaccggtacccccaacccgtaccg

SEQ ID NO: 550 - DNA, 608 bp, Homo sapiens
  misc_feature: GYAE6OF02FTDKN.29.36.D03.1.454.CMB.1.raw
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccagcagtgacgttggtgcttataaccgtgtctcctggtaccagcacgccccaggcacacgacccccaaactcatgtattttgacgtcagtaactcggccctcgacgggtccctgatcgcttctcgtcgggtacctaagtctcggcagccaccggccctcctgtacttactctcgtgggcctccgagacgtggacggacgaggtctagtaacttattagttcgactagtctacaatacgtaacgaacggaactaactacttagtcgttacgttacggtaacgtacgggaacctaaacgtccgtaccgtaccgtaacggttaccacggacccgaacggtaccccaaacccgtaccgtacgtacctaccgttccgttacccgttccccgccctcccgttacctacgttaccc

SEQ ID NO: 551 - DNA, 774 bp, Homo sapiens
  misc_feature: GYAE6OF02JAZOP.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcacgcctccctccgtgtccgggtctcctggacagtcagtcaccgtctcctgcaggtggaaccagcagtcgacgttggtctacttaacgtaaccggttgtaccttccgttacggtaaccaggccaccggcccccgaggaccacgaccgacccccctaaatcagttgttactttttcggacgttctaaggttacgtcccggtacccgtacggacggggttccctggtacgtcgtctttcgtcgttcgggtaccaacggttcgtcggacgacggcgtaccggtcccttaccgtagtacttacgttcgttcggtcggtcctaccgaacggtaccgtagggacgggtacggtacggtacgtaggtaaactttagttagttacggacgtacgtaccgttactaacgtaacgtaacggtaaaccgggtaaactaaaccgtaacttttaacgtccggttaaccggttacgggtaaaccgtaccgggtaaaccgtaaaccgttaccgtaaccggttaccgttaacggtaacccgacgtaaccccgggtaaccgtaccccctaaacccgtacgttacccgtacccgtaccgtttcccgttacccggttaccccctacccgttacccgtccgttaaccgttaccc

SEQ ID NO: 552 - DNA, 595 bp, Homo sapiens
  misc_feature: GYAE6OF02GZOIF.29.36.D03.1.454.CMB.1.raw
  modified_base (201)..(201): a, c, t, g, unknown or other
  misc_feature (201)..(201): n is a, c, g, or t
  modified_base (215)..(215): a, c, t, g, unknown or other
  misc_feature (215)..(215): n is a, c, g, or t
tcagatagagtactcacgaccggtgctcgatttagctgcgtcacgatctctctcggaatatctccaccatggcctgggctctgctcctcctcaccctcctcactcagggcacaggatcctgggctcagtctgccctgactcagcctccctccgtgtccgggtctcctggacagtcagtcaccgtctcctgcagtggaaccngcagtgacgttggngcttataaccgtgtctcctggtaccagcacgccccaggcacacgcccccaaactcatgtattttgacgtcaagtaactccggccctcgacggggtccctgactcgtcttctcgtgggtaccaagtcgtgcacgcacggccctcctgacttatctcgtggcctcgagacgtgaggacgaggtctagaattacgttatgacagtctactaataactaacgaacggaacaactactttactagttacgttacggaacgtacggaacctaaacgtaccctaccgttaccgtaggaccgaccgaccctaaaccggacccctaaaccctacttaccgtaccttacctccgttccgttccccgtacccttccgtaccgtacgttacc

SEQ ID NO: 553 - DNA, 604 bp, Homo sapiens
  misc_feature: GYAE6OF02GC6W6.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacaggatcctgggctcagtctgccctgactcagcctccctcgtgtccggtctcctggacagtcagtcaccgtctcctgcagtggaaccagcagtgacgttggtgcttataaccgtgtctcctggtaccagcacgcccccaggccacacgacccccaaaactcatgtatttttgacgtcaagtatccggccctcacggggtccctgatcgcttctcgtgggtaccaagtcgtggcagccgaccgggcctccctgtacttactctcgtgggcctccagtacgtaggacggtacggaggcttgaacttattatgactagtctactataactaacgaagggaactaaacgtaactttatacggttaccgttacgggaaaccgtacggggtaaccctaaacggtccgtaacccgttaccgttaacgggtacccaacggtaccccgaaacggtaccccctaaaccccgttaaccg

SEQ ID NO: 554 - DNA, 764 bp, Homo sapiens
  misc_feature: GYAE6OF02FKJ66.29.36.D03.1.454.CMB.1.raw
tcagatagagtactcacgaccggtgctcgatttagctgcgtcacgatctctctcggaatatctccaccatggcctgggctctgctcctcctcaccctcctcactcaggcacaggatcctgggctcagtctgccctgactcagcctccctccgtgtccgggtctccgtggacagtcagtccaccgtctcctgcagtcggaaccagcagtgacgttggtgtcttaactaaccgtgtaccttccgtaggtaccagcacgccccgaggccaccacgacccccaaactcagtgtacgttttcgacgtctagtaacgtccggccctcggtacgggtccctgactccgtcgttcttcgttcgggtacctaaggtcctcggcctacggccgaccggtccccttacccgttaggtaactttccgtcgttaccggtcgggtcccttaccgacgtaccgtagggacggtacggtacggacgtagtaatttagttaacgttcgtacgacgtaccttacgtaagtaacgtaacggtaaacgaacgtaacctaaccgtttacgttacggttacccgttacgggtaaccgtacgggaaaccgttaaaaccgttccgtaaacccggttaccgttaacgggtacccgacccgtaaccccgtaaaccgggtaccccctaaacccccggttacgtttacccggttaaccgttaaccccgtttcccgttaccccggtttaccccccgccccgtttaccccgttacggttaccgtttaacccccg

SEQ ID NO: 555 - DNA, 768 bp, Homo sapiens
  misc_feature: GYAE6OF02GUVC0.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatcctgggctcagtctgccctgactcacgccctccctccgtcggtccgggtcctccgtggacagtcagtccaccgtctcctgcagtggaaccagcagtgtacggttggtgtacttactaaccgtgtcctccgtggtaccagccaccgccccgaggccacgaccgacccccaactcatagttattttcgacgttactacgtaacgtccggcccgtacggtacgggtccctgactcgtctttcgtcgtcggtacctacgtcgtcggcagccgtaccggtccctccctagttacttacgtcgttccggtcggtacctacgacgtacgtacgggacggtaacggacggtacgttaagtaattagtttacgttacggactacggttactaacgttaacgttaacgaaaccggtaaacgggtaacctaaaccttacgtttaaccggttcgttaacccggttaacggggtaaacccgttaacgggtaaacccgttaaacggttcccgtaaaccccgtttacgggtaacgtacccgaacccggtaacccccgtaaccgggtaaccccccaaccccgttaaacgttcccgttacccgtacccgtttacccggttacccccttaccccgtaaccccctaccgttacgttaacccctttaaccg

SEQ ID NO: 556 - DNA, 675 bp, Homo sapiens
  misc_feature: GYAE6OF02JX44D.29.36.D03.1.454.CMB.1.raw
tcagatagagtactcacgaccggtgctcgatttagctgcgtcacgatctctcttggggatctcaggaggcagctctctcggaatatctccaccatggcctggtctctgctcctcctcaccctcctcactcagggcacaggactcctgggctcagtctgccctgactcagtccctcccgtcgtcggtccgggtctaccgtggaacctggtcacggtccaccgttctccgtgcaaggtggaacccaggcaggtcgacggttggtgtcttactaaccgtgtccttctacggttaccgagtccgaaccgccccaggtaccacaccgacccccaatccaacgttcgtacgtttttcgaacgttacgaacgtaactccggaccctcggtaccgggtcctggtactcgtcttcgtcgtacgggactaagtcgcgtacgacgccgacggtccctaccgtgtacttactccgttcggtcggacctcgacgtacgtacgaggacggtcgtacgtagtacttaagtcgttacgctacgtctagtaagttacgtaacgaaacggtactaaagtaccgtttagtaccgtacgttaaggaaccgttaggtaacctaaacgggttccctaacccgggtacttaccggtactacccggtaacccgtacggaacccccgtacccttaaccgg

SEQ ID NO: 557 - DNA, 706 bp, Homo sapiens
  misc_feature: GYAE6OF02G3VQR.29.36.D03.1.454.CMB.1.raw
  modified_base (205)..(205): a, c, t, g, unknown or other
  misc_feature (205)..(205): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctcagtctcgccctgactcacgtccctcccgtcgtcggtcccggtctccgtggacngtcagtccaccgtctcctgcaggtacggaaccagcgaggtgtacggttggtgtacttaacgtaaccgtcgtccttccgtacggtaccacgcgaccgcccccgaggccaccgacccgaccccctaactccgagttacgttacttttacggacgtacgtaacgttacgtccggtacccgtacgggtacgggtccgtagtacgtccgtcttccgttcggttacggtaccgtaaggttccgtacggactacggacccgtcccgggtacccttccgtacgtactttacgtccgttccggtcggtccctacgtacggtacggtacgggacgggacggtacgtacgttaagtaacttagtttacgtcgtacgtacgtacctacgtaacgttaacgaacggtaaacgaacctacgttaacgttagtacgttaccgtacggtaacggtaacggaaccgtaacgtccgtaccgtacgtacgtcgaccgacccgaaccggtacccacctacg

SEQ ID NO: 558 - DNA, 722 bp, Homo sapiens
  misc_feature: GYAE6OF02I0562.29.36.D03.1.454.CMB.1.raw
tcagatagagtactcacgaccggtgctcgatttagctgcgtcacgatctctcttggggatctcaggaggcagctctctcggaatatctccaccatggcctggctctgctcctcctcaccctcctcactcagggcacaggacttccgtgggctcgagtcctcgcccgttgacttcacgtccccttccccgttccggttcggttcccgggtcctccgtacggaccgacgttcacgtccaccgttcctcctgccacggtacggaaccagcgaggtcgtacgttggtctacttacgttaacgtcgttcctaccgtacggtaccacgcaccgccccgaggtccaaccgaccgacccctaaactcacgtttgtacgtttttacgacgtcgtaaacgtaccgtccggtcccgtacggtaccgggttcccgtacgtacgttccgtccgttccgtcggtttacggtccgtaacggtcgtggtaccacggtaccctccggtcccttccgtacgtacgtttactcgtcggttacggccttacgacgtacgtcggaacgggtacggtaaggtactagttaacgtttagttacgttagcccgtagtaccgttaacgtaagttaacgtaacgaaacgttaactaacttagttacgtcgtttacgtacgtaacggtaacgtaacgtaacgaccgtaccgtcgtacggtcgaacgtacccgaccgaccctactacccg

SEQ ID NO: 559 - DNA, 910 bp, Homo sapiens
  misc_feature: GYAE6OF02FL0ZM.29.36.D03.1.454.CMB.1.raw
  modified_base (167)..(167): a, c, t, g, unknown or other
  misc_feature (167)..(167): n is a, c, g, or t
  modified_base (201)..(201): a, c, t, g, unknown or other
  misc_feature (201)..(201): n is a, c, g, or t
tcagatagagtactcacgaccggtgctcgatttagctgcgtcacgatctctcttggggatctcaggaggcagctctctcggaatatctccacatggcctggctctgctcctcctcaccctcctcactcagggcacaggactccgtgggctcagtctcgccctgactnacgcctcgctcagtcgtccgggtctccgtggacngtcagtaccaccatctccgtgacacgtacggaaccagacgacgacgtacgtggtacgggttaggtttaacgttaacgttttcgtccgttccgttacggtaaccctaaccaaacccgacccggaacgggacccggtacccgggcccccccgtaacgtacctaactttaaaacgttttagtacgaacgttcggtaactaaacgttaacgggacccgggtccccgtacgggtaccggggttacccctgtacgttacccggttcctttacccgttccggttaccgtcccgtttaacccgttaacggtacccgtttaacggggaaccccttaaaccggtacccttaccgggtaccccctttacccggtaaccgttaccccgtaaacctttccgtaaccgggttcccgggtccgttacccggtacggtaccgttcggtaaaccgtacggttacgggtaccgtttacgttaaaccgtttaaccgggttttaccgttacggttacccgttacgttaccgtttaccgtttaacggttttcccggacggtaaacccgggtaccccgtaaccccggttacccggtccgttttacgggtcccgttaacggtttaccccggggttaaccggggtaaccggggttaaccccgggtaaccggaacggggtttaccccgtaccgggggtttaacccccgttaccggggtttacggtaaaccccgg

SEQ ID NO: 560 - DNA, 805 bp, Homo sapiens
  misc_feature: GYAE6OF02HHZMF.29.36.D03.1.454.CMB.1.raw
  modified_base (212)..(212): a, c, t, g, unknown or other
  misc_feature (212)..(212): n is a, c, g, or t
tcagatagagtactcacgaccggtgctcgatttagctgcgtcacgatctctctcggaatatctccaccatggcctgggctctgctcctcctcaccctcctcatcagggcacaggactctcgggctcagtctcgccctgacctcacgccctccgtcgtggtccggtctccgtggactaggtcagtccaccgtctccgtgcacgtacggaaccngcgagcgtattcggtacggttagtttaacttactttcggtcctaccggttacggaaaccctaaacgaccgaccggacggaccggacccggtaccccgtaactacttaacttaacgttacgtacgtacgttacgttaacgttaacggttaaccggccggtacccggtacgggtaccgggtacctcgtaccgttcgtaccttcgtcggtacgtaccgtacgtaacgtcggtacgaacctaaccgtccgtaccgtacccgtaccgtacgtaccgttacgttcggtaccggtccggtacctacggtacgtacggtacgtaacggtacggtacgggtacggttagttacgttacgttacgcgtacgtcgttacgttacgttcggttaccggtacggtaccggtaccgtcccgtacgtacgttcggttacggtaccgttaccggggttacgggaccgaacgggtaaccgtacggtaccgttaccgggttacccgttacgggtacgtacggtaccggtaccggtaccggaccggttcccgtccccgttacccggttccgttacccggttaccgtttaccccgttccctaccccgttaccg

SEQ ID NO: 561 - DNA, 599 bp, Homo sapiens
  misc_feature: GYAE6OF02HCB0I.29.36.D03.1.454.CMB.1.raw
  modified_base (235)..(235): a, c, t, g, unknown or other
  misc_feature (235)..(235): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctcagtctgccctgactcagccctccctccgtcgtcccgggtctcctggacagtcagtccacccgtctcctgcaggtacggaaccngcagtgacgttggtgtcttaagtaccgtgtcctccgtggtaccagcaccgccccaggccaacaccgacccccaactcatgttattttcgacgtacaagttacgtccggccctacggtcgggtccctgtactcgtcttcgtcgtcggtacctagtctggcacgccgaccgtccctcctagtactactcgtcgtcggtcctacgacgtacgaggacggacgagtctagtaattattagtcgcacgtctagtaactaacgtaacgaacggtaacaacttagttacgtcgtacgtacggtaacggtacggaactaacggtcctaccggtacgtacggtaccacgtacccaaccggacccacccgtacg

SEQ ID NO: 562 - DNA, 759 bp, Homo sapiens
  misc_feature: GYAE6OF02FK64I.29.36.D03.1.454.CMB.1.raw
tcagatagagtactcacgaccggtgctcgatttagctgcgtcacgagctctctcggaatatctccaccatggcctgggctctgctcctcctcaccctcctcactcagggcacaggatccgtgggctcagtctgccctgactcagccctccctccgtgtccgggtctccgtggacagtcagtccaccgtctcctgcagtggaaccagcagtgacggttggtgcttaataccgtgtcctccgtggtaccagccaccgcccccgaggcaaccgaccgacccccctaaactcattgttatttttacgaccgttactaaggttaaccgtccggtccccgtacggacggggttccctaggtactccgtctttccgtcgttcgggtacctaagtcgtcggcacgccgaccgtccctcctagtattactctcgtcggtcctaccgtagacgtaggaggacggacggtactagtaaatttagttacgttcgactacgtctaactaacgttaacgttaaaccggaaacgggtaaaccttaaaccgttaacgtttaacgttaccggtttaccggtttaccgggaaaccggttaacgggtaaaccgtaaccgtttaacccgtaaccccggttaccgttaaccgggtaccacccgtaaccccggaacccggaaccccctaaaccccgtaacccgttaccggtacccttacccgttacccgttaccccggttacccccttaccccgttacccgttaccctaaccggttacccc

SEQ ID NO: 563 - DNA, 686 bp, Homo sapiens
  misc_feature: GYAE6OF02HKBZD.29.36.D03.1.454.CMB.1.raw
  modified_base (174)..(174): a, c, t, g, unknown or other
  misc_feature (174)..(174): n is a, c, g, or t
  modified_base (200)..(200): a, c, t, g, unknown or other
  misc_feature (200)..(200): n is a, c, g, or t
tcagatagagtactcacgaccggtgctcgatttagctgcgtcacgatctctctcggaatatctccaccatggcctgggctctgctcctcctcaccctcctcactcagggcacaggatcctgggactcgacgtctgccctgactcagcctcctccgtggtccggtctcctggacngtcagtcacgtctctgcagtgaaccngcagtgcgttggctcttataccgtgtctaccgtggtacagcacgccccaggcacaccgccccaaatctatcgtattttcgacgtctagtactccgccctagcgggtacctggactccgtcttctcgtggtacccagtactggacgagcccgcggtccttcccgtaggtactttacgccgtttagtccggggtactacccggagtaccgttacgaaccgttacggtacggtaacggtaacggtaacttttaacgtaccgttagggtaccttcggtaaccgttcgtttaacgtttacccggaacggttaaccggtacccgtacccgaccggttacgttacggtacgtacgtttaccgggtacgggacgaaccggtaccgtaacgcgtaccggtacccgtacggtacgtacgaacggttacgtaccgtaacgggtcccaccggttccccgttggtaccctacggttccctaccggttacccctacccgg

SEQ ID NO: 564 - DNA, 729 bp, Homo sapiens
  misc_feature: GYAE6OF02G23X4.29.36.D03.1.454.CMB.1.raw
  modified_base (276)..(276): a, c, t, g, unknown or other
  misc_feature (276)..(276): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcaacaggatccgtgggctcagtctgccctgactcagccctccgtcgtcggtccgggtctcctggacagtcagtcaccgtctcctgcagtcggaaccagctagtgtacgttggtgtcttacgtaacgtgtctccgtagtaccngccacgccccaggaccaccaccgccccaaactctacgttgttatttttacggacgtactaacggtacgtccgggtacccctacggtaccgggttaccctggtaccgtaccgtctttccgttacgtcgggttccctaaggtcgtacggcgtacgaccggtacccggtcccttaccgtacgtactttactcggttccgtcgggtacctaccgtacggtacgtaggaaccgggtacggacggtccgttaaggtaaacttagtttacgtacggtcgtaacgttctacgtaaaccgtaacgttaacggaaaccggaaactaaaccggttaccgttaagtttccggttaccgttaaccggtaaccgttacgggaaacccgttaaacggtacccgttaacccggttacgttacccggtaccggtaaccgtaaccggtaacccaccccgtaacccgtaccg

SEQ ID NO: 565 - DNA, 621 bp, Homo sapiens
  misc_feature: GYAE6OF02H9C9O.29.36.D03.1.454.CMB.1.raw
  modified_base (221)..(221): a, c, t, g, unknown or other
  misc_feature (221)..(221): n is a, c, g, or t
  modified_base (226)..(226): a, c, t, g, unknown or other
  misc_feature (226)..(226): n is a, c, g, or t
  modified_base (248)..(248): a, c, t, g, unknown or other
  misc_feature (248)..(248): n is a, c, g, or t
  modified_base (317)..(317): a, c, t, g, unknown or other
  misc_feature (317)..(317): n is a, c, g, or t
  modified_base (330)..(330): a, c, t, g, unknown or other
  misc_feature (330)..(330): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
  modified_base (457)..(457): a, c, t, g, unknown or other
  misc_feature (457)..(457): n is a, c, g, or t
  modified_base (555)..(555): a, c, t, g, unknown or other
  misc_feature (555)..(555): n is a, c, g, or t
  modified_base (559)..(559): a, c, t, g, unknown or other
  misc_feature (559)..(559): n is a, c, g, or t
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
tcagatagagtactcacgaccggtgctcgatttagctgcgtcacgatctctcctggcagtcagtcaccgtctcctgcagtgaaccagcagtgacgttggtgcttataaccgtgtctctggtacagcagccccaggcacacgcccccaaactccagtgatttttagacgttcagtaatccggcctcgaggggtccctgactcgcttgtctagggtccaagtntcggnacgcacggctccctgtaacttncgtcgtgggtcctccgaggcctcgggacattcggacggtcgtattaagtacgtgctcgctactttacgngacgcaacccgtnaccgtgtacgtattccgtttcgggacggtacggaaccgtaactcgtaaggtacccgtcccggtaaggtccncggttacctggaaccgttcncgggccccctgggtaccctactcgttccggtacccncccgttaccctcgacgtttccgtcttactaccggttacgacggttcccgggtcttcggggaaccgttacggcggtaccctacggtaacggtacaggtntcgngccgttgagtacgtcgtagngctcgcngctacgtcgagacgtacgtacgtgtcgtcgtagtg

SEQ ID NO: 566 - DNA, 848 bp, Homo sapiens
  misc_feature: GYAE6OF02HMKX5.29.36.D03.1.454.CMB.1.raw
  modified_base (242)..(242): a, c, t, g, unknown or other
  misc_feature (242)..(242): n is a, c, g, or t
  modified_base (276)..(276): a, c, t, g, unknown or other
  misc_feature (276)..(276): n is a, c, g, or t
tcagatagagtactcacgaccggtgctcgatttagctgcgtcacgagctctctcggaatatctccaccatggccgtgggctctgctcctcctcaccctcctcactcgagggcacaggactccgtgggctcagtctcgccctgactcgacgtccctccctccgtcgtcccgggtctccgtggactagtcacgtcctacccgtctcctgacgaggtacggaaccagctaggtgtacggttggtntacttaacgtaccgttcgtcctccgtggtaaccngccgaccgacccccgaggaccaaccgaacccgaacccccctaatacagttgttacgtttttcgacgtatacgtaacgtccggtaaaaccctcggtaccgggtcctcgtactcgtcgttcgtccggtacgggtactacggtcgtcggacgaccgaccgccggtacccttccgtagttaacttcgttaccgttcgtccgggtacctaaccgacggtacgtaggaacggtaccggacggtacgttaaggtaaacttttacggttacgtacgaacgtaccgttaccgtaaacttaaccgtaacggaaacgtaaaccggtaacttaaaccgttacgttacgttaaccgtttaaccggttaaaccggaaaccggttaaccgggtaaacccttaaaccggttaccccggtaaaccggttaccggttaaccgtaacccgaaaccccggtacccggtaaaaccccggtaaccccgtaaacccggttaccgttaccgttaaaccccggttaccgtttcccccggtaaccccggtttacccccgttacccccgtttaaccgtacccggttaaccgttaacccg

SEQ ID NO: 567 - DNA, 557 bp, Homo sapiens
  misc_feature: GYAE6OF02JSCTZ.29.36.D03.1.454.CMB.1.raw
  modified_base (237)..(237): a, c, t, g, unknown or other
  misc_feature (237)..(237): n is a, c, g, or t
  modified_base (246)..(246): a, c, t, g, unknown or other
  misc_feature (246)..(246): n is a, c, g, or t
  modified_base (251)..(251): a, c, t, g, unknown or other
  misc_feature (251)..(251): n is a, c, g, or t
  modified_base (254)..(254): a, c, t, g, unknown or other
  misc_feature (254)..(254): n is a, c, g, or t
  modified_base (275)..(275): a, c, t, g, unknown or other
  misc_feature (275)..(275): n is a, c, g, or t
  modified_base (286)..(286): a, c, t, g, unknown or other
  misc_feature (286)..(286): n is a, c, g, or t
  modified_base (462)..(462): a, c, t, g, unknown or other
  misc_feature (462)..(462): n is a, c, g, or t
  modified_base (517)..(517): a, c, t, g, unknown or other
  misc_feature (517)..(517): n is a, c, g, or t
  modified_base (526)..(530): a, c, t, g, unknown or other
  misc_feature (526)..(530): n is a, c, g, or t
  modified_base (533)..(534): a, c, t, g, unknown or other
  misc_feature (533)..(534): n is a, c, g, or t
  modified_base (536)..(557): a, c, t, g, unknown or other
  misc_feature (536)..(557): n is a, c, g, or t
tcagatagagtactcacgaccggtgctcgatttagctgcgtcacgatctctcctggacagtcagtcaccgtctcctgcagtggaaccagcagtgacgttggtgcttataaccgtgtctcctggtaccagcagccccccaggcacacgaccccccaaactccaatcgtaatttttgaacgtcagtaatcggccctcgaggggtccctgatcgcttctcgtgggtcaagtctggcagcncggcctccngtatntcngtggcctccagctgaggacgngctaggaattnttaatgactagtcctcgtatactaaccggaaggacaacgactttatgttcttaacggacgttacggaacctaaagtctaccgtacctaggtcacgtacccgaacggtacccaaccctacgtacgtcctacctccgtttccgtcccctacccgtcctaccgtaaccgttctaccgtntaccgttaggaccggtcggtccggtacggtaccggcgtaacgccttaagtacggntaaccgggnnnnncgnngnnnnnnnnnnnnnnnnnnnnnn

SEQ ID NO: 568 - DNA, 672 bp, Homo sapiens
  misc_feature: GYAE6OF02IHLFG.29.36.D03.1.454.CMB.1.raw
  modified_base (152)..(152): a, c, t, g, unknown or other
  misc_feature (152)..(152): n is a, c, g, or t
  modified_base (196)..(196): a, c, t, g, unknown or other
  misc_feature (196)..(196): n is a, c, g, or t
  modified_base (213)..(213): a, c, t, g, unknown or other
  misc_feature (213)..(213): n is a, c, g, or t
tcagatagagtactcacgaccggtgctcgatttagctgcgtcacgatctctcttggggatctcaggaggcagctctctcggaatatctccaccatggcctgggctctgctcctcctcaccctcctcactcagggcacaggatccgtgggctnagtctgccctgactcagcctcctcgtgtccggtctccgtggacngtcagtcaccgtctccngcagtcggaccagcagtgacggttggctcttataaccgtgtccttcgtcggtaccacggtcacgccccccgaggccaccaccggacccccaaactcgacttacgttattttcgacgttacgagttactccggccctcggtaccgggtcctagacgtcgtcttcgcgttcggtaccaacgttcgtcggctacgccgaccggtcccttccgtagacttttacgtccgttcggtcggtcctaccgaggtaccgtggaccgggacgacggtccttaaggaaatttacgtttagtacgactacgtctaccgtaattaacgtaacggaaacgggtacctaacttaaccgtttcgtacgttacgttaaccgggtaacgttacgggaaacccttaacgtacccgtaccggtttaccgtacgggttacccaccggtacccgtaaccggtaccccctacccgttacccg

SEQ ID NO: 569 - DNA, 593 bp, Homo sapiens
  misc_feature: GYAE6OF02F2KU2.29.36.D03.1.454.CMB.1.raw
  modified_base (202)..(202): a, c, t, g, unknown or other
  misc_feature (202)..(202): n is a, c, g, or t
  modified_base (215)..(215): a, c, t, g, unknown or other
  misc_feature (215)..(215): n is a, c, g, or t
  modified_base (290)..(290): a, c, t, g, unknown or other
  misc_feature (290)..(290): n is a, c, g, or t
  modified_base (316)..(316): a, c, t, g, unknown or other
  misc_feature (316)..(316): n is a, c, g, or t
  modified_base (439)..(439): a, c, t, g, unknown or other
  misc_feature (439)..(439): n is a, c, g, or t
  modified_base (528)..(528): a, c, t, g, unknown or other
  misc_feature (528)..(528): n is a, c, g, or t
  modified_base (550)..(550): a, c, t, g, unknown or other
  misc_feature (550)..(550): n is a, c, g, or t
tcagatagagtactcacgaccggtgctcgatttagctgcgtcacgatctctctcggaatatctccacatggcctgggctctgctcctccgtcaccctcctcactcagggcacaggatcctgggctcagtctgccctgactcagcctccctcggtgtccggtctcctggacagtcagtcaccgtctcctgcaggtcggaaccngcagtgacgttgngtcttataaccgtgtcctcgtggtaccagcacgccccaggcaccacgacccccaaatcgatgttattttgacgtnaaggtactccggcctcgacgggtccnggactcgtcttcgtcgtcgggacctagtctcggcacgtcaccggcctccgtatacttctcgtcgtcgggtcctacgagacgtcgaacgggacgacgtcgtaagtattattgtcgactacggtnaaccttataacgtacgaaacgactaactacttagtcgtaccgttacggacgtaaccgggaacttaccgtacctacgtaccgtagtaccnccggaaccaccgacccgtaccncgtcgtacctcttctcccgtaccctacccgtctacctattacc

SEQ ID NO: 570 - DNA, 765 bp, Homo sapiens
  misc_feature: GYAE6OF02FU882.29.36.D03.1.454.CMB.1.raw
  modified_base (197)..(197): a, c, t, g, unknown or other
  misc_feature (197)..(197): n is a, c, g, or t
  modified_base (212)..(212): a, c, t, g, unknown or other
  misc_feature (212)..(212): n is a, c, g, or t
  modified_base (236)..(236): a, c, t, g, unknown or other
  misc_feature (236)..(236): n is a, c, g, or t
tcagatagagtactcacgaccggtgctcgatttagctgcgtcacgagctctctcggaatatctccaccatggcctgggctctgctcctcctcaccctcctcactcaggcacaggatcctgggctcagtctgccctgactcagcctcctccgtgtccggtctcctggacagtcagtcaccgtctctgcagtcgaaccngcagtgacgttggtntcttataccgtgtctcgtgtaccngcaccgcccagcaccacgaccccaactcatgtattttcgacgtctaagttactccggtcccgtcggacgggtcctagtactcctcttacttcgtcggtacctacgtcgtcgactacgtccgaccggtccttaccgtgtaactttctacgtcgtcggacctccgtacgtacgtacggacggtaacggacgtactaaggttaacttagtttacgacgtaccgtacttacctacgtaaattaaccgtaaaccgggtaaacgggtaccctaaaaccgtttccgtttaagttaccggttttaccgtaaccgggttaaaccgttacggggtaaaaccccgtaaacgtttaacccggttaccccgttaacccggttaacggtaccccgtaaaccgggtaaccccggaaacccggttacccccctaaaccccggttaccgtttaacccgtaccccggtttacccggtttacccttttaccccccgggtcccccggtttaccccttaaccccggttaccggttaacctttaaccccgg

SEQ ID NO: 571 - DNA, 786 bp, Homo sapiens
  misc_feature: GYAE6OF02FN2DT.29.36.D03.1.454.CMB.1.raw
  modified_base (213)..(213): a, c, t, g, unknown or other
  misc_feature (213)..(213): n is a, c, g, or t
tcagatagagtactcacgaccggtgctcgatttagctgcgtcacgatctctcttggggatctcaggaggcagctctctcggaatatctccacatggcctgggctctgcctcctcctcaccctcctcactcgaaggcacgaggactccgtgggctcgagtctcgccctgacctcgacgtccctcccgtccgttcggttccggtctcgtacgacncgtcgagtcctaccgttcctccgttcgacgtacggtacggaaccgagcgtacggtggtaccggttttggggtcttaccgtttaacgttaaccggttacggtttccctacccggttggtaaccccgtagaacccgtcccggtaccccccgaagcccgaaaccgaccccgtaaccccccgaaactcgtaacctttaaggttttaacgttttacgaaccgggtttaacaacggttaaccggttccccggtacccgtccggtacccgggttctacgtacttcggtctttccggccggtttaccgggtactacgggttcgtcggcccgtacgcccgacccgttacccgtccgtttactacggtttccgtcgttccggtcggttaccctacggacgtacgacgggacggtacgtacggtagttacttaagttaccttagttccgattccgaagtaccgtagttaaccgaaccggaagttacaacgttacctaggtaccgttccgtaagggacctaacgggtacctaactcggtaccgtttaccgcgaccggaccctaaccggaccctacccacggttcc

SEQ ID NO: 572 - DNA, 859 bp, Homo sapiens
  misc_feature: GYAE6OF02H8CJV.29.36.D03.1.454.CMB.1.raw
  modified_base (47)..(47): a, c, t, g, unknown or other
  misc_feature (47)..(47): n is a, c, g, or t
  modified_base (796)..(796): a, c, t, g, unknown or other
  misc_feature (796)..(796): n is a, c, g, or t
tcagatagagtactcacgaccggtgctcgatttagctgcgtcacganctctctcggaatatctccaccatggcctgggctctgcctcctcctcacccctcctcactcgacgggcacgaggactccgtgggctacagtcctcgccctgacctcacgtccctcccgtccgtcggtcccgggtctccgtggaccagtcagtccaccgtctcctgcgtaggtacggaaccagctaggtcgtacggttcggtgtacttaacgtaaccggtcgttcctaccgttacggaccagaccaccgcccccgaaggaccaaccgacccgaaacccctaactcgtaattgttaacttttcggaacgtacaacgttaacgtcccggtaccctacggtaccgggttcctagtaccgtccgttcgttccgttacggtaccgggtaccctaaggtcgtacggaccgtacgccgtacccgtccgtacgtaactacgttcgtacccggtagttcggggtccctaaggtacgacggttaggggaccggtacggtacggttaacgtaaacgttaagttaccgtttacgacggttaccgtacgtaaccgttaaccgtaaacgttaaaccgaaaccgggtaaccgttaaacctaaccgttaaccgtttaaggttcccggtttaaccggttaaccgggaaaccgggtttacccgggaaaactttacccggtaaacccggttcccggtaacggttaacccggtcccggtaacccaaccccggtaaccgtaacccccgtaaccttaggttacccgtttaccncccggtttaccgttaccccccggaccgtttaccccttaccggtacccggtttacttaacccgg

SEQ ID NO: 573 - DNA, 694 bp, Homo sapiens
  misc_feature: GYAE6OF02GGAM6.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctcctcactcagggcacgaggactccgtgggctcagtctcgccctgactcacgtccctcccgtccgtcggtcccggtactccgtggactagtctacgtaccaccgtcctccgtgactaggtacgaaccagacgtaggtggtacggttggcgtacttaacgtacgtcgtcctccgtacggtaccagccaccggccccgagaccaccgacccgaaccccctaagtcagttgttaacttttcggacgtactaacggttacgtcccggtacctacgggacgggttccctgtaccgttccgtttctttcgcgtacccttaacggtaacgttcgtacgaccaaccggaccgtccctacccgagttacccgtcgtcgacggtcctacgcggtcgtacgacgtacgtgacggttactcgttacttaactccgtacttccgttcctaagtacgtacgacggacgaacgtaacctaaacgttacgtacgtttacgtaccggttgggaccggttaccggaacgttaacgtccggtaccgtaccgacgtaccgtcgtaaccgtcgtaccggtacgtcgtaccccgg

SEQ ID NO: 574 - DNA, 989 bp, Homo sapiens
  misc_feature: GYAE6OF02GG4SK.29.36.D03.1.454.CMB.1.raw
  modified_base (212)..(212): a, c, t, g, unknown or other
  misc_feature (212)..(212): n is a, c, g, or t
tcagatagagtactcacgaccggtgctcgatttagctgcgtcacgatctctcttggggatctcaggaggcagctctctcggaatatctccaccatggcctgggctctgctcctcctccacctcctcactcgagggcacgaggactccgtgggctcgtacgtctcgaccgtgactcgacgtccctccgtcgtcggtccggtctccgtaggacngtcgacgtacctaccgtccgtcctcgcgtacggtacgaaccgtagcgtaggtacggttacggttggtacgttacgtttaaccgttaccggttcgttaccgttaccggttacggtaccgacgtacccgacccgacccccggacggacccaaccggaaccccgtaaccccctaaataccgtaacgtttcggtttaacgttttacggaaccgttacgtaacgttaaccgtcccgggttaccgtaccgggtaccgggttaccctacggtaccgttccggtttccttaccgggtccggtttaccgggttaccgtacgggttaccggtacggtaccggtaccggtacccggttaccccgtacccgtttacggtacgtttaacccgttttcggtacccggttcgggttacccggtacccgttaaccggtaacgggttaaccgggtaccgggttaaaacggggaccgggtttaaccggtaacggtttaacggtttaaacgttttacgtttccggtaccggtacccgggttaataccgtttaaaccgttaaacgttaaaccggttaaacgggaaaccggttaaaccttaaaccgggtttactttacccgggttttttaacggtccccggggtttaaaaccgggttaaccgggtaaacccggggttaaaccgtttaaccccgggtacccgggttttaaacccgtacccgggttttaaacggaccccgggttaaacccggaacccccgggttaaccccgggttaacccctaaccctttaaccccgggg

SEQ ID NO: 575 - DNA, 766 bp, Homo sapiens
  misc_feature: GYAE6OF02GHNOL.29.36.D03.1.454.CMB.1.raw
tcagatagagtactcacgaccggtgctcgatttagctgcgtcacgatctctctcggaatatctccaccatggccgtgggctctgctcctcctcaccctcctcactcgagggcacgaggactccgtggggctcaggttctcgtccctgacctcgacgcccttcccgtccggtggtccgggtcctccgtggacagtcagtccgaccgttctcctagtacgtaggtaccggaacccaggccgaaggttggtacggtttgggtctaccgtttaaactacgtcgttccgttccgtcggtaaccagccaccggaccccgacggacgaccgaccgaccccctaactcattggttattttacggtaccgtacgaaggttaccgtaccccggtcccgtaaccgggtccgggttaccgtgtaccgttcccggttctttccgtcgggttaccggtaccggtaagttccggacggtaccgtacggacccggtaacccgggtcccctttccgttaacgtacgttacttcccggtcggtaccggtcctaacggtaacgtcggttacggaacgggtaccggtacggtacgttagttaaacgttagttacgtacggtaccaccgtctaacgtaagtaacgtaacggaacggtaactacgtacttacgttcgtaccgtacgaccgtagaaccgtactacgtcgtacgtacgaccgaccgaccgtaaccgaccctacctacctcgtacctaccgtcgtacccttccaccgttcttaccgagtcc

SEQ ID NO: 576 - DNA, 802 bp, Homo sapiens
  misc_feature: GYAE6OF02IF3PA.29.36.D03.1.454.CMB.1.raw
tcagatagagtactcacgaccggtgctcgatttagctgcgtcacgatctctcttggggatctcaggaggcagctctctcggaatatctccaccatggcctgggctctgctcctcctcaccctctcactcagggacacaggactccgtgggcctcaggtctacggccctgactcacgtccctcctcgtggtcccggtctccgtagacagtcacgtcctaccggtcttccgtagacgaggtacggaacctagacgtaggtggtacggttcggtcgtacttaacgttaaccggtcgttccgttccgtacggtaccgacgtccgaccgtacccccgacggtaccaacccgacccggaacccccctaaacttaccgacgttacggttttacgttttcgtacggttaccgttaacggtaaccgttcccggaccccgttccgggtaaccggggttccgtacgttaccgtacgttccgttccgttccgttacggttaaccgacgttcggtacggcgacggccgtacccggccttacccgtgttaacttcgttccgtcgggttccggtccttacgacgtacggtacgggtaaacgggtacggtacggttacaacggttaaattcggtttaacacggtacgttaccgttaccgttactaacgttaacgtaaacgggtaacggtaaacctaaccgtaaccttagtaccgttaccggttaacggtaaccggtaccggaaacggttaaccgtaccggtacccgttaccggttacgtaaccgaccggtaaccccgaccgtaccccgtaacctaccg

SEQ ID NO: 577 - DNA, 523 bp, Homo sapiens
  misc_feature: GYAE6OF01BHFV8.36.27.C05.1.454.CMB.1.raw
  modified_base (198)..(198): a, c, t, g, unknown or other
  misc_feature (198)..(198): n is a, c, g, or t
  modified_base (298)..(298): a, c, t, g, unknown or other
  misc_feature (298)..(298): n is a, c, g, or t
  modified_base (510)..(510): a, c, t, g, unknown or other
  misc_feature (510)..(510): n is a, c, g, or t
  modified_base (514)..(514): a, c, t, g, unknown or other
  misc_feature (514)..(514): n is a, c, g, or t
tcagtacgctgtctcacgaccggtgctcgatttagacgcgatcgaagggtttggggagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgtgagcagcagctacttagcctggtaccagcagaaacctggccaggctccaggctcctcatctatggtncatcccgagggacgggccacgtggcactcccagacaggttcagtggcaggtgggtctgggacagtacttcactctcacctatcagcagactggacgcctagaacgtatttgctagtgtattactgtcagctagtagtggtacgtccgtttcgggcggtacgggaccgagggtgagtatacgaaacggtacgtgtggcgtgcacatctacgtnttcnttcctcccg

SEQ ID NO: 578 - DNA, 528 bp, Homo sapiens
  misc_feature: GYAE6OF01AK1OK.36.27.C05.1.454.CMB.1.raw
  modified_base (199)..(199): a, c, t, g, unknown or other
  misc_feature (199)..(199): n is a, c, g, or t
  modified_base (515)..(515): a, c, t, g, unknown or other
  misc_feature (515)..(515): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccaggggaaanagccaccctctcctgcagggccagtcagagtgtgagcagcagctacttagcctggtaccagcagaaacctggccaggctcccaggctcctcatctatggtgcatccaggagggccactggcatcccagacaggttcagtggcagtgggtctgggacagacttcactctcaccatcagcagactggacgcctgaagtatttgctagtgtattactgtcagcagtagtggtacgtcccgtttcgggacggtacgggaccgtaagggtggagtagtacgaaacggtaacgtcggtaggcgtgccacattctgttcttcncttccgttccccg

SEQ ID NO: 579 - DNA, 519 bp, Homo sapiens
  misc_feature: GYAE6OF01CVQ5K.36.27.C05.1.454.CMB.1.raw
tcagtacgctgtctcacgaccggtgctcgatttagacgcgatcgaagggtttgggctcaactctcctatcctacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccgagggaaggggctgggagtgggtctcgatccattagtagtagtagtagttacatatactacgcagactcagtgaaggccgattcacatctcagagacaacgccaagaactcactgtatctgacaatgaacagcctgagagccgaggacacggctgtgtattacgtgtgcgggatgcgtatagttttgacttggttacttcctaacttactactacattagtggtacgttcggg

SEQ ID NO: 580 - DNA, 573 bp, Homo sapiens
  misc_feature: GYAE6OF01DC2BX.36.27.C05.1.454.CMB.1.raw
  modified_base (196)..(196): a, c, t, g, unknown or other
  misc_feature (196)..(196): n is a, c, g, or t
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcacctgtctttgctcaggggaaangccaccctctcctgcagggccagtcagagtgtgagcagcagctattagcctggaccagcaagaacctggccaggctccaggctccncatctatggtgcatcccaacgagggccagtggtactcccgaggccggttanaggtggcgaggtcggggtctgggactaggtacgttcacgctcaaccatcagcaagcctgacagagtagaagtatttcgcttagttttattagttgtcagctaagttaataataacgttggacccgttccggtctacgtttcgggacgggacgggtacctaagggtggaacgtagtaacgaaaaccggtacttgggtcggccttagacccgtaacttacgttcttacggtcttcgtacccg

SEQ ID NO: 581 - DNA, 661 bp, Homo sapiens
  misc_feature: GYAE6OF01C79T7.36.27.C05.1.454.CMB.1.raw
  modified_base (576)..(576): a, c, t, g, unknown or other
  misc_feature (576)..(576): n is a, c, g, or t
tcagtacgctgtctcacgaccggtgctcgatttagacgcgatcgaagggtttgggctcaactcctcctatccacttggtgatctagcactgagcaccgaggattcaccatggaactgggctccgctgggtttcttgtgctatttagaaggttgtccagtgtgtaggtgcagctggtggagtcgtgggggaggccgtggtcgaaggccggtgggggtccctgagacgtcgtccgtgtgcagtcctcgtaggacttcgaccttcagtacgcttatacgtacagtcgaacgtcgggtccgccgtaggctccggaggggaagggtcctgggagtcgggtctcgaagtccgtagttagtagtagttagttagttacaattacgtactagacgtagactcgtagtaggaacgggctacgttaccaacgacgtacctaccgaaacgacgaacctaaccgaacccaaaggaaacccttcaacgttacgtaactacctagaactaaagtcgaactacgactaggaacgacggaccgaaggaccgtacggtcgtaacgtagtaacgttcgttggtacggcggttanacggagttagttagtttacgagtttggtttaaccttccttaaactaccttaacgttaactacttacggtccggtacgtaccgggg

SEQ ID NO: 582 - DNA, 535 bp, Homo sapiens
  misc_feature: GYAE6OF01BPFWL.36.27.C05.1.454.CMB.1.raw
  modified_base (200)..(200): a, c, t, g, unknown or other
  misc_feature (200)..(200): n is a, c, g, or t
  modified_base (516)..(516): a, c, t, g, unknown or other
  misc_feature (516)..(516): n is a, c, g, or t
  modified_base (523)..(523): a, c, t, g, unknown or other
  misc_feature (523)..(523): n is a, c, g, or t
  modified_base (527)..(527): a, c, t, g, unknown or other
  misc_feature (527)..(527): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccgaggggaaangccaccctctcctgcagggccagtcagagtgtgagcagcagctacttagcctggtactagcagaaacctggccaggcctcccaggcctcctcatctatggtgcatccgaggacgggcccagtggacactccccaaggactaggttcaggtggcaggtcgggtctgggacagtacttcgactctacacctatcacgcacgacgtggagtcctagacgtatttgctagtagttacttagtgtctagtctagtagtggtacgtccgttcggcggacggacgaggtaggagtagtacgaaacgacgtgtagctgctacgntctcgtntctntcgtcccg

SEQ ID NO: 583 - DNA, 523 bp, Homo sapiens
  misc_feature: GYAE6OF01ELSWB.36.27.C05.1.454.CMB.1.raw
  modified_base (199)..(199): a, c, t, g, unknown or other
  misc_feature (199)..(199): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgtgagcagcagctacttagcctggtaccagcagaaacctggccaggctccaggctcctcatctatggtgcatccgaggacggccactggcatcccagacaggttcaggtggcagtgggtctgggacagacttcactctcaccatcagcagactggacgcctagaagtattttgactagtgtatttactgtcagtcagttatggtacgtccgttcggacggtacggaccgaaggtggagagtacgaaacgtacgtggtggctcgactacatctagttcttctacgtccttacccg

SEQ ID NO: 584 - DNA, 572 bp, Homo sapiens
  misc_feature: GYAE6OF01B90TE.36.27.C05.1.454.CMB.1.raw
  modified_base (431)..(431): a, c, t, g, unknown or other
  misc_feature (431)..(431): n is a, c, g, or t
  modified_base (486)..(486): a, c, t, g, unknown or other
  misc_feature (486)..(486): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggtttcttgttgctattttagaaggtgtccagtgtgaggtgcagctgggtggagtcgtgggggaggccgtggtcaaggccgtggggggtccctgagactctcctgtgcagcctctggattcaccttcagtagctatagcagtgaacgtgggtcccgccgaggcctccggaagggggaaggggtcgtaggggaggtgggtctacgatccaagtttagtagtagtagtagttacatatactacgcagactcagtgaacggcattcacatcacagacgacaacgacaaagactcactgtactctaganaatacgaacacgcctagagacgaccgaggaccagggctaggttagtagtttacgnggtgacgggtatggacgttaattgtttagagtttcggttacttacctaacttacgttaactactattacggtcggtacggtccggg

SEQ ID NO: 585 - DNA, 560 bp, Homo sapiens
  misc_feature: GYAE6OF01DSRWA.36.27.C05.1.454.CMB.1.raw
  modified_base (198)..(198): a, c, t, g, unknown or other
  misc_feature (198)..(198): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgctcaggggaaagngccaccctctcctgcagggccagtcagagtgtgagcagcagctacttagcctggaccagcagaacctggccaggcctccaggcctcctcatctatggtgcagtcccgaagggacgggccacgtggacactccccgaagactaggttcaggtggcgtaggtgggtctgggacaggtaccttcactccgtcaccatcagcacgacgtggacgtcctagaacgtatttgacgtagttgttattacgtgtcagctagtatggtacgtcccgttcgggcggacggacgtaggtggagagtacgaaacgtacgtcggtaggcgtcgacctaccgattcgttacgtcctttactcgttcccgtaccccg

SEQ ID NO: 586 - DNA, 563 bp, Homo sapiens
  misc_feature: GYAE6OF01B3Y7K.36.27.C05.1.454.CMB.1.raw
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccgagggaaggggctgggagtgggtctcatccattagtagtagtagtagttacatatactacgcagactcagtgaacgggcgattcaccatctccagacgacaacgccaaagaacctcaactgtatctagcaaatgaaacagcctagacgacgacccggaggaaccacgggcttggtacgttaatttacgtggtcggacgggattcggcgtaatttagttttgacctttggtttacttccctaacttaactaccttaacgacttagtgggtacgtccggg

SEQ ID NO: 587 - DNA, 512 bp, Homo sapiens
  misc_feature: GYAE6OF01ACZBH.36.27.C05.1.454.CMB.1.raw
  modified_base (502)..(502): a, c, t, g, unknown or other
  misc_feature (502)..(502): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccaggggagggctgggagtgggtctcatccattagtagtagtagtagttacatatactacgcagactcagtgaaggccgattcaccatctccagacgacaacgccaagaactcactgtatctgacaatgaacagcctgagagccgaggacacggctgtgtattacgtgtgcgggatgcgattagttttgacttggttacttcctattactactacattntggtcgtcgg

SEQ ID NO: 588 - DNA, 510 bp, Homo sapiens
  misc_feature: GYAE6OF01E00C2.36.27.C05.1.454.CMB.1.raw
  modified_base (460)..(460): a, c, t, g, unknown or other
  misc_feature (460)..(460): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctatttttagaaggtgtccagtgtgaggtgcagctggtggagtctggggggaggcctggtcaagcctggggggtccctgagactctcctgtgcagcctctggattcaccttcagtagctatagcatgaactggggtccgccaggctccaggggaaggggctggagtgggtctcatccattagtagtagtagtagttacatatactacgcagactcagtgaagggccgattcaccatctcagagacaacgccaagaactcactgtatctgacaaatgaacagcctgagagccgaggacacggctgtgtattactgtgcggntgcgattagtttgacttggttacttcctactactactacatatggctcgg

SEQ ID NO: 589 - DNA, 639 bp, Homo sapiens
  misc_feature: GYAE6OF01D6DO9.36.27.C05.1.454.CMB.1.raw
  modified_base (199)..(199): a, c, t, g, unknown or other
  misc_feature (199)..(199): n is a, c, g, or t
  modified_base (375)..(375): a, c, t, g, unknown or other
  misc_feature (375)..(375): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccgagggaaanagccaccctctcctgcagggccagtcagagtgtgagcagcagctacttagcctggtaccagcagaaacctggccaggcctccaggcctcctcatctatggtcgcatccgaggacggccacgtggcatcccgaagactacggttcagtggcagtggtctgggactgacttcgactcncacatcagcagacgtaggacgtaccgtagaaggttacgttttacggaccttaaggtttaccgttaagttttacccgttgttaccgtaagtaccgtaagttacgtttacgggttacgttccccgggtttacgggacgggtaacgggtaacccgtaaggggttcggaaacgtaacttaacggaaaaccgggtcgttagggtacggtcgttacggacctaacccgtagttccgttacgttacctttccgtactttcccgtacccccg

SEQ ID NO: 590 - DNA, 569 bp, Homo sapiens
  misc_feature: GYAE6OF01CFF2K.36.27.C05.1.454.CMB.1.raw
  modified_base (198)..(198): a, c, t, g, unknown or other
  misc_feature (198)..(198): n is a, c, g, or t
  modified_base (301)..(301): a, c, t, g, unknown or other
  misc_feature (301)..(301): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgctccaggggaaanagccaccctctcctgcagggccagtcagagtgtgagcagcagctacttagcctggtaccagcagaaacctggccaggcctcccaggcctcctcatctatggtncatccgaggacgggccacgtggcactcccagacaggttcagtcggcgaggtgggtcgtgggacaggtacttcactctccaccatcagcagactggacgcgtagtagtatttgacgtagttgttattactgtacagtactagtagtacgggtacgtcccgtttacgggacggacgggtaaccgagggtacggagtacgtaccgaaacgtacgtggtacggactcggacctaacgtacgtaccgttcgtacttcgtacgttccgtccccg

SEQ ID NO: 591 - DNA, 313 bp, Homo sapiens
  misc_feature: GYAE6OF01BYPE8.36.27.C05.1.454.CMB.1.raw
  modified_base (308)..(313): a, c, t, g, unknown or other
  misc_feature (308)..(313): n is a, c, g, or t
tcagtacgctgtctcacgaccggtgctcgatttagacgcgatcgaagggtttgggctcaactctcttgtccacctgtgtattactgtgcgggatgcgatattttgactggttattcctactactactacactatggacgtctggggccaagggaccgcggtcaccgtctcctcagcctccaccaagggcccatcggtcttcccctggcaccctcctccaagagcacctcgtgggggcacagcggccctgggctgcctggtcaaggctactccagacagcgtactgagcgggctggcaaggcgcatagnnnnnn

SEQ ID NO: 592 - DNA, 792 bp, Homo sapiens
  misc_feature: GYAE6OF01EFK8Z.36.27.C05.1.454.CMB.1.raw
  modified_base (199)..(199): a, c, t, g, unknown or other
  misc_feature (199)..(199): n is a, c, g, or t
  modified_base (305)..(305): a, c, t, g, unknown or other
  misc_feature (305)..(305): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctcgaggggaaangccaccctctcctgcgaggccagtcagagtgtgagcagcagtctacttagcctggaccagcaagaaacctggccaggcctccgaggcctcctcattctagtggtcncacgtccgagggacgggccacgtcggacctacgtaccccgaggtaccgtagggttaccgaaggttcggaccgtaaggggttcgggtcgtacggggaacctacggtaccttttaccgaaccgtttccgtaacccgaaacccgtacgttaccgaacgtaccgaacggtaccgttacggggtaaccgtacccgtttaagggtaaacggtttaggtttttacggaccgtttaaggtttacgtttaactttaccgttacggttaccgtaacggtacgttaaggtttaacggttacggggtttaacccggttccccgggttttacgggggaaccggggttaacggggtaacccggtaaagggggttacgggaaacgttaaacgttaaaccggaaaaccggttaacggtacgggttaccggtacggttaccggaccgtaacccgtacgtttccggttacgtttaccctttacgtaccgtttccccgttaccccg

SEQ ID NO: 593 - DNA, 658 bp, Homo sapiens
  misc_feature: GYAE6OF01ENPGA.36.27.C05.1.454.CMB.1.raw
  modified_base (282)..(282): a, c, t, g, unknown or other
  misc_feature (282)..(282): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctgggtggagtcgtggggggaggcctggtcaaggccgtggggggtccctggagactctcctgtgcagcctctggattcaccttcagtagctatagcatgaactgggtccncgaggctccgaggggaaggggctgggaggtgggtctcatccattaggtagtagtagtagttacatatactacgcagactcgaaggtaggaacgggcctagttaccaacctacttcctacccgaaggacgaaccgaaacgacccaaagtaacctacctaacgttagtaactctagaacctaaagtacgaaacacggtccgttaggaacgacggaccggaaggaccgaacgggtcttaggttacgttaatttccggtagggtcgggtacgggattcggtaccgttaattttaacgtttcggtaaacgtttcggtttaaccttcccttaaacctaccgtttaacctacgtaagttcgttacgggtaccggttaccgggg

SEQ ID NO: 594 - DNA, 721 bp, Homo sapiens
  misc_feature: GYAE6OF01CR2QI.36.27.C05.1.454.CMB.1.raw
  modified_base (199)..(199): a, c, t, g, unknown or other
  misc_feature (199)..(199): n is a, c, g, or t
  modified_base (293)..(293): a, c, t, g, unknown or other
  misc_feature (293)..(293): n is a, c, g, or t
  modified_base (305)..(305): a, c, t, g, unknown or other
  misc_feature (305)..(305): n is a, c, g, or t
tcagtacgctgtctcacgaccggtgctcgatttagacgcgatcgaagggtttgggggagctgctcagttaggacccagagggaaccatggaaaccccagcgcagcttctcttcctctgctactctggctcccagataccacggagaaattgtgttgacgcagtctccaggcaccctgtctttgtctccgaaggggaaanacgcccaccctctcctgcagggccagtcagagtgtgagcagcagctactagcctggacagcaagaacctggccaggcctccgaggtcctacctnactctagtggtncagtccgaggacggccagtcggcatcccaagcctaggttcgagttcgggactagggtcgggtactcggggactacggtaaccttccaactcctaccaacccgtaatccgaagaccgtaacgtacgtacgggtaacggtacccctaaggttaaagttaacgttttcggtaaccgtaaggtttagttaaactttaccgttaggttaaccgtaacggtaaccgttaaggtttaacggttacgggttaaccggttaccccgggtttttacggggaccggggttaacgggaaccggtaagggttacgggaaacgtacgtaaacgtaaaacggtaaccggttagggtacggtacgtacgtaccgtaacccgtaacgttccgttaacggttcctttaacctaaccgtttcccgttaaccccgg

SEQ ID NO: 595 - DNA, 676 bp, Homo sapiens
  misc_feature: GYAE6OF01BALPW.36.27.C05.1.454.CMB.1.raw
  modified_base (201)..(201): a, c, t, g, unknown or other
  misc_feature (201)..(201): n is a, c, g, or t
  modified_base (238)..(238): a, c, t, g, unknown or other
  misc_feature (238)..(238): n is a, c, g, or t
  modified_base (362)..(362): a, c, t, g, unknown or other
  misc_feature (362)..(362): n is a, c, g, or t
  modified_base (479)..(479): a, c, t, g, unknown or other
  misc_feature (479)..(479): n is a, c, g, or t
tcagtacgctgtctcacgaccggtgctcgatttagacgcgatcgaaggggtttgggggagctgctcagttaggacccagagggaaccatggaaaccccagcgcagcttctcttcctcctgctactctggctcccagataccaccggagaaattggtgttgacgcagtctccaggcaccctgtctttgctccgaggggaaangcccacctctctgcagggccagtcagagtgtgagacngctagctacttagccttggtaccagacgaacgaaacctcgggcctaacggcctacccgaggctccaatccacttcgtagttggtcgacctactcccgaccggagggccctacgtacggttaccncccgaacggttccctaaccgtttaggcggtacgagggttcgggtacgtacggggactaggtacgttacacttcgtacaacctatcgacgctacgtcctgcgtagtcgtagtaagttntttacgtagtttaagtttacttcgtacgtactaagtaactaacgtagtacgtacgttcgtccttcgttacgttcggtttaccgggacgggtaaccggtaacggtaaggtacgggtaacgtaaccgtaaacggtaaacgtacggttcgcggtaccgaacggtacccaaccgttacgttcgttccgtttccgttacccg

SEQ ID NO: 596 - DNA, 578 bp, Homo sapiens
  misc_feature: GYAE6OF01CAHHL.36.27.C05.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctntcctgcagggccagtcagagtgtgagcagcagctacttagcctggtaccagcaagaaacctggccaggctccaggctcctcatctatggtgcatccgagggacggccacgtggcatcccagacaggttcagtggcaggtgggtctgggacagacttcactctcaccatcagcagacgtgagcctagaagtatttgactagttagtatttactggttacagtactagtaattggttacgtccccgttttcgggacgggaagggaaccgtaagggtagggaagtaacgtacgaaaaacggtaacgtacggtaggccgttggacctaccgtaattccgttagtttacctttacctacgttcccgttacccccg

SEQ ID NO: 597 - DNA, 674 bp, Homo sapiens
  misc_feature: GYAE6OF01D0BIG.36.27.C05.1.454.CMB.1.raw
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagcctctggattcaccttcagtagctatagcatgaactgggtccgccgaggcctaccgaggggaggggtcgtgggaggtgggtcctcatcctagttaggtagtagtagtaagttacataatactacgcagactcgagtggaaggaccgattacacctatctaccaagagaaccaacgacccaaagaacctctaacttgtactcgtagaacaaagtcgaaaccagaccgtaggaacggaacgaccgggaacgggtaaccgacgggtcccgttagttggttaaacttacgttggtcggggacgggtactagggtaccgttaagttttagtttttacggtaaccgttttagggtttaaacccttttacccgttaactttaaacccgtttaaaccttaaaccgttaccgtttaacggttccgggttaaacccggttacccggggg

SEQ ID NO: 598 - DNA, 745 bp, Homo sapiens
  misc_feature: GYAE6OF01CD79I.36.27.C05.1.454.CMB.1.raw
  modified_base (332)..(332): a, c, t, g, unknown or other
  misc_feature (332)..(332): n is a, c, g, or t
tcagtacgctgtctcacgaccggtgctcgatttagacgcgatcgaagggtttgggggagctgctcagttaggacccagagggaaccatggaaaccccagcgcagcttctctcctcctgctactctggctccagataccacggagaaattgtgttgacgcagtctccaggcaccctgtctttgtctccgaaggggaagacgcccacccgtctcctgcgagggtccagtcagagtgtgagcgagccagtcctaacgttacgccgtacggtaccgagtaccaacgaaaccgtggaccgtaggccctccgacggcctcctctagtcttagcggtcncgtacgtacgacgggaggccgaacgtcggacaccgtacccgaagaccgtacggttacgaggtcggagtacgggtcgggtacgtacggggactacggtaccttacctaccgttaccacctacctaacgtacacgtacgaacgacggtcgacgtacgtagtaagttcgtttaggacgtaggttatacgtttacgtcgtacggtagtaccgtaaggttcgtaacgggttaccggttaccccgggttacgggtacggggtaaaccgggtaaccggtaacggggtaacggaaacggtaacctaaaccgggtaaaaaccgtgggttaacggaccggttacgtaccgggaaccccttaaccgttaccgtttacgttacggtttacccctttaaccgtcccgttttaacccccgtccccgg

SEQ ID NO: 599 - DNA, 780 bp, Homo sapiens
  misc_feature: GYAE6OF01D9WL9.36.27.C05.1.454.CMB.1.raw
  modified_base (278)..(278): a, c, t, g, unknown or other
  misc_feature (278)..(278): n is a, c, g, or t
  modified_base (342)..(342): a, c, t, g, unknown or other
  misc_feature (342)..(342): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtgcagcctctggattccaccttcagtagctatagcatgaacgtgggtccncgaggctccgaggggaggcgtggagtgggtcactagtcctattagtagtagtaggttaagtacnttaacgtactacactaagactacgtaggtaggaaccgggtcctaacgtacctaaacctagttcccgaacgaaacggaacgaaacccgaaccggaacccgaaaacgtaacctaccgtaactttaacgttaacctccgtcggaaaacccttaaaggacgtaaaaccgaccgttcgaacggaacgggaacccgggacgggtaaaccggaaccggtacccgggtagtttcgggtttaaattaaccgtttaacgggttgggtaaccgggtaggggttacttacggggttaaactttaacgtttttaagggtttttaaccggtaagggttttttaacccgggtttacccttttaaccccgttaaacccggttttaaaccctaaccgtaaacccctttaaggttaacccgggttaccgggggttaccctttaaacccgggggggg

SEQ ID NO: 600 - DNA, 695 bp, Homo sapiens
  misc_feature: GYAE6OF01EZY5C.36.27.C05.1.454.CMB.1.raw
  modified_base (253)..(253): a, c, t, g, unknown or other
  misc_feature (253)..(253): n is a, c, g, or t
  modified_base (588)..(588): a, c, t, g, unknown or other
  misc_feature (588)..(588): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctatttagaaggtgtccagtgtgaggtgcagctggtggagtcgtgggggaggctggtcaagccgtgggggtccctggagactctcctgtgcagcctcgtggacttctacccgnttcgacgtagctactacgtcgacgtcggaccgtcggtccggccgacggacggtacggaggtaggggcgtgggtcgtcggtactcactactagttagtagtagttacgtagtactatactactacgacacgacgtcgtaggtacggacggtcgtactacctactactaccgacgacgaaccgaaccgaaccgaaccgtaaccgtactacgacttacgtacgtctagccaaagtacgaaaccacgaccgtaggacggaacggacccggaacggggaacccgtaaccggggtaccgttacggttacggttaacgtttaaccggttacgggttacgggntaccgggggtaagttacgggttaccggttaacgtttaacgtttttacggttaaccgtttacgggttttaaccgtttacccgtttaacccgttaaacccgttaacccg

SEQ ID NO: 601 - DNA, 624 bp, Homo sapiens
  misc_feature: GYAE6OF01AOJSY.36.27.C05.1.454.CMB.1.raw
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctatttagaaggtgtccagtgtgaggtgcagctggtggagtcgtgggggaggcctggtcaagccgtgggggtccctgagactctcctgtgcagcctctggattccacctttcagtagctatagcatacgaacgtcgggtcccgccaggcctaccggaaggggaacggggtcgtgggaggttcgggtctcgtactcccgtaagttaacggtaggttagtagttagttaactagttataacgtacgctagtactcgagtaggaacgggtcctattaccaccgtatcctccgaagacgaacaacgaccaaagtacctactatcgtatctacgactaaagtacgaacacgtcagaacgacggccgaacggaccgtaacggtcgttaggttacgtagtttacggtggacgggtacgggtatcgacgttagttagttttcgagtttgttacctttcctaacgttactacgtactatagtcggcgttcggg

SEQ ID NO: 602 - DNA, 322 bp, Homo sapiens
  misc_feature: GYAE6OF01A85FM.36.27.C05.1.454.CMB.1.raw
  modified_base (314)..(322): a, c, t, g, unknown or other
  misc_feature (314)..(322): n is a, c, g, or t
tcagtacgctgtctcacgaccggtgctcgatttagacgcgatcgaagggtttgggctcaactctcttgtccacctgtgtattactgtgcgggatgcgatattttgactggttattcctactactactacactatggacgtctggggccaagggaccgcggtcaccgtctcctcagcctccaccaagggcccatcggtcttccccctggcaccctcctccaagagcacctcgtgggggcacgagccggccctgggctgcctggtcaaggactacttcagaccagcgtactgagcgggactggcaaggcgcatagnnnnnnnnn

SEQ ID NO: 603 - DNA, 765 bp, Homo sapiens
  misc_feature: GYAE6OF01DIY8I.36.27.C05.1.454.CMB.1.raw
  modified_base (329)..(329): a, c, t, g, unknown or other
  misc_feature (329)..(329): n is a, c, g, or t
  modified_base (406)..(406): a, c, t, g, unknown or other
  misc_feature (406)..(406): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctggtttctgttgctatttagaggtgtccagtgtgaggtgcagcgtggtggagtcggtgggggagcctggtacgaaggtccggtcggggggtccctggacgtacctcttccgttggtcgacgacggtcccttacggtacggtaactttccctaaccgtttacgaaggttacgacttatacggactagtacgtaacgtcgggtaccnccgaggccgtacggaggggaacgggtctgggaggtcggtctacactcgtaagttaggtagtagtaagttacgttaanactactacgtaacgacgtagactacgaaggtacgggaaacggccgtaacttacaacctcgtacacgaagaacgacctaaccgacgtaaagacctacgactttagtaacctcgtaaacgaaccgtaaagtcggtaaaccgaaccggtaccgttaaggaacgggaaccggtaaccgggaacggtacccgggtaaccggttcgtttaagggttagtttaaccggtttaccggtttgggaacggggtacgggttagtaccggtaggtttaaatttacgttttacgtacggttttacggtttaaccttacccgttaaaccttacgtaaacttaacgtaacgttaggtcggtacggttaccgggg

SEQ ID NO: 604 - DNA, 897 bp, Homo sapiens
  misc_feature: GYAE6OF01CQTKS.36.27.C05.1.454.CMB.1.raw
tcagtacgctgtctcacgaccggtgctcgatttagacgcgatcgaagggtttgggctcaactctcctatccacttggtgatcagcactgagcaccgaggattcaccatggaactggggctccgctggttttccttgttgctatttagaaggtgtccagtgtgaggtgcagctggtggagtcgtggggggagccgtggtcaacggccgtcgggggggtccctggacgtacttccgtcctggtcgccagcccttcgtggtattcctaccttcgagtacgctatacgcaagtagaacgtcgggtcccgccgacggccgtaccggaggggaacggggcgttaggggtacggttcgggtccttacgtaacttcccgtaagtttaacgggttaaggttaaaggttaagtttaaaggtttaacctaagtttaaacgttaccgttaaccggacgtaaaggtaccttacgggaacggttaacgggaaccggggtacccgtaacgtttacccaccccttaagttccccgttacccgaaaggaaccggaaccgtaaaaccccggacccgaaaagttaaccccttacctacgttaacggttacctaccggtaacggaaccgtaaaagttaaccgaaaaccggtaccggtacccgttaagggaaacggtaccgggaaccccgggaaaggggtaaccccgtaaccgggtacctttacggggtttactttaaccggtttaacggttggggtaccgggtaccggggtacgttagtaacccggtttaggtttttaacgtttttccggtaaacggtttttaggttttaacccctttaacccgttaaactttaaccccgttaaacctttaaccgtaagtttaaccgggtacggggttaacccgttaaccggggggg

SEQ ID NO: 605 - DNA, 697 bp, Homo sapiens
  misc_feature: GYAE6OF01C6X6L.36.27.C05.1.454.CMB.1.raw
  modified_base (255)..(255): a, c, t, g, unknown or other
  misc_feature (255)..(255): n is a, c, g, or t
  modified_base (602)..(602): a, c, t, g, unknown or other
  misc_feature (602)..(602): n is a, c, g, or t
  modified_base (640)..(640): a, c, t, g, unknown or other
  misc_feature (640)..(640): n is a, c, g, or t
tcagtacgctgtctcacgaccggtgctcgatttagacgcgatcgaagggtttgggctcaactctcctatccacttggtgatcagcactgagcaccgaggattcaccatggaactgggctccgctggtttcctgtgctatttagaagtgtccagtgtgaggtgcagctgggtggagtcgtgggggagcctgggtcaagccgtggggggtcctggagacctctccgtgtcgccagtcctgtggacttccgacctttnagtagctaagtagacagtaggaaccgttcgggtcccgccgacggtccgtaccggaagggggaacggggtccgtaggggacggttcggggtacctcgacttccgtaatttacggtagtaacgttaagtagtactaagtactactacgacacgactagacgtaggaacggtccacttaccaactataccgtaccgaaagtacgaaccgaacgaccgtaaaactaccgttacgaaccgttaggtaaccttacgacgtaaaactaaacgtcgaaaaccgtaggccctaagggaaacggttaccggacccggaaagggttccgacggtcttagggttacgttaacgttacgngggttaccgcgggttagcgtagtactttgtttaaccgnggtttatttaccgttcaaacgttaccttaacgtacaagttcggtagtccggtacggg

SEQ ID NO: 606 - DNA, 732 bp, Homo sapiens
  misc_feature: GYAE6OF01BMJBJ.36.27.C05.1.454.CMB.1.raw
  modified_base (144)..(144): a, c, t, g, unknown or other
  misc_feature (144)..(144): n is a, c, g, or t
  modified_base (199)..(199): a, c, t, g, unknown or other
  misc_feature (199)..(199): n is a, c, g, or t
  modified_base (237)..(237): a, c, t, g, unknown or other
  misc_feature (237)..(237): n is a, c, g, or t
tcagtacgctgtctcacgaccggtgctcgatttagacgcgatcgaagggtttgggggagctgctcagttaggaccagagggaaccatggaaaccccagcgcagcttctcttcctcctgctactctggctccagataccacgganaaattgtgttgacgcagtctccaggccaccctgtctttgtcctccgaggggaaangcccaccctctccgtgccagggccagtcagagtgtgancagcagctacgtgcctaggacctagcaagaactggaccagcctccgaggcctcctacattcctagtggtcgacactccgaaggtcggccacgtggccacgttcccaaggacctacggttaccgaggtacggtacgtacggttcgggacttacggggaactacggtaacctttcgaaccttccgtacccgtaactacgtaccgacgtacccgtacgtaccgtcgtacgtaacggtaccgtaaggtaacgttacgtttttacgggacttttaacggttttacgtttaaccgttacggttaaacccgaacgttaaaccggttaactaacggttaaccgtaccgttacccgggttacccttaccgttaacccgttaccggttaccgggacggggtaaacggaccggttaagggtacggtaacgtaacgtaaacccgtaacggtaaccgttaggtaacccggtacttaccggaccttaaccgcttacccgttgttacccg

SEQ ID NO: 607 - DNA, 648 bp, Homo sapiens
  misc_feature: GYAE6OF01AMS71.36.27.C05.1.454.CMB.1.raw
  modified_base (149)..(149): a, c, t, g, unknown or other
  misc_feature (149)..(149): n is a, c, g, or t
  modified_base (195)..(195): a, c, t, g, unknown or other
  misc_feature (195)..(195): n is a, c, g, or t
  modified_base (310)..(310): a, c, t, g, unknown or other
  misc_feature (310)..(310): n is a, c, g, or t
  modified_base (507)..(507): a, c, t, g, unknown or other
  misc_feature (507)..(507): n is a, c, g, or t
  modified_base (573)..(573): a, c, t, g, unknown or other
  misc_feature (573)..(573): n is a, c, g, or t
  modified_base (606)..(606): a, c, t, g, unknown or other
  misc_feature (606)..(606): n is a, c, g, or t
  modified_base (614)..(614): a, c, t, g, unknown or other
  misc_feature (614)..(614): n is a, c, g, or t
tcagtacgctgtctcacgaccggtgctcgatttagacgcgatcgaagggtttgggggagctgctcagttaggacccaggagggaaccatggaaaccccagccgcagcttctcttcctcctgctactctggctcccagataccaccgganaattgtgttgacgcagtctccaggcaccctgtcttgctcagggaanagccacctctcctgcagggcctagtcagagtgtgagcagcagctacttacgccgtggtaccagacaagaacctggccagggccctcccgaggtccctcctctatcgtagtcggtnctacgtccggaagggaccgggccacggtcggactaccgtacccagtaccgtagggttccaaggttcgacgtagggttggggttccggacgggactaacgtcctttccacgttccacgacctacgtcaacgtccgaaggaccgtagggactaccgttaaggtaagtttgtttacggcttaggtttagtactttacggngtacgacgtcgtaacggttaagtccggtaccgttaccggttcgggacgggtaccgtacggtagggngaacgtacgtaaaccgaaggtagtcggaggtcncggacccngtattccgttacttaccgtctacgttccctaccg

SEQ ID NO: 608 - DNA, 845 bp, Homo sapiens
  misc_feature: GYAE6OF01C40ZO.36.27.C05.1.454.CMB.1.raw
  modified_base (157)..(157): a, c, t, g, unknown or other
  misc_feature (157)..(157): n is a, c, g, or t
  modified_base (180)..(180): a, c, t, g, unknown or other
  misc_feature (180)..(180): n is a, c, g, or t
  modified_base (251)..(251): a, c, t, g, unknown or other
  misc_feature (251)..(251): n is a, c, g, or t
  modified_base (621)..(621): a, c, t, g, unknown or other
  misc_feature (621)..(621): n is a, c, g, or t
  modified_base (650)..(650): a, c, t, g, unknown or other
  misc_feature (650)..(650): n is a, c, g, or t
  modified_base (719)..(719): a, c, t, g, unknown or other
  misc_feature (719)..(719): n is a, c, g, or t
tcagtacgctgtctcacgaccggtgctcgatttagacgcgatcgaagggtttgggctcaactctcctatccacttggtgatcagcactgagcaccgaggattcaccatggaacgtcggggcctccgcttgggttttccttgttgcttatttagagtntcagtgtgaggtgcagtcgtggnggacgtggtgggggacgtccgtggtcgaagtccggttcgggggtccctaggacgtcgtcctcgtgtcgacncgtcctcgtaggtcttaccgtaaccttcaacggttagtaccttaaagtacgtaccgtaaggtacggttaaaccggtccggggttaccccggaccgaaccgggtccgttaccggggaaagggggaaccgggggtggttacggggtacgggttacggggtcctactaacgttaccgtaagtttaaggtaaggttaacgtaagttaacgttaactaattaacgtacgaaccgacgtaaacgaccgtaagtaggtacgggaacgggtaacctactttacccgaccttaacgttccgtaacccgtaaaggaacccgtaaaacccggaaacccggttaaccaaaaacggttaaaccctaaccgttaaacccggttntttaaaaccggtcgttaaacccggaaaanaaacccgtttaaaggaaaccctcgtaacggtacgacggaacgggaaccggtaacgggtgaaccggtttnttaacggttaacgttacgttacggtcggtacggtcgtaagtcgttaagttacgttagtttacgtacgtttacttacccttaactaaccgttactaaattaacagttcggtacggtacggtaccggg

SEQ ID NO: 609 - DNA, 314 bp, Homo sapiens
  misc_feature: GYAE6OF02HVKU1.36.27.C05.1.454.CMB.1.raw
  modified_base (310)..(314): a, c, t, g, unknown or other
  misc_feature (310)..(314): n is a, c, g, or t
tcagtacgctgtctcacgaccggtgctcgatttagacgcgatcgaagggtttgggctcaactctcttgtccacctgtgtattactgtgcgggatgcgatatttgactggttattcctactactactacactatggacgtctggggccaagggaccgcggtcaccgtctcctcagcctccaccaagggcccatcggtcttccccctggcaccctcctccaagagcacctctgggggcacagcggccctgggctgccctggtcaaggactacttccagacagcgtactgagcgggctggcaaggcgcatagnnnnn

SEQ ID NO: 610 - DNA, 509 bp, Homo sapiens
  misc_feature: GYAE6OF02JGL2N.36.27.C05.1.454.CMB.1.raw
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaagggctggagtgggtctcatccattagtagtagtagtagttacatatactacgcagactcagtgaagggccgattcaccatctccagagacaacgccaagaactcactgtatctgacaaatgaacagcctgagagccgaggacacggctgtgtattactgtgcgggatgcgatagttttgacttggttattcctactactactacactatggacgtcgg

SEQ ID NO: 611 - DNA, 613 bp, Homo sapiens
  misc_feature: GYAE6OF02F4YWM.36.27.C05.1.454.CMB.1.raw
  modified_base (116)..(118): a, c, t, g, unknown or other
  misc_feature (116)..(118): n is a, c, g, or t
  modified_base (120)..(121): a, c, t, g, unknown or other
  misc_feature (120)..(121): n is a, c, g, or t
  modified_base (123)..(123): a, c, t, g, unknown or other
  misc_feature (123)..(123): n is a, c, g, or t
  modified_base (125)..(125): a, c, t, g, unknown or other
  misc_feature (125)..(125): n is a, c, g, or t
  modified_base (139)..(139): a, c, t, g, unknown or other
  misc_feature (139)..(139): n is a, c, g, or t
  modified_base (142)..(142): a, c, t, g, unknown or other
  misc_feature (142)..(142): n is a, c, g, or t
  modified_base (146)..(147): a, c, t, g, unknown or other
  misc_feature (146)..(147): n is a, c, g, or t
  modified_base (150)..(151): a, c, t, g, unknown or other
  misc_feature (150)..(151): n is a, c, g, or t
  modified_base (153)..(153): a, c, t, g, unknown or other
  misc_feature (153)..(153): n is a, c, g, or t
  modified_base (164)..(164): a, c, t, g, unknown or other
  misc_feature (164)..(164): n is a, c, g, or t
  modified_base (175)..(175): a, c, t, g, unknown or other
  misc_feature (175)..(175): n is a, c, g, or t
  modified_base (192)..(192): a, c, t, g, unknown or other
  misc_feature (192)..(192): n is a, c, g, or t
  modified_base (197)..(198): a, c, t, g, unknown or other
  misc_feature (197)..(198): n is a, c, g, or t
  modified_base (235)..(235): a, c, t, g, unknown or other
  misc_feature (235)..(235): n is a, c, g, or t
  modified_base (245)..(245): a, c, t, g, unknown or other
  misc_feature (245)..(245): n is a, c, g, or t
tcagtacgctgtctcacgaccggtgctcgattttagacgcgatcgaaggttttggggcgtcaactctcttgtccacctgtgtattactgagccgggctggccaaggcgcacttagnnnanncncngctgctgactgtcngtnaccnnganncncacgtgctgcncgacgagctcncgtgcgagcacgttcgngtagnngcgtacgacactgtacgtcgtacgacgagtactagtnactagctcgngaaccgtttcgaaacgtttgggccgtttcgtcgtacgtcgtacgacgtacgtacgtacgcgtcgcgtcgacgtcgcgtcgtacgtacgtacgtacgtcgtacgtacgtacgtacgtacgtcgtacgtacgtcgtcgtacgtacgtacgtacgtacgtacgtacgtacgtacgtacgtacgtacgtacgtacgtacgtacgttacgtacgtacgtacgttacgtacgtacgtacgtacgtacgtacgtacgtacgtacgtacgtacgttacgttacgttacgtacgtacgtacgtacgtacgtacgtacgtacgtacgtacgtacgtacgtacgtacgtacgtacgtacgtacgtacgtacgtacgtcg

SEQ ID NO: 612 - DNA, 497 bp, Homo sapiens
  misc_feature: GYAE6OF02IXVRK.36.27.C05.1.454.CMB.1.raw
  modified_base (468)..(468): a, c, t, g, unknown or other
  misc_feature (468)..(468): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagagccaccctctcctgcagggccagtcagagtgtgagcagcagctactagcctggtaccagcagaaacctggccaggctcccaggctcctcatctatggtgcatccagggaggccacgtggcatcccagacaggtcagtgcagtggtctgggacagacttcactctcaccatcagcagactggagcctagaagtatttgctagttgtattactgtcagcagtatggtacgtccgttggcggaggaccgaggtggagatacgaacgagtgngctgacacgatcgtgtctctactctcccg

SEQ ID NO: 613 - DNA, 311 bp, Homo sapiens
  misc_feature: GYAE6OF02H4S6K.36.27.C05.1.454.CMB.1.raw
  modified_base (310)..(311): a, c, t, g, unknown or other
  misc_feature (310)..(311): n is a, c, g, or t
tcagtacgctgtctcacgaccggtgctcgatttagacgcgatcgaagggtttgggctcaactctcttgtccacctgtgtattactgtgcgggatgcgatattttgactggttattcctactactactacactatggacgtctggggccaagggaccgcggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnn

SEQ ID NO: 614 - DNA, 505 bp, Homo sapiens
  misc_feature: GYAE6OF02GR1OB.36.27.C05.1.454.CMB.1.raw
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccagggaagggctgggagtgggtctcatccattagtagtagtagtagttacatatactacgcagactcagtgaagggccgattcaaccatctccagagacaacgccaagaactcactgtatctgcaaatgaacagcctgagagccgaggacacggctgtgtattactgtgcgggatgctatatttgacttggttattcctactactactacactatggatcg

SEQ ID NO: 615 - DNA, 643 bp, Homo sapiens
  misc_feature: GYAE6OF02J1NIU.36.27.C05.1.454.CMB.1.raw
  modified_base (199)..(199): a, c, t, g, unknown or other
  misc_feature (199)..(199): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccaggggaaangccaccctctcctgcagggccagtcagagtgtgagcagcagctacttagcctggaccagcagaaacctggccaggctcccaggccttcctcatctatggtcgcatcccgagggacggggccctacgtggacctaactccccgaaggtaccagggtttccaaggtcgggacagggttcgggtacgtggggactaggacctttcgacttccgtccacctagtccacgcacggactagggacgtcgtagaacgttagtttacgcgtagttcgttattacttcgtcgagtccgtagttagtacggttacgtaccgtttccggggtacggtaacgggtaccggtaaagggttacgggagtacgttacgaaacgtacggtacgggtggtaccgtcggtaccgtaaccgtaggttcgttaccggttactaccgttacgttcccgttacccg

SEQ ID NO: 616 - DNA, 518 bp, Homo sapiens
  misc_feature: GYAE6OF02HFGG6.36.27.C05.1.454.CMB.1.raw
  modified_base (372)..(372): a, c, t, g, unknown or other
  misc_feature (372)..(372): n is a, c, g, or t
  modified_base (377)..(377): a, c, t, g, unknown or other
  misc_feature (377)..(377): n is a, c, g, or t
tcagtacgctgtctcacgaccggtgctcgatttagacgcgatcgaagggtttgggctcaactctcctatccacttggtgatctgcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgccaggctccaggggaaggggctgggagtgggtctcatccattagtagtagtagtagttacatatactacgcagactcagtgaaggcattcacatcncaganacaacgccaagaactcactgtatctgacaaagtgaaacagcctgagacgccgaggaccacggctgtgtattacgtggtgcggatgacgtattagtttgacttggttacttcctacttactactacactatacggatacggg

SEQ ID NO: 617 - DNA, 541 bp, Homo sapiens
  misc_feature: GYAE6OF02FNJTH.36.27.C05.1.454.CMB.1.raw
  modified_base (276)..(276): a, c, t, g, unknown or other
  misc_feature (276)..(276): n is a, c, g, or t
  modified_base (377)..(377): a, c, t, g, unknown or other
  misc_feature (377)..(377): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccnccaggctccgaggggaaggggctgggagtggggtctcgatccattagtagtagtagtagttacatatactacgcagactcagtgaaggccattcaccatcncagagacaacgacaagaactcactgtatctagacaaatgaaacagcctagagagccggaaggacacggctggtgttattactggtggcgggatggacgtatagttttggacttgggttattaccgttaactaccttactaactactacgtcggtacgttacggg

SEQ ID NO: 618 - DNA, 314 bp, Homo sapiens
  misc_feature: GYAE6OF02F9SRU.36.27.C05.1.454.CMB.1.raw
  modified_base (310)..(314): a, c, t, g, unknown or other
  misc_feature (310)..(314): n is a, c, g, or t
tcagtacgctgtctcacgaccggtgctcgatttagacgcgatcgaagggtttgggctcaactctcttgtccacctgtgtattactgtgcgggatgcgatattttgactggttattcctactactactacactatggacgtctggggccaagggaccgcggtcaccgtctcctcagcctccaccaagggcccatcggtcttccccctggcaccctcctccaagagcacctctgggggcacagcggccctgggctgcctggtcaaggactacttccagacagcgtactgagcgggctggcaaggcgcatagnnnnn

SEQ ID NO: 619 - DNA, 557 bp, Homo sapiens
  misc_feature: GYAE6OF02IZDSK.36.27.C05.1.454.CMB.1.raw
  modified_base (412)..(412): a, c, t, g, unknown or other
  misc_feature (412)..(412): n is a, c, g, or t
  modified_base (465)..(465): a, c, t, g, unknown or other
  misc_feature (465)..(465): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtcgtgggggaggcctggtcaagcctgggggtccctgagactctcctgtgcagcctctggattcaccttcagtagctatagcatgaactgggtccgccaggctccgaggggaagggctgggagtgggtctcatccattagtagtagtagttagttacatatactacgcagactcagtgaagggccgattcaacatctaccagagacaacgaccaaagaactcactgtatctnacaaatgaacagcctagagacgaccgaaggtaccacggctggtagtattacgnggtaggcgggtatggacgtattagttttcggactttagggttactttccctaagtttacctaccttaaccgtctaagttcgggacgttcggg

SEQ ID NO: 620 - DNA, 518 bp, Homo sapiens
  misc_feature: GYAE6OF02IOR0A.36.27.C05.1.454.CMB.1.raw
  modified_base (353)..(353): a, c, t, g, unknown or other
  misc_feature (353)..(353): n is a, c, g, or t
  modified_base (359)..(359): a, c, t, g, unknown or other
  misc_feature (359)..(359): n is a, c, g, or t
  modified_base (386)..(386): a, c, t, g, unknown or other
  misc_feature (386)..(386): n is a, c, g, or t
  modified_base (403)..(403): a, c, t, g, unknown or other
  misc_feature (403)..(403): n is a, c, g, or t
  modified_base (407)..(407): a, c, t, g, unknown or other
  misc_feature (407)..(407): n is a, c, g, or t
  modified_base (412)..(412): a, c, t, g, unknown or other
  misc_feature (412)..(412): n is a, c, g, or t
  modified_base (414)..(414): a, c, t, g, unknown or other
  misc_feature (414)..(414): n is a, c, g, or t
  modified_base (448)..(448): a, c, t, g, unknown or other
  misc_feature (448)..(448): n is a, c, g, or t
  modified_base (452)..(452): a, c, t, g, unknown or other
  misc_feature (452)..(452): n is a, c, g, or t
  modified_base (464)..(464): a, c, t, g, unknown or other
  misc_feature (464)..(464): n is a, c, g, or t
  modified_base (467)..(467): a, c, t, g, unknown or other
  misc_feature (467)..(467): n is a, c, g, or t
  modified_base (471)..(471): a, c, t, g, unknown or other
  misc_feature (471)..(471): n is a, c, g, or t
tcagtacgctgtctcacgaccggtgctcgatttagacgcgatcgaagggtttgggctcaactctcctatccacttggtgatctgcactgagcaccgaggattcaccatggaactggggctccgctgggttttcttgttgctattttagaggtgtccagtgtgaggtgcagctgggtggagtcgtgggggaggcctggtcaagccgtggggggtccctggagactctcctgtgcagcctctggattcaccttcagtagctatagcatgaactggggtccgccaggctccgagggaaggggctggggaggtggggtctcatccattagtagtagtagtagttacatatactacgnagactnagtggaaggcattcaccatcctcaganacaacgaccaaagactnactntatcnanaaatagaacagcctagacgagccggagacacggntgtntattatggtagnggntagngtatgtttgacttggttacttcctattactactacactatggatcgg

SEQ ID NO: 621 - DNA, 606 bp, Homo sapiens
  misc_feature: GYAE6OF02HPWUF.36.27.C05.1.454.CMB.1.raw
  modified_base (200)..(200): a, c, t, g, unknown or other
  misc_feature (200)..(200): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgtgagcagcagcttacttagcctaggtaccagcagaaacctggccaggctccaggctctcatctagtggtcgactagtccgagggacgggccagtcggacactcccaaggactaggttcagtggcagggtcgggtctagggacacgacttcacttctcaaccatacagactacgacgtggagtccgtagtaacgtagttttagacgtagttagtttattaacgttgtacaggtacgtagttagttacggtacgtcccgtttacgggacgggtaacgggtaacggtaaaggtaggtaagtactacgtaaacggtaacggtggtacggacgtcgtaaccgaccgtacttcgtacgttacttactacgttccttacccg

SEQ ID NO: 622 - DNA, 640 bp, Homo sapiens
  misc_feature: GYAE6OF02IJ7E1.36.27.C05.1.454.CMB.1.raw
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtcgtggggggaggcctggtcaagccgtgggggtccctgagactctcctgtgcagcctcgtggacttcaccttcagtagctatagcatgaacgtgggtccgccaggctccgaggggaggggctgggagtgggtctcgactcctattagtagtagtagtagttacatatactacgacagactcagtaggaacgggccgtattccaacctatccgtaccgaagacgaaccaaccggaccaaacggtaacctcacttagtactctagactaaagtcgaacctagccctaggacgaccggaccggaggacccgaggtcttggtagttactttacgtgggtacggaccgggtatacgggtacgttaagttttacgtttttagaccggttttggttttaaccgttacccttaaccgttaacctttaaccttaccgaagtttacggtaccgggtaaccgttccgggg

SEQ ID NO: 623 - DNA, 510 bp, Homo sapiens
  misc_feature: GYAE6OF02GWYDA.36.27.C05.1.454.CMB.1.raw
  modified_base (404)..(404): a, c, t, g, unknown or other
  misc_feature (404)..(404): n is a, c, g, or t
  modified_base (435)..(435): a, c, t, g, unknown or other
  misc_feature (435)..(435): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtctgggggaggcctgggtcaagcctggggggtccctgagactctcctgtgcagcctctggattcaccttcagtagctatagcatgaactgggtccgccaggctccagggaaggggctggagtgggtctcatccattagtagtagtagtagttacatatactacgcagactcagtgagggcgattcacatctccagagacaacgccaaagaactcactgtatcngacaaagtgaacagcctgagagccgaggacncggntgtntattacgtgtcgcgggatgcattatttgacttggtaattcctatactactacatagtggacgttcgg

SEQ ID NO: 624 - DNA, 614 bp, Homo sapiens
  misc_feature: GYAE6OF02GT8BD.36.27.C05.1.454.CMB.1.raw
  modified_base (315)..(315): a, c, t, g, unknown or other
  misc_feature (315)..(315): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtctgggggaggcctggtcaagccgtggggggtccctgagactctcctgtgcagcctctggattcacccttcagtagctatagcatgaactgggtccgccaggctccgaggggaaggggctgggagtggggtctnactccatttagtagtagttagtagttacatatactacgcagactcagtaggaacgggccgattcaccatcctcagagacaacgccaagaacctcacttgtatcgagacaaaagtcgaacacgacctgacgtaacggccggaaggaccgaccgggacgttggtagttaacttttaccgtggtacggacgggtaattcgggagtaattttaggtttttcggaacgtttagggttttaacttaccctttaacttaaccctttaacttaaccgttacctaggttacggacccggtttaccggg

SEQ ID NO: 625 - DNA, 614 bp, Homo sapiens
  misc_feature: GYAE6OF02IEFVO.36.27.C05.1.454.CMB.1.raw
  modified_base (199)..(199): a, c, t, g, unknown or other
  misc_feature (199)..(199): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaaattgtgttgacgcagtctccaggcaccctgtctttgtctccaggggaangccacctctcctgcagggccagtcagagtgtgagcagcagctacttagcctaggtaccagcaagaaacctggccaggcctccaggctctcatctagtggtgctatccgagggacgggccacgtcggcactcccgaagacgtaggttcaggtcggacgtaggtcgggtcgtagggacaggtacttcacctcgtaccaacgtatcagtcgacgcctgacaggagtagaacgtatttcgattaagttttattattgtactagtcgttaagtagttaaactacgttcggtaccgttccggtacttacgggttacgggacgggtaacgggtaaccgtaaggggtcgaagggtaactaaggtaaaaccggtacgtgtaccgggtactacggtaccaaccgttacgttaccgttcggttacc

SEQ ID NO: 626 - DNA, 1058 bp, Homo sapiens
  misc_feature: GYAE6OF02IWE81.36.27.C05.1.454.CMB.1.raw
  modified_base (200)..(200): a, c, t, g, unknown or other
  misc_feature (200)..(200): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctgctccagataccacggagaaattgtgttgacacagtctccagcccaccctgttctttgtcctccgaggggaaancgccaccctctcctgcgacggccagtcagtagttgttagcacgtcttacgttacggccttacgggtaacccaaacaacggtaaacccgtcgggacccgacggtccctaccccgaggtccttccctacctacttacgtaatcgaacttaacctactacccgtaaccggaccggggtaccaaccggttcgggaccctaaccgttacccccgaacggtaccccgtaacgggtttaccgtagggtacgggtacgtacgggggttcggggttaccggttacggggggtaacccgtacgggttaacccgttttaccgtaaccccgtttaccgttaacccgtaaacccctacggtttaacccgaaaccggtacccggtaaaccccgggtaccccgtttaaaaccgggttaaaccccggtaaacgggttaaaacgtttttacggtttttaccgggttaaacccggtttttaaacgttttttaaaccggtttaaacccgtttacccgggttaaccgttaaacggggtaccccgttaacggggtaaaccgggtaacgggggtttaaccccgggtttacccgggttttttaacccccgggggaccccgggttaaccggggggtaaaacccggttaaaaggggttaacggttaaaaccggttaaccgttaaacccgttaaaaacccgggttaaacggtttacgggttacccgggttaccgttaaccgggtaccccttaaacccggttaacccgtttacccggtttaaccggttttaaccccgtttacccgtttaaccgtttacccccccggtttaccccggttacccctttaacggtttacccggttaaaccggtaagttaacccccggg

SEQ ID NO: 627 - DNA, 637 bp, Homo sapiens
  misc_feature: GYAE6OF02GRI7S.36.27.C05.1.454.CMB.1.raw
  modified_base (199)..(199): a, c, t, g, unknown or other
  misc_feature (199)..(199): n is a, c, g, or t
  modified_base (208)..(208): a, c, t, g, unknown or other
  misc_feature (208)..(208): n is a, c, g, or t
  modified_base (597)..(597): a, c, t, g, unknown or other
  misc_feature (597)..(597): n is a, c, g, or t
tcagtacgctgtctcacgaccggtgctcgatttagacgcgatcgaagggtttgggggagcgtgctcagttaggacccagagggaaccatggaaaccccagcgcagcttctcttcctcctgctactctggctcccagataccaccggagaaattgtgttgacgcagtctccaggcaccctgtctttgctcgaggggaaancgccacctntcctgcagggccagtcagagtgtgagcagcacgtctacttagcctagggtaaccagacaacgaaaccgtcggaccaaggtcctcccgaggtcctcctacacttcgtaagtcggtcgactacgtccgagggaccggcctacggtggacctacgtaccgaaggtactaggttcaacggtggactagggtcgggttcgacgggtacagtaccttgtacctctaccgaacctatcgaacgtcaacggtacgtacgggacgtaccgttaggtaacgttagtttcgacttaggttacgttacttacgtagtcgagtcgaagttcgtacggtcgtccgttcgggacggaaggtaacgacggtagacgacgtacgaacggtacgtggacgtacgtanaccgtacgtacgtcttcgttctacggtacttccttacccg

SEQ ID NO: 628 - DNA, 725 bp, Homo sapiens
  misc_feature: GYAE6OF02IATPV.36.27.C05.1.454.CMB.1.raw
  modified_base (221)..(221): a, c, t, g, unknown or other
  misc_feature (221)..(221): n is a, c, g, or t
  modified_base (233)..(233): a, c, t, g, unknown or other
  misc_feature (233)..(233): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttcttgttgctattttagaaggtgtccagtgtgaggtgcagctgggtggagtcgtggggggaggcctggtcaagccgtggggggtccctgngactctcctgtncagcctcgtggacttctaccttcagtagctatagcatagaacgtcgggtccgcgaggctccgaggggaacgggctggggaggttgggtctcacgtacctagttaggtagtagtagtagttacatatacacgacagtactacgaggtaggaacgggcctagttcccaacctacttccctaccgaagtaaccgaacgaaacccgccaaaacggaacccttaccgtaaccttagttaaactcgttaaaggaacctaaaaattaccggaaaaccgtcggacccgtagggaaccggaacgggtacccgggaacgggtaccggtaacccgggtcgttggttaacgtttaactttaccggtggtacgggaccgggtatcggtacgttaagttttacgttttaggtaacccgttttgggttttaaacccttccctttaaacccgttacttaaccgttaaaccgtaaccgtttaggttacccggggtacgtttacccgggg

SEQ ID NO: 629 - DNA, 631 bp, Homo sapiens
  misc_feature: GYAE6OF02ILXFG.36.27.C05.1.454.CMB.1.raw
  modified_base (235)..(235): a, c, t, g, unknown or other
  misc_feature (235)..(235): n is a, c, g, or t
  modified_base (359)..(359): a, c, t, g, unknown or other
  misc_feature (359)..(359): n is a, c, g, or t
tcagtacgctgtctcacgaccggtgctcgatttagacgcgatcgaagggtttgggctcaactctcctatccacttggtgatcagcactgagcaccgaggattcaccatggaactgggctccgctggttttcttgttgctattttagaaggtgtccagtgtgaggtgcagctggtggagtcgtgggggaggccgtggtcaagccgtgggggtccctgagactctctgtgcagcctntaggacttcaccttcagtagctatagacatgaacgtgggtccgaccagggtcctaccggaggggaaggggccgtgggtaggtggtcgtcacgtcctaagttagtaagttaagtagttacgttanattaagtactaacgacacgtactcaaggtaggaacggcgattccaaccgtatctaccgagtacgacaacgtaccaaagaactctaactgtatctcgaactaaatacgaacgtactcgagaacgacgacggtaacggacaacggtctggtaattacgttactggttcggacggtatccgtagttacgttagttttacggaccgtttaggtttaccgttacccttaagtaaccctttacgtaacctacggttagtaccggttacgttaccgggg

SEQ ID NO: 630 - DNA, 711 bp, Homo sapiens
  misc_feature: GYAE6OF02HR0R6.36.27.C05.1.454.CMB.1.raw
  modified_base (201)..(201): a, c, t, g, unknown or other
  misc_feature (201)..(201): n is a, c, g, or t
  modified_base (309)..(309): a, c, t, g, unknown or other
  misc_feature (309)..(309): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctccagataccacggagaaattgtgttgacgcagtctccaggccaccctgttctttgtctccgaaggggaaancgccaccctctcctgcgagggccagtcagagtgtgagcagcagctacttagcctggtaccagcaagaacctggaccaggcctccgaggcctcctcattctagtggtanacctagtccggaagggaccgggccacgtcgggcctaacgtccccgaagtaccgtagggttcaaggtcggactagggttcggggtacgtaggggaacaacgggttccttacaaccgttccaccgtaacctacgtcgaacggaccgtaacggtaccgttacgggacggtaccgttaaggtaaagttacgttttacggacgttaggttacgtttaacgttacgttacgtactaggtacttaggttacggttacgggttaccgttccggtttacggggaccggtaacgggtaaccggtaaggtaacgggtacgtaacggtaccgtaaacggtacggtgggtaccggtacgtacgtacccgtacgtaccttcggttaccgttaccgtacttaccgttccctacccgg

SEQ ID NO: 631 - DNA, 837 bp, Homo sapiens
  misc_feature: GYAE6OF02JDKRL.36.27.C05.1.454.CMB.1.raw
  modified_base (145)..(145): a, c, t, g, unknown or other
  misc_feature (145)..(145): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctccagataccacgganaattgtgttgacgcagtctcaggcacctgtcttgctccagggaaagacgccacctctctgcgaggccagtcaggagtgtagagcagcagactacttacgccgtaggtaccagcaacgaaaccgtggaccacggacctccgaggtccctaccgtcaacgttcgtagttcggagtaccgacgttaccggaggggaaccggcccgtacgtccggaccctaaccgtaccggtaacggtacgtacgggttacgacggttaccgggacgtacgggttcgggttacggtacgggaaacctaaccgggtttaccttacgtaacccgttccgtaacccgtaacttaacggtacccgacgtaaccgtaaacgtccggttacgggaaaccgttcccggtaaagttaaaggttcgtttttcgaaacggttgttttaaccggtttacgtttaacggtcgtaacccggtaagttccggtaaacgttacgggttacggttaccctttacccggggtttacggggaccggggttaacggtaaacccggtaaggggttaaccggtaaacgaacggttaacccgggttaaaaaccgtcggggtttaacccgggtaagttccccggttaacgtaacccggtaaccggttacgtttaccgggtttaacccgttagttttaacccggtaccccgttaacccccggtttacccg

SEQ ID NO: 632 - DNA, 686 bp, Homo sapiens
  misc_feature: GYAE6OF02G3TEF.36.27.C05.1.454.CMB.1.raw
  modified_base (200)..(200): a, c, t, g, unknown or other
  misc_feature (200)..(200): n is a, c, g, or t
  modified_base (287)..(287): a, c, t, g, unknown or other
  misc_feature (287)..(287): n is a, c, g, or t
  modified_base (297)..(297): a, c, t, g, unknown or other
  misc_feature (297)..(297): n is a, c, g, or t
  modified_base (399)..(399): a, c, t, g, unknown or other
  misc_feature (399)..(399): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcaccctgtctttgtctccaggggaaagngccaccctctcctgcagggccagtcagagtgtgagcagcagctacttagcctggtaccagcagaacctggccaggctccagctcctnatctatggtncactccgagggacggccacgtggcactcccgaagtacctaggttcaaggtcggacgtagggtcgggtctaggggactacgtacttccaccttcgtccaaccnttacacgacaaggtaccgtgggaacgtcccgtaaggtaacgttacgttttacggaccgttaaggtttcgttaaattttaccgtacgttaccgaaggttacctaaggtttaacggttacgggttaccggtttccccggtttacggggaaccggggttaaccggggtaaccggtaacggggtacgggaacgtaaccgtaacgaaaaccgggttacgtagggttaccggtacgtaccggacccgtaaccgtagttccgttaggttacctacggttaccttcccgtacccg

SEQ ID NO: 633 - DNA, 553 bp, Homo sapiens
  misc_feature: GYAE6OF02IEIIY.36.27.C05.1.454.CMB.1.raw
  modified_base (279)..(279): a, c, t, g, unknown or other
  misc_feature (279)..(279): n is a, c, g, or t
  modified_base (383)..(383): a, c, t, g, unknown or other
  misc_feature (383)..(383): n is a, c, g, or t
  modified_base (392)..(392): a, c, t, g, unknown or other
  misc_feature (392)..(392): n is a, c, g, or t
  modified_base (417)..(417): a, c, t, g, unknown or other
  misc_feature (417)..(417): n is a, c, g, or t
  modified_base (457)..(457): a, c, t, g, unknown or other
  misc_feature (457)..(457): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtctgggggaggcctggtcaagcctggggggtccctggagactctcctgtgcagcctctggacttcacctttcagtagctatagcatgaactgggtccnccaggctccgagggagggctggagtgggtctcatccattagtagtagtagtagttacatatactacgcagatcagtgaagggcattcacatctcagacacaacnccaagactnactgtactctagacaaatcgaaacngcctagacgagaccgaggacacggtctagtcgtaattccnggtcggacgggatggacattttagtttcgacgttaggttactttacccgtaacgttaaccttaactaaccttacgtaagttcgggtaccgttcggg

SEQ ID NO: 634 - DNA, 677 bp, Homo sapiens
  misc_feature: GYAE6OF02HSLS9.36.27.C05.1.454.CMB.1.raw
  modified_base (160)..(160): a, c, t, g, unknown or other
  misc_feature (160)..(160): n is a, c, g, or t
  modified_base (192)..(192): a, c, t, g, unknown or other
  misc_feature (192)..(192): n is a, c, g, or t
  modified_base (529)..(529): a, c, t, g, unknown or other
  misc_feature (529)..(529): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctccagataccaccggagaattgtgttgacgnagtctccaggcacctgtcttgtctcagggaanacgccacctctctgcaggccagtcagagtgtgagcagcagtcttactagccgtaggtacagacgaagtaaaccgtggaccaggccctaccccgaaggtcccttccgtactacgttccttaagtcgggttcgaccgtacgtacccgaggggtacccgggtaccctacggttcgggacctaccgtaccccgaggtaaccgtacggttcaacggttgacgtacggtggtcgtacgggactaacggttcgttccgaaccttccgaccgaacgtgtacgacgcgtacgacgttggacgtcgtaacgtagttacgtttcgacgtagtagttactacgttcgtntagtacgtagttacgtacggttaccgtacccgggttcggacgggtacgaacggtaaggacgtaacgagtaccggaaacggtcgtaggtacggaccgagtacccgtacgtcgttacgtaccgttacctacgttacctcccgttacccgg

SEQ ID NO: 635 - DNA, 620 bp, Homo sapiens
  misc_feature: GYAE6OF02FI18L.36.27.C05.1.454.CMB.1.raw
  modified_base (199)..(199): a, c, t, g, unknown or other
  misc_feature (199)..(199): n is a, c, g, or t
  modified_base (232)..(232): a, c, t, g, unknown or other
  misc_feature (232)..(232): n is a, c, g, or t
  modified_base (307)..(307): a, c, t, g, unknown or other
  misc_feature (307)..(307): n is a, c, g, or t
  modified_base (393)..(393): a, c, t, g, unknown or other
  misc_feature (393)..(393): n is a, c, g, or t
  modified_base (433)..(433): a, c, t, g, unknown or other
  misc_feature (433)..(433): n is a, c, g, or t
tcagtacgctgtctcacgaccggtgctcgatttagacgcgatcgaagggtttgggggagctgctcagttaggacccagagggaaccatggaaaccccagcgcagcttctcttcctcctgctactctggctcccagataccaccggagaaattgtgttgacgcagtctccaggcacctgtctttgtctccgaggggaaanagccaccctctcctgcagggccagtcagagtgngagcagcagcttaacttagcctggtaccagcaagaaacctggccaggctccccgaggtcctcctcatctatggtncactccgaggacggccacgtgacactcccgagactaggttcaggtcggacgtaggtcgggtctagggactacggtacttcacctcncctacatcagcaagacgtggacgcctagaagttctttcgntaggttcttattacgtgtcaaggtctaagtagttcgggtaccgtcccgtttagggaccgggtaacgggaaccgtaagggtacggaacgtaagtaaccggaaacggtaccggtttggaccggttacgtaccgaaccgacgttacgttccggttaggttaccctttaccgtacgttccccgttaccccg

SEQ ID NO: 636 - DNA, 566 bp, Homo sapiens
  misc_feature: GYAE6OF02JIJEG.36.27.C05.1.454.CMB.1.raw
tcagtacgctgtctcacgaccggtgctcgatttagacgcgatcgaagggtttgggctcaactctcctatccacttggtgatcagcactgagcaccgaggattcaccatggaactggggctccgctgggtttccttgttgctattttagaaggtgtccagtgtgaggtgcagctggtggagtctgggggaggcctggtcaagcctggggggtccctgagactctcctgtgcagcctctggattcaccttcagtagctatagcatgaactgggtccgcaggctccgagggaagggctggagtggtctcactccattagtagtagtagtagttacataatactacgcagactcagtagaacggccgtattcaacctatcctcaggacacaacgaccaagaaacctcgactagttactactgactaaacgtacgaaactagacctaggtaagaccggccggaacgggacgaacggccttaggtagttaacgttactgtggacggagtgctagtgttttagacttaggttacttacccttataccttactacgtactgtaggtacgtcggg

SEQ ID NO: 637 - DNA, 686 bp, Homo sapiens
  misc_feature: GYAE6OF02HZ806.36.27.C05.1.454.CMB.1.raw
  modified_base (181)..(181): a, c, t, g, unknown or other
  misc_feature (181)..(181): n is a, c, g, or t
  modified_base (209)..(209): a, c, t, g, unknown or other
  misc_feature (209)..(209): n is a, c, g, or t
  modified_base (249)..(249): a, c, t, g, unknown or other
  misc_feature (249)..(249): n is a, c, g, or t
  modified_base (304)..(304): a, c, t, g, unknown or other
  misc_feature (304)..(304): n is a, c, g, or t
  modified_base (312)..(313): a, c, t, g, unknown or other
  misc_feature (312)..(313): n is a, c, g, or t
  modified_base (317)..(317): a, c, t, g, unknown or other
  misc_feature (317)..(317): n is a, c, g, or t
  modified_base (322)..(322): a, c, t, g, unknown or other
  misc_feature (322)..(322): n is a, c, g, or t
tcagtacgctgtctcacgaccggtgctcgatttagacgcgatcgaagggtttgggggagctgctcagttaggacccagagggaaccatcggaaaccccagcgcagcttctccttcctcctgctacctcgtggcctcccgaagtactaccgaaccggtagtaaattgtgttagacgcagtcncgagcacctgtcttgctcgaagggaacncgccaccgtctcgtgacacgggtcagtcgaagtgtcgagngacgagcagtctacgtgcctacggtacacgactacgaaccgtggccgagcctcgngtcacgtnntacngcgtnctacgtcggaaggccggactacgcggactaccgtaccggataccggtaggtctacgggtctacggtaagggttcgggaacgtaacggttaccaaggttacctacgggttaacccttcgtccgaacccgttaatacggacgacggtacgtaaccggacgtacggtacgtacgttaacgttaacgttcgtcgtacggtttattaccgttagtacgtagacgtagtagttacgcggttaacgtccggtacggtacggtacgtacgggtacggtgaagttaccgacgtaacgtacggttcgacggttcaaccggtcaaccgttcgttacgttaccggttacctttaccggtccgtttacccgtacccg

SEQ ID NO: 638 - DNA, 608 bp, Homo sapiens
  misc_feature: GYAE6OF02HBZVY.36.27.C05.1.454.CMB.1.raw
  modified_base (285)..(285): a, c, t, g, unknown or other
  misc_feature (285)..(285): n is a, c, g, or t
  modified_base (547)..(547): a, c, t, g, unknown or other
  misc_feature (547)..(547): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtcgtgggggaggcctggtcaagccgtggggggtccctgagactctcctgtgcagccctcgtggacttccacctttcagtagctatagcatgaacgtcgggtccnccgaggctaccggaggggaagggcgtagggacggtggggtcctcactcctaagtttaggtagttagtagttagttacattactactacgacagtactcgagtaggaacgggcctaattaccaaccctattcctacgaacgacgaaccaacgaccaaagaacctcatgtatctagaacaagtcgaacagtccgagagacgccggaggaccgacggtctagtagttattacgtggacggcgtagtggacgttatttaggtttanacgtttaggtttaccttaccgttaacttactaacctactaacgtgtacggtacgtaccggg

SEQ ID NO: 639 - DNA, 649 bp, Homo sapiens
  misc_feature: GYAE6OF02IOAJR.36.27.C05.1.454.CMB.1.raw
  modified_base (254)..(254): a, c, t, g, unknown or other
  misc_feature (254)..(254): n is a, c, g, or t
  modified_base (260)..(260): a, c, t, g, unknown or other
  misc_feature (260)..(260): n is a, c, g, or t
  modified_base (422)..(422): a, c, t, g, unknown or other
  misc_feature (422)..(422): n is a, c, g, or t
  modified_base (443)..(443): a, c, t, g, unknown or other
  misc_feature (443)..(443): n is a, c, g, or t
  modified_base (562)..(562): a, c, t, g, unknown or other
  misc_feature (562)..(562): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttcctgttgctatttagaaggtgtccagtgtgaggtgcagctggtggagtcgtggggggagcctggtacaagccgtggggggtccctggacgtctctcctgtgcagcctctggattccaccttnaggtanctaatagctagtgaacgtgggtacacgcgaggctacggaggggtaacgggctagggaggtcggtctcgactccgtaagttagtagtagtagttagtacattactaactcgactaaggaccttgaggtacggaacggcctaatccaacctatccgtacagaanaaccaaccgacaaagtacctnaacgttgtaactcctaacggaaataaaggacaaacgacgtaccgtaggaaacgaccgggacgtaacgaaccggtacgtcgttaagttaacggttaactacggttggacggtacgggtanacggttacgtaagttttagttacggtacgtttacggttacctttcaaacgtttaccaacgttaccaaggtttacgtacgggtccggg

SEQ ID NO: 640 - DNA, 630 bp, Homo sapiens
  misc_feature: GYAE6OF02GRSJJ.36.27.C05.1.454.CMB.1.raw
  modified_base (361)..(361): a, c, t, g, unknown or other
  misc_feature (361)..(361): n is a, c, g, or t
  modified_base (448)..(448): a, c, t, g, unknown or other
  misc_feature (448)..(448): n is a, c, g, or t
  modified_base (463)..(463): a, c, t, g, unknown or other
  misc_feature (463)..(463): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctatttagaggtgtccagtgtgaggtgcagctggtggagtcgtgggggaggcctggtcaagccgtgggggtccctgagactctcctgtgcagcctcgtggacttccaccttcagtacgctatagcatgaacgtcgggtccgcgacggcctaccgaggggaagggcgtagggaggtcgggtctcgtatccagttagtagtagtagtagtacatatactacgnagactagagtagaagggccattaccacctatcctaccgaaggacgaaccgaaccgaccgaaacgtaacctacgacgtgtactcgtanactaaatacgaaacncgtacgtgaacgcggaccggaggaccgtacggcttaggtagttacttaccgtggtacgggacggtattgggacgttatttacgttttcggtacgtttaggtttaccttaccgttaatttaacccgtacttaacccgtaacgtacgttaccgggtaccgttaccgggg

SEQ ID NO: 641 - DNA, 859 bp, Homo sapiens
  misc_feature: GYAE6OF02G65ND.36.27.C05.1.454.CMB.1.raw
  modified_base (154)..(154): a, c, t, g, unknown or other
  misc_feature (154)..(154): n is a, c, g, or t
  modified_base (276)..(276): a, c, t, g, unknown or other
  misc_feature (276)..(276): n is a, c, g, or t
tcagtacgctgtctcacgaccggtgctcgatttagacgcgatcgaagggtttgggctcaactctcctatccacttggtgatcagcacgtgagcaccgaggattcaccatggaactggggctccgctgggtttccttgttgctattttagaggtntccagtgtgaggtgcagctggtggagtcgtgggggacgccgtggtccaaggtccgtggggggtccctgacgaccttctcctgtacgcacgtcctcgtaggtacttcctaccttcgagttacnctatagccagtacgtaaccgtcgggtaccgaccgaggtcctaccggaaggggtaacggggtcttagggaggttcgggttacctcggtaacttccgtaagtttaaggtacggtaagttaggttaagtttaacctagttaaccttaaccgtaccgtacgaacgtaccgtacgtaaggttacgggaaacggtccgtacttaaccgtaaccctaagttacccgtaaccgtaagaacggtaacccgaaaccgacccgtaaaagtaaccccttacgaaccgttggtaacttccggaaacgggtaacctaaaacggtacgtaacccgaacccggttccgaagggaccggtaaccggacccgggaaaacggggttccccgaccgttaacgggttcgtttaaccgttaaccgtttaacggggcggtttaaccggggcccgtaagttaccgggtaccgttttaaattttacccgggtttaacggtttaaccggtttacggtttttacccggtaaaccctttaacccggtaaaccttttaacccgtaaccgttaacccggttaaccgttaaccggggtaccccgttaaccgggg

SEQ ID NO: 642 - DNA, 722 bp, Homo sapiens
  misc_feature: GYAE6OF02GPKNS.36.27.C05.1.454.CMB.1.raw
tcagtacgctgtctcacgaccggtgctcgatttagacgcgatcgaagggtttgggggagctgctcagttaggacccagagggaaccatggaaaccccagcgcagcttctcttcctcctgctactctggctccagataccacggagaaattgtgttgacgcagtctccaggccacctgtctttgtctccgaaggggaaagagcccaccctctcctgacgaggccagtcagtagtgtagagcagcagtactacttagccgtacggtaaccagacgaacggtaaacctgggacccgacgggcctccccgacggtcctacctactattcgtagtggtacgaccgacgtccggaaggggaccggtaccacggtacggactaccgtaccgaacgtaacggttacggtaccgtaggtcgggacgtaacgggtttcgggggtacgtacgggaacgtacgtaaccgtttccgtaaccttccgtaaccacctacgtacgacgaacgacgtacgacggtacgtacgagttattagtttcgagttagttacgttactacgttacgtgactagtaagttggtaccggttaccggttaccggttcggggtacgggtaacgggtaaccggtaagggtagaacgacgttaaccgtaacgtacggttcggcgttacgaacccgacttaacggttaccgttcgttaccgttacctttcttaacccgttcccgttacccgg

SEQ ID NO: 643 - DNA, 914 bp, Homo sapiens
  misc_feature: GYAE6OF02GVH2Z.36.27.C05.1.454.CMB.1.raw
  modified_base (639)..(639): a, c, t, g, unknown or other
  misc_feature (639)..(639): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgcgttgggtttttccttgttgcttattttagaggtcgtccagtgtgaggtgcagcgtgggtggagttcggtaggggggacgtccgtggtacgaaggtcccggtggggggttccccaggacgtaccgtccttccgtaggtgcgtacggccttcgtacggtcttacctaccctttcgaggttacgtactaattacggactatacggtaacgttcgggttccccgccgtaacggtcccgtaccggaacgggggtaacggggtccggtaggggtacggttcggggtacctccgtaacgtaccggttaagtttaacgggtaaggtttaagtaacggttaacggtttactaacgttaacgttaaccggttaccgacgtaacgtaacgtttacggaccgtaggggtaacggcggttaaccttccgaacgttactccgtaccgtaacgggaacgtaacgaaccgtaaccccgtaaggaaaccccttccgaacgtttacgtacgttaccgttacgaaccggtaaanaccggtaaacgacgttacccggtaagtacggtacccggaccggaacgggtaaaccggtacgggccgtttacgggttaacggtttaacttttaccgggttcgggtcggggtaaccggggttaccgttagggttaacccggttagtttttaaggttttaaaccgggtttaccgttttaagggttaaaccccttttacccggtttaaacccgttacctttaaaccggttaaccttaccggttaacgggtttaccgggtccggttttaaccccgggggg

SEQ ID NO: 644 - DNA, 596 bp, Homo sapiens
  misc_feature: GYAE6OF02F15AZ.36.27.C05.1.454.CMB.1.raw
  modified_base (233)..(233): a, c, t, g, unknown or other
  misc_feature (233)..(233): n is a, c, g, or t
  modified_base (239)..(239): a, c, t, g, unknown or other
  misc_feature (239)..(239): n is a, c, g, or t
  modified_base (275)..(275): a, c, t, g, unknown or other
  misc_feature (275)..(275): n is a, c, g, or t
  modified_base (343)..(343): a, c, t, g, unknown or other
  misc_feature (343)..(343): n is a, c, g, or t
  modified_base (371)..(371): a, c, t, g, unknown or other
  misc_feature (371)..(371): n is a, c, g, or t
tcagtacgctgtctcacgaccggtgctcgatttagacgcgatcgaagggtttgggctcaactctcctatccacttggtgatcagcactgagcaccgaggattcaccatggaactggggctccgctgggttttccttgttgctattttagaaggtgtccagtgtgaggtgcagctggtggagtcgtgggggagcctggtcaagccgtgggggtccctgagactctcctgtcgcngcctcnggattcaccttcagtagctatagcatgactggtccnccaggctcgagggagggctggagtggtctcgactccattagtagtagtagtagttacatatactacgnagctgagtgaaggtcaacgttcaacctntcctacgagacgacaacgaccaagaactcactgtatctagacaaagtacgaacacgtactgaacgacacgggtaacgacgtacggcttagtagttactttacgtcggtaggcgggtagtcgacgttagtttaggttttcgaacgtttttacggttaacctttccccgttaacttaaccgttaccttaaaccgtaccgtttaacggttacgggtacccgttacggg

SEQ ID NO: 645 - DNA, 593 bp, Homo sapiens
  misc_feature: GYAE6OF01DMOHQ.26.61.F06.1.454.CMB.1.raw
  modified_base (305)..(305): a, c, t, g, unknown or other
  misc_feature (305)..(305): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgtttgggatacctccaacagtcggggcaggttatgatgtacactggtaccaacatcttccaggaacacgaccccaaactcgtcatctactacaaacngcattccgggcctcgacggggtcccctgacccgtattcctctggcctccaagtctggccacctcacgccctccctggcccatccactggactacaggctgaggatgaggtacttattattactgacctaatcctatgaacaacccgtcgtggtatttggtttgttagtacgttttcggcggacgggtaccgaggtcgtacgtacccgttccggtacggtaccacggccccgaacgggtcctacccggtcccccctacgggtacctaccgttcccgtccgttccccccg

SEQ ID NO: 646 - DNA, 547 bp, Homo sapiens
  misc_feature: GYAE6OF01A58A2.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccagtctgtgctgacgcagccgccctcagtgtctggggccccaggacagagggtcaccatctcctgcactgggagcagctccaacatcggggcaggtcgtaatgtacactggtaccaacatcttccaggaacacgcccccaaactcgtcatctctacaacagcattcgggcctcgacggggtcccctgaccgattctctggctccgaagtctggcacctcacgccctccctggccatccactcggactacgaggctggaggatgaggtcttattacttactgcctaatcctatcgaaccaacccgtccgtaggtattggttttgtgtagttttcgggccggtccgggaccgaagtcctacacgtcgtaccgtaggtcacggcccaaggcctcggcccccgtcgg

SEQ ID NO: 647 - DNA, 561 bp, Homo sapiens
  misc_feature: GYAE6OF01DJZXC.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacatcggggcaggttatgatgtacactggtaccaacaagttccaggatcagtccccaaactcctcatctctggaacaccaatcggccctcgaggggtcccctgacccgattcctctggctccaagtctggcacctcggcctccgtggtcatcactgggctccgaggatgaggatgaggctgattatactgcctagtcgtatgaactaaccgttccttacttgttagttggttccgggcggagggaccgtaggggtcgaccggtcctacgtccacgcccgaacgggctcggcccccgtcggtcaccgttcctcgttccccgtccctccgtctaacg

SEQ ID NO: 648 - DNA, 655 bp, Homo sapiens
  misc_feature: GYAE6OF01C2WSS.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctccttgttttgggagtacctccaacagtcgggggctaggttatgatgtacactggtaaccaacaagttccaggatcacgtaccccaaactcctcatctctacggaacaccaatccggccctcgacgggtccctgaccgattcgtctcggctccgaagtcgtcggccaccgtccggccctcccgtggtcatccacgtcgggcctccgaggtactggaggagtggaggtctaggtattaacttacgtcgtacctaggtcgtatacgtaacctaacgttccttaacgtttgtacgtttcggttaccggggtacggtaacggggtaccgtaggggtccgtacccggttccgtaccggtccgaaccggtcccggtaacgtcccgtcccggtcccccgttccggtaccacccgttcccgttacccgttacccctccccttcccgtaccgttaaccgg

SEQ ID NO: 649 - DNA, 539 bp, Homo sapiens
  misc_feature: GYAE6OF01BM8LV.26.61.F06.1.454.CMB.1.raw
  modified_base (526)..(526): a, c, t, g, unknown or other
  misc_feature (526)..(526): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacatcggggcaggttatgatgtacactggtaccaacaagttccaggatcagtccccaaactcctcatctctgggaacaccaatcggccctcacggggtccctgaccgattctctggctccaagtctggcacctcacgccctccctggcccatccactcggacctacacggctgaggatggaggtcttattattactgacctaatcctatcgacaaccgcctggattggtttgtgtagttttcggcggtcggacaagctcactacgtcgtaggtcacgcccgaggcctcgcccctcgtccnctctcgttccccg

SEQ ID NO: 650 - DNA, 565 bp, Homo sapiens
  misc_feature: GYAE6OF01BPBZJ.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacagtcggggcaggttatgatgtacactggtaccaacaagttccaggatcagtccccaaactcctcatctctagggaacaccaatccggcctcgacgggtccctgaccgtattctctcggcctcaagtctggccacccgtcggccctcccgtggtccactccacgtcgggcctccgaggactggagagtgaggtctagtattattactgcctagtcgtatgactaacgtccttattgtattggtcggcggaggactagggtacgaccgtctacgtcgacgcccgaaggtcctccgccccgtcgtccacgtcctaccgttccccgcccttccgtcgtacg

SEQ ID NO: 651 - DNA, 557 bp, Homo sapiens
  misc_feature: GYAE6OF01CMR50.26.61.F06.1.454.CMB.1.raw
  modified_base (262)..(262): a, c, t, g, unknown or other
  misc_feature (262)..(262): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagaggtcaccatctcctgttttgggagtacctccaacagtcggggcaggttatgatgtacactggtaccaanaagttccaaggatcagtccccaaatcctcatctcgtggaacaccaagtccggccctgacggggtccctgaccgtattctctggctccaagtctggcacctcggcctccgtggtcactcactgggctccgagatgagatgaggctgattatactgctagtcgtatgacacgtcctagttgtattggtcggacggagggacctagggtcaccgtccgtacgtcacgacccgtaaggtccgtacgtcccccgtacgtaccaccttcgttacccgttccccgtcccctccgtcgtaacg

SEQ ID NO: 652 - DNA, 543 bp, Homo sapiens
  misc_feature: GYAE6OF01B2BSW.26.61.F06.1.454.CMB.1.raw
  modified_base (531)..(531): a, c, t, g, unknown or other
  misc_feature (531)..(531): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacatcggggcaggttatgatgtacactggtaccaacaagttccaggatcacgtcccaaactcctcatctctgggaacaccaatccggccctcgacgggtccctgaccgattctctggctccaagtctggcacctcggccctccctggtcatccacgtcgggcctccgaggatggaggatggaggctgattattactgcctagtcgtatgactaactcctacttgttattgttcgggcggagggaccgagggtcgaccggtccgtacgtcgacgcccgaggctcgcccctcgtcactctcgtcccnccctcctctacg

SEQ ID NO: 653 - DNA, 579 bp, Homo sapiens
  misc_feature: GYAE6OF01BST6W.26.61.F06.1.454.CMB.1.raw
  modified_base (453)..(453): a, c, t, g, unknown or other
  misc_feature (453)..(453): n is a, c, g, or t
  modified_base (566)..(566): a, c, t, g, unknown or other
  misc_feature (566)..(566): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagaggtcaccatctcctgttttggagtacctccaacagtcggggctaggttatgatgtacactggtaccaactaagttccaggactcacgtaccccaaactcctacactctcgtagggaaccaccaacgtccggccctcgacggggtccctgaccgtattctctcggcctccaagtctcggccaccgtcggccctcctggtcactcgacgtcgggcctaccgaggatggaggatggaggctgtattatactgactagtcgtancgactaacgtcttacgttgttattcggttcggcgggacgggacgtagggtcgacccgtcgtacgtcgacgcccgaggtctccggccccgtcggtcctcttccgtccttccccnccctctacgtacg

SEQ ID NO: 654 - DNA, 962 bp, Homo sapiens
  misc_feature: GYAE6OF01D0PWF.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagaggtcacatctctgttttgggactacctcaacagtcggggctaggttatgatgtacactggtaaccaacaagttccaggactcacgtaccccaaactcctacactcctacgtacggaaccaccaacgtccggccctcgacggggtccctagaccgtacttccgtcgtcggtcctaccgaacgttccgtacggcccgtacccgttcccgggtaccccttccccgttcgggtacctacgttcccgtaaccggttccggggtaccctttaccggaacgggtacggttacgggaacggggtacgttacggggtaacggggttaccgttaaggttaacgttttaacgtttaacccggtaccggttaaccccgttaacgggttttaccgggtttaaacgttaaccgggttaaaccccgtttaaaacccgggttttaccccgtttttaacggtttttaccgggttttaacggtttttaccgggggtttacccgggggtaaccggggggttaaaccgggggtaacccgggttaacggggggtttacccggttaaccccgggtttaaccccgttaccgggttaccccggaacccgggttaaccccccgggttaaacggggttccccccggtttacccccggggttacccccccccggtttaccgggggttaaacccccgttaaccccccggttttcccccggttttacccccgggtttacccccccccccgggtttaccccccgtttacccccggtttaacccggtttaaaccccgggg

SEQ ID NO: 655 - DNA, 635 bp, Homo sapiens
  misc_feature: GYAE6OF01EOM0O.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcacatctcctgttttggagtacctcaacatcggggcaggttatgatgtacacgtgtaccaacaagttccaggatcacgtccccaaactcctcatctctagggaaccaccaatccggccctcgacggggtccctgaccgtattctcgtcggcctaccaagtctcggccacctcggccctcccgtggtctactcacgtcgggctaccgaggatgaggagtggacggtctagtaatttattacgtgacctagtcgtagtacgaactaaccgttccgttactttgttactttcggttcgggtacgggtacgggtaccgacgggtccgtaccggtaccgtccgtacggtaccgaccggtacccgtaacggtcccgttccccgtcccccgttccggtaccctaccgttccgttacccgttccccctaccccgttcccgtaaccg

SEQ ID NO: 656 - DNA, 570 bp, Homo sapiens
  misc_feature: GYAE6OF01CQTR5.26.61.F06.1.454.CMB.1.raw
  modified_base (227)..(227): a, c, t, g, unknown or other
  misc_feature (227)..(227): n is a, c, g, or t
  modified_base (355)..(355): a, c, t, g, unknown or other
  misc_feature (355)..(355): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctcggggccccagggcagaggtcaccatctcctgtttggagtacctccaacngtcggggcaggttatgatgtacactggtaccaactaagttccaggatcacgtccccaaactcctcatctctggaacaccaatccggccctcgacgggtccctgaccgtattctctcggctaccagtcngcaccgtcggcctcccgtggtccatccgtacgtcggctcgaggatggaggatggaggtctgtattattactgacctgtcgtatcgactaacgtccttactttcgtagttcggttcgggtcggtacgggacgtagggtcgtacccgtcctacgtcacgcccgaacggccgtccggcccccgtcgtcctactccgtcgttccccgccctctcgtacg

SEQ ID NO: 657 - DNA, 815 bp, Homo sapiens
  misc_feature: GYAE6OF01DPKWC.26.61.F06.1.454.CMB.1.raw
  modified_base (226)..(226): a, c, t, g, unknown or other
  misc_feature (226)..(226): n is a, c, g, or t
tcagagactatactcacgaccggtgctcgatttagctacgctctaagggaaaggggacaaggaggcagcactcaggacaatctccagcatggcctggtctcctctcctcctcactctcctcgctcactgcacgagggtcctgggcccagtctgtgctgacgcagcccgccctcagtgtcgtcggggccccaggacaggagggtcaccatctcctgcacgtgggacncacgcctaccaacgacggtccgggggctaacggggttaccgttaaagtacggttaaccaccgttacgggtaaacccaaactacttccgttaccgaaggaaacccaccgacccccctaaaacctccggtaccacttacctaccgtaaaccaaaccgacgactacggttccgggaccctacggtaccggggttcccctacggaccgtactttctcgtcggtacctaccgtaacgttccgtcgggccctaacccgtccgtaccgtccccgttcccgttacgggacccctacgtacccgtaccggtaccggtaaccgttaaccgacggggtacccgttagggaacggtagttacgggtacggttacttttaaagttaccgttaaccgtcgtaacccttaacttacccgttacgtaaccggaacctaacccggtccgttaggttaacgttttcggggtttttacgtcggtttacgggtttccggggaccgggtaccgggtaacctaaccgggtctacccgaacgttaccggttaccgttaacggacctaccggtaccccgtacgggtcccgtccccggtcccccgttacccggg

SEQ ID NO: 658 - DNA, 724 bp, Homo sapiens
  misc_feature: GYAE6OF01D3NUF.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctcggggccccagggcaggaggtcaccatcctccttgttttgggacgtacctccaacagtcggggctaggttatgatgtacacgtggtaccaactaagttccaggtactcacgtaccccaaactcctacacttctacgtacggaacctaccgaaacgtccggacccctcggtacgggggtccccttagacccggtattcctccgtagggcctaccgtagtccgtcggcctaccccgtcggcccttcccgtggtccatccgacgtcgggactaccgaggtacgtagaggtacgtggacggtcgttagtaactttaacgttaccgtacgcgtacggtacgttaagtcggtaacgtaaccgttccttacgtttacgtttacgttacggttaccggggtacggtaacggggtaccgtacgggtaccgtacccgttacgtaccgtcgaccgaccccggtaaacggtcccgtacccggtcccccgttaccgggttaccccgacccgtttccgttaccccgtttaccccctaccccttcccgttaccgtaaaccgg

SEQ ID NO: 659 - DNA, 824 bp, Homo sapiens
  misc_feature: GYAE6OF01A3ALD.26.61.F06.1.454.CMB.1.raw
  modified_base (171)..(171): a, c, t, g, unknown or other
  misc_feature (171)..(171): n is a, c, g, or t
tcagagactatactcacgaccggtgctcgatttagctacgctctaagggaaagggcacaagaggcagcactcaggacaatctccagcatggcctggtctcctctcctcctcactctcctcgctcactgcacgagggtcctgggccagtctgtgctgacgcagcccgccctnagtgtcgtcggggcccaggacaggacggtcaccatcctaccgtgacacgtgggagcacgcctaccaaacgtcggtccgggggactacggtacgtaatgtaaccacgtacggtaaccaactcgtaccttaccaacggaacaccgaccccctaaagtccgtactacttacctactaacaaaccgtacgactacggttacccgggtccctacggtaccggggttaccctcggtaaccgttacttccgtccgttcggacccttaccgtaacgttccgtaccggtacctaccccgttacgtaccgtccccttcccggtacgtaccctaagtccgtaaccggttaccggaacgtaccggacggtaccgtacggtaacgggtaactttcgggtaacggtttaccttttaaacgttttacgtttacccgtacgttaaaccctaaaccgttaccgttaaccgtaaccggtaacccgtaaacccgggttcgttacgggtttaacgtttttggggtttttacgtacgggttttaccggtttaccgggggacccggttaacccggggttaactacccgggttacttaccgtaccgttaacggttcccgtaacggttaccgaacccgggttacccgacgggttccccgttaccccggttaccccgg

SEQ ID NO: 660 - DNA, 955 bp, Homo sapiens
  misc_feature: GYAE6OF01EL2B6.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagcccgccctcagtcgtcgtcggggccccgagggcaggaggtcacctatcctccgttggttttgggactaccctaccaatacggtccggggactaggttatagtagttacgtaaccgtcgttaacggtaacccaaaacgtaaacgtttaccgaaggtaactaccgtaaccgttaaccccctaaaacttccccgtactaacttaccgttccgtaacggggaaaacccaacccgtaacggtccccgggtaccccttaccgggtaccggggttacccctacggtaacccgttacgttttcctaccggttccggtaccctaaccgttaaaccggttccgtaccgggtaccctaaccccggttcccgggcccctttaccccgttcggtaacctaacccgttcccgtaaccggttccgggtaccccttaaccgggaagggtcgttaaggggaacggttacggtacggaacgggtttccgtaacgttaaacgttttaccgttaaccgtccggttaccggtaaaggtttaccgtaaacgtacccgttaaaccgtttaaccccggtttcccgtttaagttttaccggtttaacggtttcccgggggttaaccggggtaaccgggggttaacgggtacccgggtttaagggggaccccgtttaacccggttacccgttaaccggttcccggaaaccgtacccccgggtaacggtcccctttaccccggcccccggtttaacccgtccgttaaccccgttccggtttcccccgttaccccccgttcccttcccgtaggttaaccgg

SEQ ID NO: 661 - DNA, 914 bp, Homo sapiens
  misc_feature: GYAE6OF01EC0PT.26.61.F06.1.454.CMB.1.raw
  modified_base (204)..(204): a, c, t, g, unknown or other
  misc_feature (204)..(204): n is a, c, g, or t
  modified_base (236)..(236): a, c, t, g, unknown or other
  misc_feature (236)..(236): n is a, c, g, or t
  modified_base (535)..(535): a, c, t, g, unknown or other
  misc_feature (535)..(535): n is a, c, g, or t
tcagagactatactcacgaccggtgctcgatttagctacgctctaagggaaaggggacaagaggcagccactcgaggacaatctccagtcatggcctggtctcctctcctcctcactctcctcgctcactgcacaggtcctcggcctatctgtcgttgacgcacgccgcctcagtgtcgtcgggcccagggcaggacggtcacncttccgtccgttggttttcgggacgttacccncgaacgtacgtccgggactaggttagtacgtagttcgtacgacgttacggtaacccaaacgttaacgttaccgaagggtacttaccgtaccggttaaccccctaaacttccccttacgaccgttacctttaccgaaaccgtaaaacgacggtaccggtaacggtttacccggggtaccgttaccggtaccggggtttacccctacggtaaccgttacttttaccggtacgtacggtaccttaccgtaaacggttcgtacggaccttaccgtcgtaaccgtcccgtaccgtaccggtacnccgtaacgacgttaccggtaaccgtacggtaccggtaccgtaggtacggtaacgttaggttaaccgttaacttttaacgttaacgttaccgtaccgtaaccttacttaccgttaactaccgtaaccggtaacccgtcggtttaaggttacggttttacgggtttacgtttacgggtttacccgggttttacgggccgggggtaaccgggttaaccggaaccgtttaccggtaacgttaaccggttaccgggtttaacggttaacggggtttaacccggacccgggtaacccggttaaaccgggtacccccggtttacccggttaccccccgggttaacgtttacccggtttaccccgtcccgggttttaaaccccccgg

SEQ ID NO: 662 - DNA, 802 bp, Homo sapiens
  misc_feature: GYAE6OF01AYF24.26.61.F06.1.454.CMB.1.raw
  modified_base (171)..(171): a, c, t, g, unknown or other
  misc_feature (171)..(171): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagcccgccctnagtgtccgtcggggccccagggcacggagggtccaccacgtccgttccgttggttttcgggacgtaccctaccaactacggtccggggactagggttatggattacgtactacgtacgtaaccaaactaacgttcccgaaggtactactaacgttaccccaaactcctacacttcctacgtacggaaaccactaaccgtccggacccctaggtaccggggtccccttacgaccgtactttctccgttcggcccttaccgaaggttccgcggtaccctacccggtccgtcccgttaccccgtggtacctaacgttccgaaccggttcgggtaccctacggtacggtagtacggtaacggtacgtggaacgggttcgtaagttacttaacgtttaccgtacggtacgttaacggtcgttaacggtaaccgtaacgttaaccgttacctttaggttcgttacgtttaggggtacccggtacgggtacgggtaaccgggtaggtacccggtaccgttaccggtaccctcggaaaccggtacccgtaacgggtccccttacccggtccccggtaccggttaactccccgtttacggtacccccgttttaaccccaccgtttcccgtacgttaacgg

SEQ ID NO: 663 - DNA, 746 bp, Homo sapiens
  misc_feature: GYAE6OF01AUGIK.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagcccgccctcagtgtcgtcggggccccagggcaggagggtcaccatcctccgttggttttgggacgtacctccaacgagtcggggctaggttatgatgtacacgtcggtaaccaactaagttccaggatcacgtaccccaaactcctacactctcgtacgggaaccaccgtaacgtccggaccctcggtacggggtcccctaggaccgtatttccgtcgtcggccttaccgaacgttccgtacgggccctacccgtccggtcccttcccgtggtcctactcgtaccgtcgggcctaccgaaggtacgtacggaaggtacgtacggacggtcttaggtaactttacgttaccgacgtaccgtaggttaccgttagtacgtaaccgttaaccgttacctttacgtttacggttaacgtttcgggtaccggggacgggtaacggggtaccgtacggggtaccgtacccggttacccgtacggtacccgaccggtaccccgtaacgggtccctccccggtcccccgttacggtacccttaccggttcccgttacccggttaccccccgtcccttcccgtcgttaaccgg

SEQ ID NO: 664 - DNA, 662 bp, Homo sapiens
  misc_feature: GYAE6OF01AETL2.26.61.F06.1.454.CMB.1.raw
  modified_base (228)..(228): a, c, t, g, unknown or other
  misc_feature (228)..(228): n is a, c, g, or t
  modified_base (335)..(335): a, c, t, g, unknown or other
  misc_feature (335)..(335): n is a, c, g, or t
  modified_base (424)..(424): a, c, t, g, unknown or other
  misc_feature (424)..(424): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtccgtgtccccaggacagacagccacatcacctgctcggcagacaaattggganatagaaatgctgcctggtattaccagaggccaggccagtcccctagtttggcatcttaccaagataaagaagcggaccctgagggactcccgtgaccgtaatttccnggtcctaccaacgtcgtagggaaccacgacgcccactctacgaccagtccgacggtccgggacccaacgcccaacggataggacggganaacgtacgtagttacgcagggtcgtagggaacaagttacgtaagttggttaacggttggtttacgggacgggtagggtaccctagggtccgtacggtacccggttacccgtaaggtcccgtaacggacccgtaaacgggtcccgttcccggtacccccccgttcgggtacccctaacccgtttcccgttacccgtttaccccccacccccgtttcccgtaccgtaacggtttaacccg

SEQ ID NO: 665 - DNA, 757 bp, Homo sapiens
  misc_feature: GYAE6OF01CSEFR.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacaggtcctgggcccaatctgtgttgacgcagccgccctcagtgtcgtcggggccccgagggcaggtagggtccaccatcctccgttgtttgggactacctccaacgacgtcgggctaggttatgatgtacacgtggtaacccaacgtacgttcaggtactccgaaccgtacccaaactctcacttctacgtacggaaaccaccgtaacgtcccggccgtaccggtacgggtccctacgtaccgtacttccgtcgtcggtctaccgagttccgtcgtaccctacccggttccggtccccttaccggtcggtacctacgtccgtaccggttcgggtaccctacggtacgggtaacgtaggaagggtaactcgggtacggtacgttaaggttaacttaacgttaccgttacggtaccgttaacggttacgtaacttacgggaacctttaaccggttcctttaacggttagtttacggtttacgggtaccggggtacgggaacgggtaccggttaacggggtccgttaacccgtacggttaccgtacgccgtaacccggaacggtcccgtccccgtccccgtacgtccaccgtttcccgtaccgttacccctacccgttcctacgttaccg

SEQ ID NO: 666 - DNA, 1051 bp, Homo sapiens
  misc_feature: GYAE6OF01ASW2L.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacgagggtcctcgggacccaatctgtgttgacgcagccgcctcagtcgtcgtcggggcccgagggcaggcgggtcactatccttccgttggttttacggggactacccgtaccgaacgtacgggtccggggtaccgtaaggtttacgtggtaacgttacggtaaccgtaacgttaccggtaaaccgtaaaccgtaacggtttacccgaacggtaccgttaccgtaaaccgttaaccccctaaaaccttccgtacctacgttaccgtaccggtaacgggaaaccctaacccgtaacgtccccgggtacccgttaccgggtaccggggttaccccgtaccggtaacccgttacgtttccgtaccggttccggtaccgtaccgtaaacggttccgttaccggacccgttaaccccggttcccggttccccgttcccggtacggtacccttaccgttaccggtaccggttcgggtacccgttaaccgggtacgggtaacggttacggtaacgggttaagtccgggttaacggttaccgtttaacggtttaaacgttttaaccggtttaccggttacggttaacccggttaacgggtttaacgttaccggtaaccgttaaaccggtttaacccgtttacccgttttaacggttttacggttttaaccgggtttacggggttaccgggggtaaccggggttaacggggttaaccgggtaccggggttacccgttaaccccgggtttccggttaaaccggttcccggaaaaccccgggtttccccgggtaaaccccggggttccccggttaaccccccggggttcccccggttacccggttaacccccgttacccggttttacccccgtttacccccgggttaaccccccctttaccccgggttcccgtttaacccgggtttaacccgg

SEQ ID NO: 667 - DNA, 940 bp, Homo sapiens
  misc_feature: GYAE6OF01BR8DT.26.61.F06.1.454.CMB.1.raw
tcagagactatactcacgaccggtgctcgatttagctacgctctaagggaaagggacaagaggcagcactcaggacaatctccagcatggcctggtctcctctcctcctcactcctcctcgctcactcgacacgagggtcctcgggccctaattcgtgtcgttgacgccacgcccgcccttagagttcggtccggtcgggggcccccagggtcacgggacgggtaccaaccgtcttccttccggtttgggtttttacgggaccgttaacccctaaccgtaaacggtaccggttccgggggtacgtttaggttacgtagtacgttacgtacgtaaccgtacggtaaacccaaacgtaacgttccgaaggtactacctaacccgtaccctaaccttccttactacttaccgtacgttaaccgggaaaccctaccgtaaaccggttccgggaaccccttacgggtacccgggtttacccgacggtacccgtttacgtttccgacggttcgtccgtaaccgtacgttcgacggaccccttacccgtcccggtcctaaccggtcttccgactcggaccgttcggaccctagggtaacggtagtacggacgggttacgtaccggaggttaccggttaattaaccggtttaacgttaacccggttacggtaaccgttaacggtaaccgttactaccggtaaacccgtttaacgttaaccgttttcggtttaggtttaaccggggttttcggggtaccggggttaccggggtaacgggtttacccggggaaccggtttaccgggttaacccgtaccccgttacgggtaaccccaccgggtaacccggtacccgggttccccgtaccccggtccccggtttacgttcccccgttaacgttcccccgtaacccctttaccccgtttaccctacccgtttagttaacccgg

SEQ ID NO: 668 - DNA, 776 bp, Homo sapiens
  misc_feature: GYAE6OF01BY0FC.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcacgccgccctcagtgtcgtcggggccccgagggcaggacggtccaccatcctccgttggttttgggacgttaccctaccaacgacggtccgggacgtaggttatagtacgtacgtactacgttacggtaaacctaaacgtaacggtaccgaggtactaccgtaccgtaacccctaaactccctactactcgtaccgtacggaaccctaaccgtacgtcccggacccgtaccggtaccggggtccctacggtacccgtactttccgtccgtcgtccctaccgtacgtccgtccggccctacccggtcccgtaccccgttccgtcgtaccgtacgtccctacgggttccggtcctaccggtaggtacgtaggaacggtacgtgggtaacggtacgttacgttaacgtttaacgttccgtacgtacccgttaagttccggttaagtacccgttaacccgttaacccgttactttacgttacgtttacggttcgggtaccggggtacgggtacgggtaccggttagggtacccgtaacggttcccgtccggtacgaccgtacccggtacgtccgacccgtcccgtcgtcctccgtccctaccgtccctccgtctcgtacg

SEQ ID NO: 669 - DNA, 788 bp, Homo sapiens
  misc_feature: GYAE6OF01EPYJL.26.61.F06.1.454.CMB.1.raw
  modified_base (208)..(208): a, c, t, g, unknown or other
  misc_feature (208)..(208): n is a, c, g, or t
  modified_base (225)..(225): a, c, t, g, unknown or other
  misc_feature (225)..(225): n is a, c, g, or t
  modified_base (241)..(241): a, c, t, g, unknown or other
  misc_feature (241)..(241): n is a, c, g, or t
  modified_base (357)..(357): a, c, t, g, unknown or other
  misc_feature (357)..(357): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccagtctgtgctgacgcacgcccgccctcagtcgtcgtcggggccccaggacagacggtccaccntcctctgcacgtgggancacgtcctaccaacgnggtccggggactacggttacgtaatcgtaaccacgttacggtaacccaacgtacttccgttaccgaacggtaaccacccgaccccctaaactcgtactacttccgtactaacaacncgtccgtacgttccggcctacggtaccggtaccgtacgtaacccttattcctacggtcgtcctaccgtacgtccgtacggacctaccgtcaccgtcccgtccgtcgcctacgtaccgacgttacgaaccgtacgacggtctaggacgtcgtaggtacgttacgtttattaaccgttacgtacgtaacctaaacgttccgtaacgtaccggtaaccgtaaccccggttgttaacggtttcgtttttacgggttttccggttacgggtttaccgggtttccgggggaaccgggtaacccgggttaaaccgtaccggtaaccgttacccggttaacccggttcgttaaccccgggtttaacggtaacccccgtaaccggtaacccccgggttaaaccggttccccgttcccccggttccccggttaaccccggg

SEQ ID NO: 670 - DNA, 777 bp, Homo sapiens
  misc_feature: GYAE6OF01BGARA.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcacgccgccctcagtgtcgtcggggccccagggcagagggtcaccatcctctgttttgggacgtacctccaacacgtcggggactaggttatgtagtgtacacgtcggtaacccaaacgtaacgttaccgaggactaccgtacgtaacccccaaacctccctacactcctcgtacgggaacctaaccgaacgtccggccctacggtaccggggtccctacggtaccgtacttccgtacgtcggtcctacgtaacgtcgtacggacccgtaccgtcccgggtaccctcccgttacggtcctaactcgtaacccgtggggtaccctcggaagaacgtcggaacgggtagtacgggacggtacttaggtaactttaacgttacgtcggacgtacggttacgtaacgtacggtaaccgtaacgttacccgtttagtttacggtacgtttacgggttaccggggtacgggaaccggggtaccggtacgggtaccgggtaaccccgttaccgaccgttaccggaaccggtaacccggtaacggccctcccgggttcccccttcgggtacccgtaccgtttcccttacccggttacccccgtaccccttccgttaaccgtaacgg

SEQ ID NO: 671 - DNA, 735 bp, Homo sapiens
  misc_feature: GYAE6OF01AO6AA.26.61.F06.1.454.CMB.1.raw
  modified_base (246)..(246): a, c, t, g, unknown or other
  misc_feature (246)..(246): n is a, c, g, or t
  modified_base (254)..(254): a, c, t, g, unknown or other
  misc_feature (254)..(254): n is a, c, g, or t
  modified_base (361)..(361): a, c, t, g, unknown or other
  misc_feature (361)..(361): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatcctgtgttgacgcagccgccctcagtgtctggggccccaggggcaggagggtcaccgatctcctgtttcggagtacctccaacatcggggcaggtacngatgtacntggtaccaacgaagttccaggactctaagtcccccaaaatccctctatcgtgttacgggaaccacgaactccgggtccttaccgacgggggtcccctggaacccgtntttcctcgtacggtcctctaaacgtccgtggtccacccgttccggcctcccgtaggtctacgtccgtacgtcggggtccttaccggacgggtatacgggaacggacgtttacgggacgggtaccttagggtaacctttaacgtttacgactaccggtaagttccggtatacggaacttaacgtaccttacggtttagttacggttggtaccgggtacggtagggtacccgtaggggtcccgtaacccgggttcgtaaaccggttccgaacggtaccccggtaacggtcccttaccgggtacccccccgttgggtacccctacgttcccggtttcccggtccccccggtaaccccgttccgttacccggtaacgg

SEQ ID NO: 672 - DNA, 781 bp, Homo sapiens
  misc_feature: GYAE6OF01DL3RJ.26.61.F06.1.454.CMB.1.raw
  modified_base (133)..(133): a, c, t, g, unknown or other
  misc_feature (133)..(133): n is a, c, g, or t
  modified_base (139)..(139): a, c, t, g, unknown or other
  misc_feature (139)..(139): n is a, c, g, or t
  modified_base (520)..(520): a, c, t, g, unknown or other
  misc_feature (520)..(520): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacgnggtccncggccaatcgtgtgtgacgcacgcccgtcctgagttcgtcggtccgggcccgagggcgtaggcggtccacctagtccttaccgttggtttacggggaactttaccccaaccgaaacgtcgggttaccgggggtccttaagggtttacgtacgtaacggtacgttaaccgtaacggtttaccggtaaacccgtaaaaaccgtaccggtttaaccgaaacggttaccgttacccgtaacccgtaacccctaaaccttcctaacctaccgttccgtacggtaaccggaaccaaccgtacgtccggtaccctccggtacggtcccgcgtactcgttcctcgtacgtcctacgcgttccgcgtcctcctccgtcctccggttactntcgtacgtccggacgtcgtccggagtacgttacggacgttagtacgtagttacgttattaacgttcacgtacaattaccctgtaccgaaccgtccgtacgtcggttagtttggtttcgttacggttcggtttacccggggacgtaccgggtacccgagttacccgacgtacgtacccggtaactccggtaccgacgtacccggtcgtaccgtccccggtaccgttccgaccggttccctaccggttcccttacccgtcccg

SEQ ID NO: 673 - DNA, 531 bp, Homo sapiens
  misc_feature: GYAE6OF02GQ8ZI.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacatcggggcaggttatgatgtacactggtaccaacaagttccaggatcagtccccaaactcctcatctctgggaacaccaatcggccctcaggggtccctgaccgattctctggctccaagtctggcacctcggcctccctggtcatcactgggcctccgaggatgaggatggaggctgattattactgccagtcgtatgacaacgtcctacttgtattgttcggcggagggaccagggtgaccgtcctacgtcagcccgaaggcctcgcccctggtcactctcgttccccaccctcctctacg

SEQ ID NO: 674 - DNA, 525 bp, Homo sapiens
  misc_feature: GYAE6OF02IV9J0.26.61.F06.1.454.CMB.1.raw
  modified_base (389)..(389): a, c, t, g, unknown or other
  misc_feature (389)..(389): n is a, c, g, or t
  modified_base (394)..(394): a, c, t, g, unknown or other
  misc_feature (394)..(394): n is a, c, g, or t
  modified_base (446)..(446): a, c, t, g, unknown or other
  misc_feature (446)..(446): n is a, c, g, or t
  modified_base (521)..(521): a, c, t, g, unknown or other
  misc_feature (521)..(521): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacatcggggcaggttatgatgtacactggtaccaacaagttccaggatcagtcccccaaactcctcatctctgggaacaccaatcggccctcgacggggtccctgacccgattctctggctccaagtctggcacctcggcctcctgtcatcactggctcgagntgagntgagctgattatactgccagtcgtatgactacgtcctacttgtattgtcggnggagggccagggtcgaccgtctacgtcacgcccgaggctcgcccctcggtcacctctccgttccccaccttcctntacg

SEQ ID NO: 675 - DNA, 530 bp, Homo sapiens
  misc_feature: GYAE6OF02HSOJ6.26.61.F06.1.454.CMB.1.raw
  modified_base (450)..(450): a, c, t, g, unknown or other
  misc_feature (450)..(450): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacatcggggcaggttatgatgtacactggtaccaacaagttccaggatcagtccccaaactcctcatctctgggaacaccaatcggccctcacggggtccctgaccgattctctggctccaagtctggcacctcggcctccctgtcatcactgggctccgaggatgaggatggaggctgattattactgccagttcgatgacacgtcctattgtattgttcggnggagggccagggtgaccgtccgtacgtcagcccaaggcctcgcccctcggtccactctccgttccccgccctcctctacg

SEQ ID NO: 676 - DNA, 547 bp, Homo sapiens
  misc_feature: GYAE6OF02HCLUJ.26.61.F06.1.454.CMB.1.raw
  modified_base (392)..(392): a, c, t, g, unknown or other
  misc_feature (392)..(392): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggatacctccaacatcgggggcaggttatgatgtacactggtaccaacaagttccaggatcagtccccaaactcctcatctctgggaacaccaatccggccctcgacggggtccctgaccgattctctggctccaagtctggcacctcggcctccctggtcatcactgggcctcaggntgaggatggaggctgattatactgcctagtcgtatgactacgtccttattgtattgtcggcggagggaccagggtcgaccgtcgtacgtcacgcccgaaggcctccggccccctcggtccaccgttccgttcgttccccgccccttctcctacgg

SEQ ID NO: 677 - DNA, 541 bp, Homo sapiens
  misc_feature: GYAE6OF02H5TQJ.26.61.F06.1.454.CMB.1.raw
  modified_base (265)..(265): a, c, t, g, unknown or other
  misc_feature (265)..(265): n is a, c, g, or t
  modified_base (530)..(530): a, c, t, g, unknown or other
  misc_feature (530)..(530): n is a, c, g, or t
  modified_base (537)..(537): a, c, t, g, unknown or other
  misc_feature (537)..(537): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctggtttttgggagtaccctccaacatcggggcaggttatgatgtacactggtaccaanaagttccaggatcagttcccaaactcctcatctctgggaacaccaatccggccctcgacggggtccctgaccgattctctggctccaagtctgcacctcgccctccctggtcatcacgtcgggctccgaggatgaggatggagctgtattatactgccagtcgtatgacaacgtcctacttgttattggttcggcggtagggaccgagggtcgaccgtcgtacgtcgacgccaaggcctcgcccctcgtccactctcgttccccncctcctntacg

SEQ ID NO: 678 - DNA, 536 bp, Homo sapiens
  misc_feature: GYAE6OF02HNIOG.26.61.F06.1.454.CMB.1.raw
  modified_base (265)..(265): a, c, t, g, unknown or other
  misc_feature (265)..(265): n is a, c, g, or t
  modified_base (341)..(341): a, c, t, g, unknown or other
  misc_feature (341)..(341): n is a, c, g, or t
  modified_base (464)..(464): a, c, t, g, unknown or other
  misc_feature (464)..(464): n is a, c, g, or t
  modified_base (531)..(531): a, c, t, g, unknown or other
  misc_feature (531)..(531): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacagtcggggctaggttatgatgtacactggtaaccaanaagttccaaggatcacgtccccaaactcctcatctctggaacaccaatcggccctgacgggtccctgaccgattcnctgctcagtctcgcacctcggcctccgtgtcatcacgtggctccgagatgaggatgaggctgtaattattactgtccagtcgtatagactacgtcttacttgtattgtcggcggtaggaccgnggtcgaccgtcgtacgcgacgcccgaagcctccggcccctcggtcctctctccgtcccctacctccnctacg

SEQ ID NO: 679 - DNA, 589 bp, Homo sapiens
  misc_feature: GYAE6OF02IA67X.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccaccctcagtgtctggggccccagggcagagggtcaccatctcctgttttgggatacctccaacatcggggcaggttatgatgtacactggtaccaacaagttccaggatcacgtccccaaactcctcatctctgggaacaccaatccggccctcgacggggtccctgaccgattctctggctccaagtctggcacctcggcctcctggtcatcactggctcaggatgagatgagctgtattattactgcctagtacgtatgacaacgttcctacttgttattgtttcgcgggtacgggaccgtacggctacggaccgtaccgtagggtaccacggtccccgaagggtccgtaccggtccccccgttaccgggtcctaacccgttccgttacccggtttaccccctaccccgttcccgttaaccgg

SEQ ID NO: 680 - DNA, 565 bp, Homo sapiens
  misc_feature: GYAE6OF02HSY8Q.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggatacctccaacatcggggcaggttatgatgtacactggtaccaacaagttccaggatcagtccccaaatcctcatctctgggaacaccaatccggccctcgacggggtccctgaccgattctctggctccaagtctggcacctcggccctcccgtggtcatcacgtgggcctccgaggatggaggatggaggctgtattattactgcctagtcgtatcgaactaacgtcctacttgtagtttcggtcggcgggaggaccgaggggtcgaccgtccgtacgtcacgacccgaaggtcctccggcccccgttcggtccaccttccgtccgttccccaccccttcctctacg

SEQ ID NO: 681 - DNA, 587 bp, Homo sapiens
  misc_feature: GYAE6OF02F6N5P.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggatacctccaacatcggggcaggttatgatgtacactggtaccaacaagttccaggatcagtccccaaactcctcatctctgggaacaccaatccggccctcgacggggtccctgaccgattctctggctccaagtctggcacctcggccctccctggtcatccacgtcgggctccgaggactggaggagtggaggctgtattatactgcctagtcgtatgacctacgtcctacgttgtagttcggttcgggcggtacgggaccgagggtcgtaaccggtccgtaccggtcacggcccgaacggtcctaccgggtccccccgttcggtcctaccgttccgttccgttccccgaccccttccctacgtaccgg

SEQ ID NO: 682 - DNA, 624 bp, Homo sapiens
  misc_feature: GYAE6OF02GYNGA.26.61.F06.1.454.CMB.1.raw
tcagagactatactcacgaccggtgctcgatttagctacgctctaagggaaaggggacaagaggcagcactcaggacaatctccagcatggcctggtctccctctcctcctcactctcctcgctcactgcacagggtcctgggcccaatctgtgttgacgcagccgccctcagtgtctggggccccagggcagagggtcaccatctcctgttttgggagtacctccaacatcggggcaggttatgatgtacactggtaccaacaagttccaggatcagtcccccaaactcctcactctcgtggaaccaccaagtccggccctcgacgggtccctcgaccgtattcctcgtcggcctacctaagtccgtggacctacccgtccggccccttcccgtggtccactccacgtggcctccgaggatggaggagtggaggctagtaatttattacgtgcctagttcgtatcgaactaaccgtccttaactttgtacgtttcgggtcgggacgggtacgggtaccgtagggtcgtaccgtccgtaccgtcgacgtacccgaaggtcctccggcccccgttcggtccctaccgttccgttccgttaccccctacccttcccgtacgtaacg

SEQ ID NO: 683 - DNA, 569 bp, Homo sapiens
  misc_feature: GYAE6OF02FWCXU.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagcccgccctcagtgtctggggccccagggcagagggtcaccatctcctgttttgggagtacctccaacagtcggggcaggttatgatgtacactggtaccaacaagttccaggatcacgtccccaaactcctcatctctgggaacaccaatccggccctcgacggggtcccctgaccgtattctctggctccaagtctggccacctcggccctcctggtcactcacgtggctccgaggatggaggagtggaggtcgtagtattagtactcgcctagtcgtagtgactacgtccttattgtagttggttcggacggacgggtcgagggtcgaccgtccgtacgtcgacgcccgaacggcctcgtcccccgtcggtccacgttccgtccgttccccacccttcctctacg

SEQ ID NO: 684 - DNA, 527 bp, Homo sapiens
  misc_feature: GYAE6OF02FMMJT.26.61.F06.1.454.CMB.1.raw
  modified_base (395)..(395): a, c, t, g, unknown or other
  misc_feature (395)..(395): n is a, c, g, or t
  modified_base (448)..(448): a, c, t, g, unknown or other
  misc_feature (448)..(448): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggagtacctccaacatcggggcaggttatgatgtacactggtaccaacaagttccaggatcagtccccaaactcctcatctctgggaacacaatcggccctcaggggtccctgaccgattctctggctccaagtctggcacctcggcctccctggtcatcactgggctccaggatgaggangaggctgattatactgccagtcgtatgactaacgtcctacttgtattgtcggnggagggaccagggtgaccgtctacgtcagcccgaaggcctcgccccctcggtcactctccgttcccgccctcctctacg

SEQ ID NO: 685 - DNA, 650 bp, Homo sapiens
  misc_feature: GYAE6OF02H0NDH.26.61.F06.1.454.CMB.1.raw
  modified_base (266)..(266): a, c, t, g, unknown or other
  misc_feature (266)..(266): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtcgtcggggccccagggcagagggtcaccatctccttgttttggagtacctccaacagtcggggcaggttatgatgtacactggtaaccaanaagttccaggatcagtccccaaactcctcatctctggaacaccaatccggccctcgacgggtccctgaccgtattctacgtggctccgaagtctggactaccgtcggaccctccgtggtctatccacgtcgggctcccgaggtacgtgaaggagtgacggtctagtaattaacgttacgtagtcctaaggttcgttaagttacgaaccgtaaaccgttcccttacttaggttaacgtttcgggtttaccggacgggacggaccgtacggggtcacccgttaccgttacgaccgtaccgacccgaacgggtcccttaccgccccccgtttacggacctaccgttccttacccgttaccccctaaccccgttcctaccgttaacgg

SEQ ID NO: 686 - DNA, 552 bp, Homo sapiens
  misc_feature: GYAE6OF02GAOBU.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagagggtcaccatctcctgttttgggatacctccaacatcggggcaggttatgatgtacactggtaccaacaagttccaggatcagtccccaaactcctcatctctgggaaccaccaaatccggccctcgacggggtccctgaccgattcctctggctccaagtctggcacctcggcctcctggtcatcactggctccaggatgaggatggaggctgtattattactgctagtcgtatgactaacgtctacttgtattgttcggcggagggaccgtagggtcgaccgtcgtacgtcacgcccgaaggcctccggcccccgttcggtccacttccgttccgttccccgtccctcctcgtaacg

SEQ ID NO: 687 - DNA, 967 bp, Homo sapiens
  misc_feature: GYAE6OF02IMC8U.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtcgtcggggccccagggcaggagggtcaccgatcctccgttggttttgggacgttacccgtccaaactacgttcgggggcctaagggtttatggaattcgtaacctaccgttcggttaaacccaaacgtaaacggtttccgaagggtaactaccgtaaccgtacccccaaaacgttccctacaacttccgtcgtacgggaaaccaaccgtaacgtacccggtccctaccggaacggggttcccctaacggtaaccggtaacctttccgtccggttacgggtaccttacccgtaaacggttcccgttacggggcccctaaccccggttccccggggtcccctttacccccgggtttacgggttaccctaaaccttttccccggtaaacccgggttcccgggggggtacccctttaaccccgggtaaacggggggtaacgtacggggtaaaccgggtaacggtacggggtaaaccgggtccgttaacgggttaaacgtttaacgtttacccggtaccgtaacccgttaacgggtttaccgttaacgtaccggtaaacccgtaaaccggttccctttaacgtttcggttaacgtttccgggtaccggggttaccgggtaacggggtaacccgttaggggtaccgtaaccccggttaccgttaccgtacgtaacccggtacccggttaaaccgggcccggttccccgggtaacccccccgttccgggttaccctaacccgtttcccggttaccccggtttaccccccaaccccgtttccccgtagtttaaccccggg

SEQ ID NO: 688 - DNA, 610 bp, Homo sapiens
  misc_feature: GYAE6OF02GXBS8.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctggggccccagggcagaggtcaccatctcctgtttgggatacctcaacatcggggcaggttatgatgtacactggtaccaacaagttccaggatcagtcccccaaactcctcatctctcgggaacaccaagtccggccctcgacggggtccctgacccgtattctcgtggctccaagtctggcacctcggccctccgtggtcatccacgtcgggctccgaggactgaggatggaggcttagtaattattacgtgaccgtagttacgtaatcgaaccgtaacgttccttacgtttgttacgtttggttccgggacgggtacgggtaccgtaggggtaccgtaaccgttccgtacgtccgacggacccgaaggccgttcccgcccccgttacggtcctaccgttccgtcccgttccccaccctcccgtacgtaacg

SEQ ID NO: 689 - DNA, 704 bp, Homo sapiens
  misc_feature: GYAE6OF02G59TD.26.61.F06.1.454.CMB.1.raw
  modified_base (324)..(324): a, c, t, g, unknown or other
  misc_feature (324)..(324): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccagtctgtgctgacgcagccgccctcagtgtctggggccccaggacagacgggtcaccatctcctgccacgtgggagccagcctaccaacagtccgggggacaggtcgtaatgtaacacgtggtaaccaacatcttccaaggaacacgacccccaaactcgtacatcctactaacaaacngcagttccgggcctgacggggtccctagaccgtattcgtcgtcggcctaccgaagtcgtcggcacctcacgtccctcccgtcggacctatacctacgtcggaacctaacggagggtaccgtaggaacgggtagtacgggtacggttactttaactttaagtttaccgtcgtaacctaaacttcccgttaagtaccggaaccctaaccgtacccgttagggttaacgttttcggggttttttagtcggtttaacggtttttcccggggaccgggtaccgggtaaccgtaacggtcctaccggttaaccgtacggttaccgttacggtaccgaaccgggtacccgtaaacgggtcccgttacccggtccccccgttaccggg

SEQ ID NO: 690 - DNA, 688 bp, Homo sapiens
  misc_feature: GYAE6OF02IWFXR.26.61.F06.1.454.CMB.1.raw
  modified_base (243)..(243): a, c, t, g, unknown or other
  misc_feature (243)..(243): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtcgtggggccccagggcagagggtcaccatctctgtttgggactacctccaacagtcggggcaggttangatgtacacgtggtaccaacagttccaggatcacgtcccccaaatcctcactctcgtggaaccaccaatccggccctcgacggggtccctagacccgtatttcgtcgtggcctaccgaagttcgtgccaccttccgggccttcccgtggtacctactccgtaaccgtcggggtacccttccgagggtatacgggaacggtagtcgggacgggtaccgttaggtaactttaaacgttacccgtggtacccgtaagggtttccgttaattacgggaacccgtaaaccgtttcccttacgtttagtttacgttcgggttcgggacggggtacgggtaccgtaagggtcgtaaacccgtccttaacgtcgacgtacccgaaggtccctccggtccccctagggtccctaccgttccgttacccgttccccaccccgttacctcgtaacg

SEQ ID NO: 691 - DNA, 700 bp, Homo sapiens
  misc_feature: GYAE6OF02JICVD.26.61.F06.1.454.CMB.1.raw
  modified_base (368)..(368): a, c, t, g, unknown or other
  misc_feature (368)..(368): n is a, c, g, or t
  modified_base (437)..(437): a, c, t, g, unknown or other
  misc_feature (437)..(437): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtcgtggggccccagggcagagggtcaccatctccttgtttgggagtacctccaacagtcggggcaggttatgatgtacactggtaccaacagttccaggatcacgtccccaaactcctcatctcgtaggaacaccaatccggtccctcgacggggtccctcggacccgtacttctccgtcggtctaccaagtcncggtccacccgtccgtccctcccgtcggtactacgtccacgtcgggtcctaccgaggtactaggacggngttcggaacggtccttaggtaactttacttaccgtggcccgttagtcggttaactacggtaaccttaaccggttccctttacgtttacggtttcgttttacgggttccggggaccgggtacgggggtaacccgtagggggttacccgtacccggttacccgttaccggttccgaccggacccggtaaccggcgttcccggcccccggttacggtacctcccgttcgttccccggttaccccgaccccttccgttacgtaacgg

SEQ ID NO: 692 - DNA, 742 bp, Homo sapiens
  misc_feature: GYAE6OF02GT8HS.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtcgtcggggccccagggcagagggtcaccatctcctgtttgggatacctccaacagtcggggcaggttatgatgtacacgtggtaccaaacaagttccaggatcacgtaccccaaatcctactatcctcgtacgggaacaaccaacgtccggccctacggtacggggtcccctaggaacccgtactttcgtcgtcggtacctaccgtaaagtccgtacgggtcctaacccgttccgggcccttcccgtggttaccacttacgacgttacggggccctaccggagggtaactacggaggtagttacgggacgggtcctaggttaaactttaatttaccgtcggtaccgttaacggttcggtaattacgggaaaccctaaaccggtttcccttaagtttcgttaacgtttcgggttacgggacccgggtacggggtaccgtaaggggtccggtaacccgttccgtaccgttaccgaacggtacccaaagggtcccttacccggtacccccgttcggtacccgtaccttaccgttcccgttacccccgtacccctttcctacccgtaacgg

SEQ ID NO: 693 - DNA, 783 bp, Homo sapiens
  misc_feature: GYAE6OF02GH810.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtctcggggccccagggcagagggtcaccatctccttggtttgggacgtacctccaacagtcggggctaggttatgatgtacactggtaccaacaagtccaggactcgacgtaccccaaactcctcactctcgtacggaaccaccaagtcccggaccctcgacggggtccctacgtaccgtattccgtcgtcggtcctaccgtacgtcgtcggacctaccgtccggtcccttcccgtggtacctactccgtacgtcggggcctacccgtaggacgtaggaacggtacgtagggacggtcgtacggtaactttacgttaccgtacggtacccgttaacggtacgttaagtacgtaaaccctaaccggtttaccccgtttacgttttacggtacgtttttcgggttaccgggggtaccggggtaacggggtacccggttaacgggggttaccggtaaccccgtttcgggtacccggttacccgaaccgggtaccccggaaaccgggttcccgttacccccgggtaccccccgttaccggggtacccttacccgtttacccggttacccggttttaccccccacccccggttttacccgtaccgttaacccgg

SEQ ID NO: 694 - DNA, 709 bp, Homo sapiens
  misc_feature: GYAE6OF02GYSPX.26.61.F06.1.454.CMB.1.raw
  modified_base (249)..(249): a, c, t, g, unknown or other
  misc_feature (249)..(249): n is a, c, g, or t
  modified_base (302)..(302): a, c, t, g, unknown or other
  misc_feature (302)..(302): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcgagtgtcgtcggggccccagggcaggaggtcaccatctccttgtttgggagtacctccaacgacgtcggggcaggttangtatgtacacgtggtaccaacgtaagttccaggactcacgtccccaaactccnctactctcgaggaaccacaacgtccggccctcgacgggtccctcgaccgtattctcgtcggtcctccgaagttcgtcggcctacccgtccggtcccttcccgtggtcacgtcgacgttcgggacctcgagggtactaggtaggtacgtaggacggtcgtagtaactttagttacgtacgtaccgttaggttacgttagtaccgtaacctaccggttaccttacgtttggttaactttcggggtttaccgggtacgggtaacgggtaccggttaacggggttaccgtaacccggttaccgttaccggtaccgtaaccggacccggtaacggtcccggttacccggtcccccgttaggtacccttccgttccgtttcccgttacccctaccctttccgtacttaaccgg

SEQ ID NO: 695 - DNA, 849 bp, Homo sapiens
  misc_feature: GYAE6OF02G1IDE.26.61.F06.1.454.CMB.1.raw
  modified_base (169)..(169): a, c, t, g, unknown or other
  misc_feature (169)..(169): n is a, c, g, or t
  modified_base (830)..(830): a, c, t, g, unknown or other
  misc_feature (830)..(830): n is a, c, g, or t
tcagagactatactcacgaccggtgctcgatttagctacgctctaagggaaaggggacaagaggcagcactcaggacaatctccagcactggcctggtctcctctcctctcactctcctcgctcactgcacgagggtcctgggcccaatctgtgtgacgcagccgcctnagtgtcgtcggggccccagggcaggagggtccaaccatcctccgttggtttttgggaacttacccgtccaactacggtccgggggctaagggtttatggatggtaacctacggtacggttaacccaaaccgaacggtttaccagggtacttaccacggttacccccaaaaccttcccttactaacgttccgttaccgtacgggtaacctaaccgtaacgtcccgggacccgttcggaaccggggttccctttaacggaccccgtagtttaccgtcgtacgggtcctaccgttaaacggttccggtccgggaacccttaccccgggttcccggtaccccttccccggtttacgggtactaccgtacctacggttcgggggaccctacgtacgggacgtacgtagggtaacgtacggtacggtacgttacgggttaactttaacgttaccggttcggtaaccgttaggttaccgtacggttaacggtaaccgtaaccgttaccgtttacgttttacggttaacttttcgggttaccgggtaagggtaccggggacgtaccgggggttaccaccgggttacccggtaaggtccgtaccggtaccgtaccggtccgttacccggccccgttaccgtaccgtcccgttaccgttccgttaaccccncttacccgtaccgttaacg

SEQ ID NO: 696 - DNA, 860 bp, Homo sapiens
  misc_feature: GYAE6OF02GKF5F.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagccgccctcagtgtcgtcggggccccagggcagacgggtcaccatctccttggtttgggagtacctccaactacgtcggggactaggttatggattgtactacgtacggtaaccaaacgtaagttaccgaaggtactaccgaccgtaccccaaactcctacacttcctacgtacgggaaacctaaccgaacgtcccgggtccctacggaccggggttccctacgtaccgtacttctacgtcggcctacgtaacgtcgtcgcctaccgtccgggtcccttccgttcggtacctacgttaccgtacggtcggggtaccctaaccgggtagggtaacgtacgggtaaacggtacggtacgggtacgggttcgttaacgttaacgtttaacgtttaaccggtacgttaacccggttaaccgggttacgtttaacggtaaccggttaaacccgttaacccgtttaacccgtttaacgtttaacggtttacggttttccggggttaccggggtaccggggttaaccgggtaaccggtacgggtaccggttacccgttacccggttaccgttacccggaacggtaaccccgggttaaccgggtcccgttaacccggtccccccgggttacggttacccgttacccggtttccccggtttaccccggttccccccggttacccgttccccggttacccgttaaccgg

SEQ ID NO: 697 - DNA, 891 bp, Homo sapiens
  misc_feature: GYAE6OF02JMMYU.26.61.F06.1.454.CMB.1.raw
tcagagactatactcacgaccggtgctcgatttagctacgctctaagggaaaggggaacgaagaggcagcactcaggacaatctccagcatggctggtctcctctcctcctcactctcctcgctcactgcacgagggtccgtgggcccaatctgtgttgacgcagcccgccctcagtgtcgtcggggccccgagggccgaggacgggtccaccgatccttccgttggtttttagggacgttacccgtaccaactacggtccggggccgtaagggttatggtatcgtacaccgtcggtaaccaactaaacgttccaaggtactccgaccgtaccccctaaacttccctacacgttccttcggtaacggaaccaaccgaacgtcccggtcccgtaccggtaccggggtcccctaggtaccccgtatttcccgttacggtccggtaccctcccgtaaggtccgtccggacctacccgtccggtccccttcccgggtgttaccctacgtccctacgggtcccgggtccgttacccgacggtaagttaccgggaggacgttacgggtaggttaccttttaagtttaccgttaaccgtaccggtacccgtaaatttacccgtacgttaaccggaacccgtaacccgttcggttacgggttaggtttttcggggtttttacggttcggtttttaacgggtttccccgggggacggggtacccgggtaaaccgttaacgtccggttcccttaaaccggtcggtttacccgggttacgggttacccgaaccgtaccccgggttaaccgggtccccgttaccccgggttaccccccgggttccggttaaccccgttaacccggtttccccgtttcccccgggttttacccccccaccccgg

SEQ ID NO: 698 - DNA, 696 bp, Homo sapiens
  misc_feature: GYAE6OF02IJNJE.26.61.F06.1.454.CMB.1.raw
  modified_base (268)..(268): a, c, t, g, unknown or other
  misc_feature (268)..(268): n is a, c, g, or t
tcagagactatactcacgaccggtgctcgatttagctacgctctaagggaaagggggacaagaggcagcactcaggacaatctccacgcatggcctgggtctcctctcctctcactctcctcgctcactgcacagggtcctgggcccaagtctagttgttgacgcagccgccctcagtgtcctggggccccagggcacgacggtcacatctcctgtttgggatacctccacagtcggggctaggttatgatcgtacactggtaccaanaagttccaggaactcacgtccccaaactcctcactctctagggaaccacgaatcggccctgacgggtccctgaccgtattctcgtacggcctcgaacgtccgtcggccctaaccgtccggcctcccgttggtctaacgtccctagtcgggtcttccgaagggtatacggtaggtaactcgggacggttctcgtaagtttactaccgttgacccttaaggtccgtacgttacgaaccgtaaacgtcccgtttaactttgggttacctttccgggtcggtaccgggacgggttaaccgtgggggttacctaccggtacccgtttacggccgtaaccgggtcccgtaaacgggtcccgtcccggtccccccgttacgggttacctaccgttcctccgttaccccccggtccctcccgttacccgtaaccgg

SEQ ID NO: 699 - DNA, 773 bp, Homo sapiens
  misc_feature: GYAE6OF02IS8HG.26.61.F06.1.454.CMB.1.raw
  modified_base (273)..(273): a, c, t, g, unknown or other
  misc_feature (273)..(273): n is a, c, g, or t
tcagagactatactcacgaccggtgctcgatttagctacgctctaagggaaagggggacaagaggcagcactcaggacaatctaccagcatggcctggtctcctctcctcctcactctcctcgctcactgcacagggtcctgggcccaatctgtgttcgacgcacgccgccctcagtgtcgtcggggccccagggcaggaggtcaccatctccttgttttgggctacctccaacagtcggggctaggttactgattgtacactggtacctaanaacgttccaggactcacgtccccaaactcctacacttcctcgtacgggaaaccacctaacgtccggaccctacggacgggggttccctaggtaacccgtactttccgtccgtcgggtaccttaccgaaacgttccgtcgggtaccctacccggttccggtaccccttccgtcgggtacctacttccgaaccgttcgggtaccctaccgtagggtactacgggaacggtacgtaacggacgggtcttaggtaacttttaacgtacggttacggtaccgttaacggtttaccgttacgttaacgtaacccgttaaccgttcccgtttaacgttttcggttaaccggtttacgggttaccggggtacgggggtaccgggtaccgttaacggggttccggacccgttaccgtaccgtaccgaccgtacccggtaacggcccgttaccgcccccgttcgtacccgttctcccggttaccgttcccgtacccttccgtacgtacgg

SEQ ID NO: 700 - DNA, 747 bp, Homo sapiens
  misc_feature: GYAE6OF02H891H.26.61.F06.1.454.CMB.1.raw
  modified_base (167)..(167): a, c, t, g, unknown or other
  misc_feature (167)..(167): n is a, c, g, or t
  modified_base (246)..(246): a, c, t, g, unknown or other
  misc_feature (246)..(246): n is a, c, g, or t
  modified_base (304)..(304): a, c, t, g, unknown or other
  misc_feature (304)..(304): n is a, c, g, or t
  modified_base (325)..(325): a, c, t, g, unknown or other
  misc_feature (325)..(325): n is a, c, g, or t
  modified_base (333)..(333): a, c, t, g, unknown or other
  misc_feature (333)..(333): n is a, c, g, or t
  modified_base (679)..(679): a, c, t, g, unknown or other
  misc_feature (679)..(679): n is a, c, g, or t
  modified_base (688)..(688): a, c, t, g, unknown or other
  misc_feature (688)..(688): n is a, c, g, or t
  modified_base (723)..(723): a, c, t, g, unknown or other
  misc_feature (723)..(723): n is a, c, g, or t
  modified_base (734)..(734): a, c, t, g, unknown or other
  misc_feature (734)..(734): n is a, c, g, or t
tcagagactatactcacgaccggtgctcgatttagctacgctctaagggaaaggggacaagaggcagcactcaggacaatctccagcatggcctggtctcctctcctctcactctctcgctccatgacacgtacgggtcctacgggacccaatctgtagttggaccncgacggccgtccctgagtcgtcggacgggcccagggcaggtacggtcactgtcctcgttggttacggataccacaacgngtcggggactaaggttctagatcgttaaccagtcggaacctaacgagttaccaaggtnaccgaccgtaaccaacttccnctaacgtntacgcggaaaccactaacgttcccgcgttaccggccgggtacctacggaacctctttaccggcgggttccaaccgttacctaacgttaccggtcgaacccgttaccgtaccgggtaccctttcgtaccgggattccgttaaaccggccggtttacccggggcctttaaccggaaggttacgtacgggtaggaaaccgtttgggaccgtccgtaagttaaccgtttaaacgtacgtaccggtctaacggttaaccgtagttaaccgaacggttaaacctcgtttacgttaacggttagttacgttaccgggacgttacgggacgttagacgtaccgtcgttacgacncgggtaccncggttacacgtacccgtcgtacgctcggttaaccncccggttaccnccgttagtaacgg

SEQ ID NO: 701 - DNA, 779 bp, Homo sapiens
  misc_feature: GYAE6OF02GFIJT.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacgagggtcctgggcccaatctgtgttgacgcagccgccctcagtgtcgtcggggccccagggcagacgggtcaccatctcgttggttttagggactacctaccaactagtccggggctaggttatgatcgtactacgtacggtaaccaactaacgttccaggactcaccgtacccctaaactcctactatctactaacaaacagctagttcgggcctcggacggggtccctacgtaccgtattcctcgtcggacctacctaaggtctcggcctaccgtcaccgtccctcccgtcggaccctagttccgaccgtacggaccgttaacgacgggtctacggtaggtacgttaggtacggttactttaatttaaccgtttaacgtccgtaacctaacttaccgttacgtaccgtaacccgtaacccggtccggttagggttacggttttaggggtttttacggtttcggtttaccgggttttacccgggggtaccggggttacccgggtaaccgtaaccgtccgttacccgaacggttaacccggttaccggttaaccgggttacccggaaccggtacccgtaaccggtcccgtaccccggttaccccccggttaccggttaccccgttaccgttcccggtttacccccggg

SEQ ID NO: 702 - DNA, 881 bp, Homo sapiens
  misc_feature: GYAE6OF02GPMKW.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacgagggtcctcgggcccaatctggttgttcgacgcacgcccgccctctagtcgtccgtcggggccccgagggcgaggacgggtcacctactcttccgttggttttacgggacgttacctaccgtaaacgtacggtccggggcgtaaggttacgtagtacgttacgtaactacgtacggtaaacctaaacgtaacgttaccgaacggtactacctaaccgtaacccctaaacttcctactacttccgtacgtacggaacaccgtaacgtcccgtacccgtacgggcggtaccgtcgtaaccgtcttccgtcgttcgtaccgtaccgtaacgttccggtccggtacctaccggtcccggtccccgttccggttacgacccgttactacccgtaccgggtcggtccctaacggtacgggtaacgtacgggtacggtaacggtcggtacgggttacgtacgtttaacgttaaccgttaccgtaccggtaaccgttacggttacggttaacgtaccgttaaaccgtaacgtttacccgtttaagtttcggttacgggtttacgggtaccggggtaacggggtaccggggttaaccgggtaccggtacccggttaccggttaccggttaccggttaccggaaccggttacccggtaaccgggtccccgttacccggtcccccggttacggttaccccgttaaccggttccccgtttaccccgttaccccgtaccctttacccggtaccgttaaccgg

SEQ ID NO: 703 - DNA, 928 bp, Homo sapiens
  misc_feature: GYAE6OF02FFP7D.26.61.F06.1.454.CMB.1.raw
tcagagactatactcacgaccggtgctcgatttagctacgctctaagggaaggggcaagaggcagcactcaggacaatctccagcatggcctggtctcctctcctcctcactctcctcgctcactcgcacgacggtcctgggccctaatctgtgttcgacgcacgccgcctcgagtcgtcgtcggggcccaggcaggaggtcacctatcctccgttggtttcgggactaccgtacaacgtcggtccgggacttaagggttactcggaacgttcgtaaacctcgttacggtaaccgtaaaccgtaacggtttccgaagggaccttaccgtaacccgtacccctaaacctccgtaccgtatcccgttacggacgggtaaccaacgtaaccgtccgggtacccctacgggtacggggtttcccctaccggtaaaccgttccgtttccgtccggttacgaccgtttaacccgttaacggtcccgtaacggggttcccaaccccgggtttcccggtccccgtttaacccgggttcggtaaccgtaacccgtttaacccggccggtttaccggggacctacccgggttaaggtaaccgtttagggggaacggtacggacgggtttaacggtcccgtaagttttaacgtttaccgtttaccgggcccgaaaccgttacgtaaccgggttcgtaaacccggtaacgttacccgttttaccgggtaactttttacgggacgttttacggggtccggggtaaacgggaaccggggtttaaccggtacgggttaccccgttcgtaaccccgtttaaccgggccgttaacccggcccggttaaaccggggtccctaaccccgggtaccccggttacgtaccccgtacccgtttccgtccccggttaacccctacccgttacccgttaccgttaaacccgg

SEQ ID NO: 704 - DNA, 879 bp, Homo sapiens
  misc_feature: GYAE6OF02GOFWQ.26.61.F06.1.454.CMB.1.raw
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccaatctgtgttgacgcagcccgccctcgagtgtcgtcgggggccccagggcaggacgggtcaccatcctccgttggtttttggggacgttaccctacccaactaggtccgggggaccgtaagggtttatggtacgtacggttaaccgtaccgttacgggttaaccccaaaacgtaaaccgggtttacccgacggggtaaacttcccgtaacccggttaaccccccaaaaccttccccttaccgtaacgtttacccgttaccgggtaaccggggaaacccctaacccgtaacggttccccgggtacccccgtacgggtacccgggggttcccccttacgggtacccggtacttttaccgttccggttcggcccgtaaccgtaacgttccgtcggtaccctacccgtccggtcccttcccggtcggtacgactcgaccgtcgggtacctacggacggtagcggtaggagtacgggacggtacgtgtttaacgtttacgttaaccgtcgtaccggttacggtgttaacgcggtaaaccgtacgttaccgttacgttagttcggtttacggtcggggaccggtacgggtaccgggtaggggtaacctcccgggttacccgtaaccgggtccgtaaccggtacccggaaccggttcccgcccccgggtaccccgtttccggtaccctacggttccccgttacccggttaccccccgtcccgttacccgtcggttaacccg

SEQ ID NO: 705 - DNA, 819 bp, Homo sapiens
  misc_feature: GYAE6OF02ITHJW.26.61.F06.1.454.CMB.1.raw
  modified_base (236)..(236): a, c, t, g, unknown or other
  misc_feature (236)..(236): n is a, c, g, or t
tcagagactatactcacgaccggtgctcgatttagctacgctctaagggaaaggggacaagaggcagcactcaggacaatctccagcatggcctggtctcctctcctcctcactctcctcgctcactgcacagggtcctgggcccagtctgtgctgacgcacgcccgccctcgagtcgtcgtacggggcccccaggacaggacgggtccaccgtatcctcctcgactacgtggganccgacgtcctaccaaccgtaggtccggggactacggttacggtaacgttcggtaacctaccggttacggtaaccctaaactacttaccgttaccgaaacgggaaccaccgacccccctaaacgtccgtacacgttcctacctaaaccaacgtcgactaccggttcggtaccctcggtaaccggggttccccacggtaccgtacttccgtccgtccggtaccctaccgtaaggtcccgtcggaccctaccgtcgtacccgtccccttcccggcggtacccctataccgtaccgttacggaaccgttacggaccggtccgtacggaaggtacgtacggtacggttacctttaacggttaccttacctacgtacccgtaactacgtacgtaaccgtaacccgtacccgtcggttagttacggttttcgtttacgtacggttacccggttttcggggaccgggttaccggaacccgttacggtaacccgtacggtaacccgttaccggttacccggttaaccggtacccggttaacccgaacccggtaccgggttaccccgttaccccggtacccccgtttaaccgg

SEQ ID NO: 706 - DNA, 881 bp, Homo sapiens
  misc_feature: GYAE6OF02GN94Q.26.61.F06.1.454.CMB.1.raw
tcagagactatactcacgaccggtgctcgatttagctacgctctaagggaaaggggacaagaggcagcactcaggacaatctccagcatgtcctggtctcctctcctcctcactctcctcgctcactgcacagggtcctgggcccaatctgtgttgacgcagccgccctcagtgtctggggccccagggcagagggtcaccatcctccttgttttgggacgtacctccaacagtccggggctaggttactggaattcgtaactacttacgggttaacccaaactaacgttcccgaagggtacttccgaacgttcccccaaaacgtccctaccaattccttcgttacgggaacctaaccgaaacgtcccgggacccttacggaacgggggttccccctaggtaaccccgaacttttccgtaccgttcgggaccttaccccgaaaggttccgtacggggtaccctaccccgggttccgggtccccttaccccggttgggttaccctaacgttacccgtaaccggttcgggggccctttacccggaaggggtaaccgttcgggaaacgggttacgtaggggtacgggtacccgttagttaacgtttaacgtttaccgtacggtacccgtaacggtttaccggtttaacgttacgggaaacccgtttaaccggttacctttaacccgggttttaggttaacggttttaaccgggttttccgggggtaacccggggtaacggggttaacccggtaacggggttaccgtaaccccggttaccgttaccggtaccgttaacggaccccggtaacggtccgtcccggtaacccccgttcggtacccacgttcccgttaccgttccccggacccttcctacgttaaccgg

SEQ ID NO: 707 - DNA, 189 bp, Homo sapiens
  misc_feature: GYAE6OF01BZC0J.18.43.D10.1.454.CMB.1.raw
  modified_base (169)..(189): a, c, t, g, unknown or other
  misc_feature (169)..(189): n is a, c, g, or t
tcagtacgagtatgcacgaccggtgctcgatttagactagcagtaagggcccatcggtcttcccctggcgccctgctccaggagcacctccgagagcacagcggccctgggctgcctggtcaaggactacttcccatactcgtactgagcggctggcaaggcgcatagnnnnnnnnnnnnnnnnnnnnn

SEQ ID NO: 708 - DNA, 174 bp, Homo sapiens
  misc_feature: GYAE6OF01BB6F3.18.43.D10.1.454.CMB.1.raw
  modified_base (171)..(174): a, c, t, g, unknown or other
  misc_feature (171)..(174): n is a, c, g, or t
tcagtacgagtatgcacgaccggtgctcgatttagactagcagtaagggcccatcggtcttccccctggcgccctgctccaggagcacctccgagagcacagcggccctgggctgcctggtcaaggactacttcccatactcgtactgagcgggctggcaaggcgcatagnnnn

SEQ ID NO: 709 - DNA, 170 bp, Homo sapiens
  misc_feature: GYAE6OF01DWPEY.18.43.D10.1.454.CMB.1.raw
  modified_base (169)..(170): a, c, t, g, unknown or other
  misc_feature (169)..(170): n is a, c, g, or t
tcagtacgagtatgcacgaccggtgctcgatttagactagcagtaagggcccatcggtcttcccctggcgccctgctccaggagcacctccgagagcacagcggccctgggctgcctggttaaggactacttccatactcgtactgagcgggctggcaaggcgcatagnn

SEQ ID NO: 710 - DNA, 172 bp, Homo sapiens
  misc_feature: GYAE6OF02GU7JP.18.43.D10.1.454.CMB.1.raw
  modified_base (170)..(172): a, c, t, g, unknown or other
  misc_feature (170)..(172): n is a, c, g, or t
tcagtacgagtatgcacgaccggtgctcgatttagactagcagtaagggcccatcggtcttcccctggcgccctgctccaggagcacctccgagagcacagcggccctgggctgcctggtcaaggactacttcccatactcgtactgagcgggctggcaaggcgcatagnnn

SEQ ID NO: 711 - DNA, 176 bp, Homo sapiens
  misc_feature: GYAE6OF01ED29X.23.64.F09.1.454.CMB.1.raw
  modified_base (168)..(176): a, c, t, g, unknown or other
  misc_feature (168)..(176): n is a, c, g, or t
tcagacgcgagtatcacgaccggtgctcgatttagcgcgtatacaagggcccatcggtcttccctggcgccctgctccaggagcacctctggggcacagcggccctgggctgcctggtcaaggactacttccatactcgcgtctgagcgggctggcaaggcgcatagnnnnnnnnn

SEQ ID NO: 712 - DNA, 188 bp, Homo sapiens
  misc_feature: GYAE6OF02HOW8P.23.64.F09.1.454.CMB.1.raw
  modified_base (180)..(188): a, c, t, g, unknown or other
  misc_feature (180)..(188): n is a, c, g, or t
tcagacgcgagtatcacgaccggtgctcgatttagcgcgtatacaagggcccatcggtcttccctggcgccctgctccaggagcacctctggggcacagcggccctggggtctcgccgtggtacgaaggtacttacttccatacgtcgcgtctgaggcggcgtggacgaaggcgcatagnnnnnnnnn

SEQ ID NO: 713 - DNA, 346 bp, Homo sapiens
  misc_feature: GYAE6OF01EV2E8.7.10.A10.1.454.CMB.1.raw
  modified_base (343)..(346): a, c, t, g, unknown or other
  misc_feature (343)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnn

SEQ ID NO: 714 - DNA, 342 bp, Homo sapiens
  misc_feature: GYAE6OF01E22NI.7.10.A10.1.454.CMB.1.raw
  modified_base (340)..(342): a, c, t, g, unknown or other
  misc_feature (340)..(342): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctggggcacagcggccctgggctgcctggtcaaggactacttcctagagacacgctgagcggctggcaaggcgcatagnnn

SEQ ID NO: 715 - DNA, 343 bp, Homo sapiens
  misc_feature: GYAE6OF01A3BFX.7.10.A10.1.454.CMB.1.raw
  modified_base (341)..(343): a, c, t, g, unknown or other
  misc_feature (341)..(343): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctggggcacagcggccctgggctgcctggtcaaggactacttcctagagacacgctgagcgggctggcaaggcgcatagnnn

SEQ ID NO: 716 - DNA, 346 bp, Homo sapiens
  misc_feature: GYAE6OF01CDL6Q.7.10.A10.1.454.CMB.1.raw
  modified_base (342)..(346): a, c, t, g, unknown or other
  misc_feature (342)..(346): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggcctgggctgcctggtcaaggactacttctagagacacgctgagcgggctggcaaggcgcatagnnnnn

SEQ ID NO: 717 - DNA, 340 bp, Homo sapiens
  misc_feature: GYAE6OF01B2J02.7.10.A10.1.454.CMB.1.raw
  modified_base (338)..(340): a, c, t, g, unknown or other
  misc_feature (338)..(340): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctcaccaagggcccatcggtcttcccctggcaccctcctccaagagcacctctggggcacagcggcctgggctgcctggtcaaggactactcctagagacacgctgagcgggctggcaaggcgcatagnnn

SEQ ID NO: 718 - DNA, 346 bp, Homo sapiens
  misc_feature: GYAE6OF01C9970.7.10.A10.1.454.CMB.1.raw
  modified_base (341)..(346): a, c, t, g, unknown or other
  misc_feature (341)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggccctgggctgcctggtcaaggactacttcctagagacacgctgagcgggctggcaaggcgcatagnnnnnn

SEQ ID NO: 719 - DNA, 344 bp, Homo sapiens
  misc_feature: GYAE6OF01DB8VB.7.10.A10.1.454.CMB.1.raw
  modified_base (342)..(344): a, c, t, g, unknown or other
  misc_feature (342)..(344): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacgctgagcgggctggcaaggcgcatagnnn

SEQ ID NO: 720 - DNA, 348 bp, Homo sapiens
  misc_feature: GYAE6OF01BUU90.7.10.A10.1.454.CMB.1.raw
  modified_base (342)..(348): a, c, t, g, unknown or other
  misc_feature (342)..(348): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnnnnn

SEQ ID NO: 721 - DNA, 350 bp, Homo sapiens
  misc_feature: GYAE6OF01COU0T.7.10.A10.1.454.CMB.1.raw
  modified_base (344)..(350): a, c, t, g, unknown or other
  misc_feature (344)..(350): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggccaccctcctccaagagcacctctgggggcacagcggccctgggctgcctggtccaaggactacttcctagagacacgctgagcgggctggcaaggcgcatagnnnnnnn

SEQ ID NO: 722 - DNA, 344 bp, Homo sapiens
  misc_feature: GYAE6OF01C7WE1.7.10.A10.1.454.CMB.1.raw
  modified_base (341)..(344): a, c, t, g, unknown or other
  misc_feature (341)..(344): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagagcacctctgggggcacagcggccctgggctgcctggtcaaggactacttcctagagacacgctgagcgggctggcaaggcgcatagnnnn

SEQ ID NO: 723 - DNA, 342 bp, Homo sapiens
  misc_feature: GYAE6OF01CWXGI.7.10.A10.1.454.CMB.1.raw
  modified_base (338)..(342): a, c, t, g, unknown or other
  misc_feature (338)..(342): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccggtatcacttggatagaagtgcttattacattgactactggggccagggaaccctcgtcaccgtctcctcagcctccaccaaggcccatcggtcttcccctggcaccctcctccaagagcacctctggggcacagcggcctgggctgcctggtcaaggactacttcctagagacacgctgagcgggctggcaaggcgcatagnnnnn

SEQ ID NO: 724 - DNA, 388 bp, Homo sapiens
  misc_feature: GYAE6OF01BTJIB.7.10.A10.1.454.CMB.1.raw
  modified_base (351)..(388): a, c, t, g, unknown or other
  misc_feature (351)..(388): n is a, c, g, or t
tcagcgtgtctctacacgaccggtgctcgatttagcgtcgatctcaggggacaacgccaagaagtcactggtatctacaaatgaacagcctgagagccgaggacacggcccgtgtattactgtgtgagagataagtccgggtatcacttggatagaagtgcttattacattgactacgtggggcccagggaaccctcgtcaccgtctcctcagcctccaccaagggcccatcggtccttccccctggccacccctcctccaagagcacctctgggggcacagcggccctgggctgcctggtcaaggactacttcctagagacacgctgagcgggctggcaaggcgcatagnnnnnnnnnnnnnnnnnnnnnnnnnnnnnnnnnnnnnn

SEQ ID NO: 725 - DNA, 366 bp, Homo sapiens
  misc_feature: GYAE6OF01EOLY7.7.10.A10.1.454.CMB.1.raw
  modified_base (340)..(366): a, c, t, g, unknown or other
  misc_feature (340)..(366): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccggtctcctcagcctccaccaagggcccatcggtcttccccctggcaccctctccaagagcacctctggggcacagcgccctggctgcctggtcaaggactactcctagacgacacgctgagcgggctggcaaggcgcatagnnnnnnnnnnnnnnnnnnnnnnnnnnn

SEQ ID NO: 726 - DNA, 450 bp, Homo sapiens
  misc_feature: GYAE6OF01C8EYS.7.10.A10.1.454.CMB.1.raw
  modified_base (388)..(389): a, c, t, g, unknown or other
  misc_feature (388)..(389): n is a, c, g, or t
  modified_base (391)..(394): a, c, t, g, unknown or other
  misc_feature (391)..(394): n is a, c, g, or t
  modified_base (396)..(397): a, c, t, g, unknown or other
  misc_feature (396)..(397): n is a, c, g, or t
  modified_base (399)..(450): a, c, t, g, unknown or other
  misc_feature (399)..(450): n is a, c, g, or t
tcagcgtgtctctacacgaccggtgctcgatttagcgtcgatctcagggggacgaaacgccaagaagtctacgtcgtatcgtaaccaaatggaaacacgcctgagagcccgtaggactaccggcccgtgtattacctgtgtgacgagataacgtccgggtatcaacttggatagaagtgcttatacatgactactgggccagggaccctcgtcaccggtactcctccacgcctccaccaagggcccatcggtccttcccccgtggcctaccctcctaccaagagtcaccctgtcgggggcacaggaccggcccgtgggctgccctgggtcaacggctacttcctagagactacggctgacgacggggctgggcaaggccgcactaggnngnnnngnngnnnnnnnnnnnnnnnnnnnnnnnnnnnnnnnnnnnnnnnnnnnnnnnnnnnn

SEQ ID NO: 727 - DNA, 349 bp, Homo sapiens
  misc_feature: GYAE6OF01AP8EC.7.10.A10.1.454.CMB.1.raw
  modified_base (342)..(349): a, c, t, g, unknown or other
  misc_feature (342)..(349): n is a, c, g, or t
tcagcgtgtctctacacgaccggtgctcgatttagcgtcgatctcagggacaacgccaagaagtcactgtatctacaaatgaacagcctgagagccgaggacacggccgtcgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggaacagcggccctgggctgcctggtcaaggctacttcctagagacacgctgagcggctggcaaggcgcatagnnnnnnnn

SEQ ID NO: 728 - DNA, 344 bp, Homo sapiens
  misc_feature: GYAE6OF01B0NXB.7.10.A10.1.454.CMB.1.raw
  modified_base (341)..(344): a, c, t, g, unknown or other
  misc_feature (341)..(344): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggcaccctcctccaagagcacctctggggcacagcggccctgggctgcctggtcaaggactacttcctagagacacgctgagcgggctggcaaggcgcatagnnnn

SEQ ID NO: 729 - DNA, 567 bp, Homo sapiens
  misc_feature: GYAE6OF01BQOB1.7.10.A10.1.454.CMB.1.raw
  modified_base (275)..(275): a, c, t, g, unknown or other
  misc_feature (275)..(275): n is a, c, g, or t
  modified_base (421)..(421): a, c, t, g, unknown or other
  misc_feature (421)..(421): n is a, c, g, or t
  modified_base (428)..(428): a, c, t, g, unknown or other
  misc_feature (428)..(428): n is a, c, g, or t
  modified_base (430)..(430): a, c, t, g, unknown or other
  misc_feature (430)..(430): n is a, c, g, or t
  modified_base (433)..(433): a, c, t, g, unknown or other
  misc_feature (433)..(433): n is a, c, g, or t
  modified_base (443)..(443): a, c, t, g, unknown or other
  misc_feature (443)..(443): n is a, c, g, or t
  modified_base (471)..(471): a, c, t, g, unknown or other
  misc_feature (471)..(471): n is a, c, g, or t
  modified_base (473)..(473): a, c, t, g, unknown or other
  misc_feature (473)..(473): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
  modified_base (500)..(500): a, c, t, g, unknown or other
  misc_feature (500)..(500): n is a, c, g, or t
tcagcgtgtctctacacgaccggtgctcgatttagcgtcgatctctagggacaacggccaaggaagtcccacctggttactcgtactaaatgaactaggcctgagagccgaggacacggcccgtgtattaactgtgtgagaggattaaggtccgggtatcacttgggtataggaagtgacttttaagttacattgactacgtgggggccagggaaccctcgtcgaccggtctcctcggagcctccgaccaagggccccaggtccggtcttccccnggccacccctctcaagagccacctcgtgggggtcacctagcggacccttgggcctgaccctggtccaaggcgtaccgtcctaggacgtaccaacggcgtagaggacgggcttgggcaagggcgtactaagtaaggatgagatacanatatatnanatntgagagaganatacacactcacagacactacacacacncntatactanagagagacgcngagagagngacgacgacgctagtagtagtacgtgtaggaggagagagtagtaggtagtaggtcggtggcggacgg

SEQ ID NO: 730 - DNA, 349 bp, Homo sapiens
  misc_feature: GYAE6OF01DMYU3.7.10.A10.1.454.CMB.1.raw
  modified_base (341)..(349): a, c, t, g, unknown or other
  misc_feature (341)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtctcccctggccaccctcctccaagagcacctctgggggcacagcggccctgggctgcctggtcaaggctacttcctagagacacgctgagcgggctggcaaggcgcatagnnnnnnnnn

SEQ ID NO: 731 - DNA, 343 bp, Homo sapiens
  misc_feature: GYAE6OF01DB2VW.7.10.A10.1.454.CMB.1.raw
  modified_base (342)..(343): a, c, t, g, unknown or other
  misc_feature (342)..(343): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacgctgagcgggctggcaaggcgcatagnn

SEQ ID NO: 732 - DNA, 347 bp, Homo sapiens
  misc_feature: GYAE6OF01CZWGR.7.10.A10.1.454.CMB.1.raw
  modified_base (342)..(347): a, c, t, g, unknown or other
  misc_feature (342)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggctacttcctagagacacgctgagcgggctggcaaggcgcatagnnnnnn

SEQ ID NO: 733 - DNA, 352 bp, Homo sapiens
  misc_feature: GYAE6OF01BIUGI.7.10.A10.1.454.CMB.1.raw
  modified_base (344)..(352): a, c, t, g, unknown or other
  misc_feature (344)..(352): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactacttcctagagacacgctgagcgggctggcaaggcgcatagnnnnnnnnn

SEQ ID NO: 734 - DNA, 349 bp, Homo sapiens
  misc_feature: GYAE6OF01B7PMI.7.10.A10.1.454.CMB.1.raw
  modified_base (343)..(349): a, c, t, g, unknown or other
  misc_feature (343)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnnnnn

SEQ ID NO: 735 - DNA, 346 bp, Homo sapiens
  misc_feature: GYAE6OF01CF0KJ.7.10.A10.1.454.CMB.1.raw
  modified_base (342)..(346): a, c, t, g, unknown or other
  misc_feature (342)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggcaccctcctccaagagcacctctgggggcacagcggccctgggctgcctggtcaaggactacttcctagagacacgctgagcgggctggcaaggcgcatagnnnnn

SEQ ID NO: 736 - DNA, 345 bp, Homo sapiens
  misc_feature: GYAE6OF01BIE65.7.10.A10.1.454.CMB.1.raw
  modified_base (342)..(345): a, c, t, g, unknown or other
  misc_feature (342)..(345): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggctacttcctagagacacgctgagcgggctggcaaggcgcatagnnnn

SEQ ID NO: 737 - DNA, 348 bp, Homo sapiens
  misc_feature: GYAE6OF01C7Y7B.7.10.A10.1.454.CMB.1.raw
  modified_base (342)..(348): a, c, t, g, unknown or other
  misc_feature (342)..(348): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggctacttcctagagacacgctgagcgggctggcaaggcgcatagnnnnnnn

SEQ ID NO: 738 - DNA, 372 bp, Homo sapiens
  misc_feature: GYAE6OF01BDWEA.7.10.A10.1.454.CMB.1.raw
  modified_base (350)..(372): a, c, t, g, unknown or other
  misc_feature (350)..(372): n is a, c, g, or t
tcagcgtgtctctacacgaccggtgctcgatttagcgtcgatctccaggggacaacgccaagaagtcactgtactctacaaatgaacagccctgagagccgaggacacggcccgtgtattactgtgtgagagataagtccgggtatacacttggatagaagtgcttattacattgacctactggggccagggaaccctcgtcgaccgtctcctcagcctccaccaagggcccatcggtctcccctggccaccctcctccaagagcacctctcgggggcacagcggccctgggctgcctggtcaaggctacttcctagagacacgctgagcgggctggcaaggcgcatagnnnnnnnnnnnnnnnnnnnnnnn

SEQ ID NO: 739 - DNA, 349 bp, Homo sapiens
  misc_feature: GYAE6OF01DPKSB.7.10.A10.1.454.CMB.1.raw
  modified_base (345)..(349): a, c, t, g, unknown or other
  misc_feature (345)..(349): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggccaccctcctccaagacgcacctcgtgggggcacagcggccctgggctgcctggtcaaggactacttcctagagacacgctgagcgggctggcaaggcgcatagnnnnn

SEQ ID NO: 740 - DNA, 380 bp, Homo sapiens
  misc_feature: GYAE6OF01EH01T.7.10.A10.1.454.CMB.1.raw
  modified_base (349)..(380): a, c, t, g, unknown or other
  misc_feature (349)..(380): n is a, c, g, or t
tcagcgtgtctctacacgaccggtgctcgatttagcgtcgatctcaggggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctgccaccctcctccaagagcacctctggggcacagcggccctgggctgcctggtcaaggactacgttccgtagagacgacgctgagcgggactggcaaggcgacaagtagnnnnnnnnnnnnnnnnnnnnnnnnnnnnnnnn

SEQ ID NO: 741 - DNA, 345 bp, Homo sapiens
  misc_feature: GYAE6OF01ESX77.7.10.A10.1.454.CMB.1.raw
  modified_base (343)..(345): a, c, t, g, unknown or other
  misc_feature (343)..(345): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatccggtcttccccctggcaccctcctccaagagccacctctggggcacagcggccctgggctgcctggtcaaggactacttcctagagacacgctgagcgggctggcaaggcgcatagnnn

SEQ ID NO: 742 - DNA, 346 bp, Homo sapiens; identical to SEQ ID NO: 713
  misc_feature: GYAE6OF01B0WR7.7.10.A10.1.454.CMB.1.raw
  modified_base (343)..(346): a, c, t, g, unknown or other
  misc_feature (343)..(346): n is a, c, g, or t

SEQ ID NO: 743 - DNA, 345 bp, Homo sapiens
  misc_feature: GYAE6OF01DWIFD.7.10.A10.1.454.CMB.1.raw
  modified_base (342)..(345): a, c, t, g, unknown or other
  misc_feature (342)..(345): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnn

SEQ ID NO: 744 - DNA, 344 bp, Homo sapiens
  misc_feature: GYAE6OF01CXEXN.7.10.A10.1.454.CMB.1.raw
  modified_base (342)..(344): a, c, t, g, unknown or other
  misc_feature (342)..(344): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggctacttcctagagacacgctgagcgggctggcaaggcgcatagnnn

SEQ ID NO: 745 - DNA, 351 bp, Homo sapiens
  misc_feature: GYAE6OF01B4KZ8.7.10.A10.1.454.CMB.1.raw
  modified_base (335)..(335): a, c, t, g, unknown or other
  misc_feature (335)..(335): n is a, c, g, or t
  modified_base (342)..(351): a, c, t, g, unknown or other
  misc_feature (342)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggccaccctcctccaagagcacctctgggggcacagcggcctgggctgcctggtcaaggctacttcctagagacacgctgagcgggctggcaaggcncgatagnnnnnnnnnn

SEQ ID NO: 746 - DNA, 349 bp, Homo sapiens; identical to SEQ ID NO: 734
  misc_feature: GYAE6OF01CDEXU.7.10.A10.1.454.CMB.1.raw
  modified_base (343)..(349): a, c, t, g, unknown or other
  misc_feature (343)..(349): n is a, c, g, or t

SEQ ID NO: 747 - DNA, 355 bp, Homo sapiens
  misc_feature: GYAE6OF01AVEYJ.7.10.A10.1.454.CMB.1.raw
  modified_base (343)..(355): a, c, t, g, unknown or other
  misc_feature (343)..(355): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactgggccagggaaccctcgtcaccgtctcctcagcctccaccaagggcccatccggtcttccccctggccacccctcctccaagagcacctctggggcacagcggccctgggctgcctggtcaaggactacttcctaggacacgctgagcgggctggcaaggcgcatagnnnnnnnnnnnnn

SEQ ID NO: 748 - DNA, 346 bp, Homo sapiens; identical to SEQ ID NO: 735
  misc_feature: GYAE6OF01CWWR9.7.10.A10.1.454.CMB.1.raw
  modified_base (342)..(346): a, c, t, g, unknown or other
  misc_feature (342)..(346): n is a, c, g, or t

SEQ ID NO: 749 - DNA, 356 bp, Homo sapiens
  misc_feature: GYAE6OF01D5MLS.7.10.A10.1.454.CMB.1.raw
  modified_base (348)..(356): a, c, t, g, unknown or other
  misc_feature (348)..(356): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatccggtcttccccctggccaccctcctccaagcgcacctcgtgggggcacagccggccctgggctgcctggtcaaggactacttcctagagacacgctgagcgggctgcgaaggcgcatagnnnnnnnnn

SEQ ID NO: 750 - DNA, 348 bp, Homo sapiens
  misc_feature: GYAE6OF01BCI4C.7.10.A10.1.454.CMB.1.raw
  modified_base (345)..(348): a, c, t, g, unknown or other
  misc_feature (345)..(348): n is a, c, g, or t
tcagcgtgtctctacacgaccggtgctcgatttagcgtcgatctcaggggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggacctaacttcctagagacacgctgagcgggctggcaaggcgcatagnnnn

SEQ ID NO: 751 - DNA, 346 bp, Homo sapiens
  misc_feature: GYAE6OF01CL6BD.7.10.A10.1.454.CMB.1.raw
  modified_base (342)..(346): a, c, t, g, unknown or other
  misc_feature (342)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagtggccctgggctgcctggtcaaggctacttcctagagacacgctgagcgggctggcaaggcgcatagnnnnn

SEQ ID NO: 752 - DNA, 347 bp, Homo sapiens
  misc_feature: GYAE6OF01BZ61G.7.10.A10.1.454.CMB.1.raw
  modified_base (343)..(347): a, c, t, g, unknown or other
  misc_feature (343)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttcccctggcaccctcctccaagacgcacctctgggggcacagcggccctgggcctgccctggtcaaggactacttcctagagacacgctgagcggctggcaaggcgcatagnnnnn

SEQ ID NO: 753 - DNA, 642 bp, Homo sapiens
  misc_feature: GYAE6OF01ASU3V.7.10.A10.1.454.CMB.1.raw
  modified_base (509)..(509): a, c, t, g, unknown or other
  misc_feature (509)..(509): n is a, c, g, or t
  modified_base (518)..(518): a, c, t, g, unknown or other
  misc_feature (518)..(518): n is a, c, g, or t
tcagcgtgtctctacacgaccggtgctcgatttagcgtcgatctcagggactaacgtccggaagaaggtcactgtactacctacgaaatgaacagcctggagagccggagggaccacggccgtgtattacctcgtggtcgacgagactaaggtccgggtatcgacttggataggaagtcgacttattacgattacgactaccgtggggccagggaacccctcgtccaccgtctcctcagcctccaccaggcccagtccggtccttccccgaggccacccctcctaccaagacgtcaccgtcgtcggggacacgacggccggccgtgggacctacgtaccgttaggtacgaacggtacctaccgtaccgtaaggacgaccgacggcgtcggaccggtcgggccgtcgggacgaacgggtccgtacgtagtacggtctactagtacgacgtacgacagtcgtagtcgagtagacgacgtcgcgtagtgactagttacttactgactctacncacgacgcnctcgtacgtagtagtagtagtatcactatacgttacgtacgtatacgtacgtagtcgtacgtcgtacgtcgtccgtccgtacgtcgaccgtacggacgtacgtacgaacgacgtacgtacgtcg

SEQ ID NO: 754 - DNA, 376 bp, Homo sapiens
  misc_feature: GYAE6OF01DCLHY.7.10.A10.1.454.CMB.1.raw
  modified_base (258)..(258): a, c, t, g, unknown or other
  misc_feature (258)..(258): n is a, c, g, or t
  modified_base (342)..(376): a, c, t, g, unknown or other
  misc_feature (342)..(376): n is a, c, g, or t
tcagcgtgtctctacacgaccggtgctcgatttagcgtcgatctcagggacaacgcctaagaagtcactgtatctacaaatgaacagcctggagagccgaggacacggccgtgtattactgtgtgagaggataagtccgggtatcacttggatagaagtgcttattacattgactactggggccagggaaccctcgtcaccgtctcctcagcctccaccaagggcccatcggtcttcccctggcacctcctccaagancactctggggcacagcggccctgggctgcctggtcaaggctacttcctagagacacgcgtgagcgggctggcaaggcgcatagnnnnnnnnnnnnnnnnnnnnnnnnnnnnnnnnnnn

SEQ ID NO: 755 - DNA, 347 bp, Homo sapiens
  misc_feature: GYAE6OF01D0W90.7.10.A10.1.454.CMB.1.raw
  modified_base (344)..(347): a, c, t, g, unknown or other
  misc_feature (344)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagacgcacctctgggggcacagcggccctgggctgcctggtcaaggactacttcctagagacacgctgagcgggctggcaaggcgcatagnnnn

SEQ ID NO: 756 - DNA, 347 bp, Homo sapiens
  misc_feature: GYAE6OF01DEP4R.7.10.A10.1.454.CMB.1.raw
  modified_base (343)..(347): a, c, t, g, unknown or other
  misc_feature (343)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnnn

SEQ ID NO: 757 - DNA, 353 bp, Homo sapiens
  misc_feature: GYAE6OF01BU9WI.7.10.A10.1.454.CMB.1.raw
  modified_base (344)..(353): a, c, t, g, unknown or other
  misc_feature (344)..(353): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagacgcacctctgggggcacagcggccctgggctgcctggtcaaggactacttcctagagacacgctgagcggctggcgaaggcgcatagnnnnnnnnnn

SEQ ID NO: 758 - DNA, 359 bp, Homo sapiens
  misc_feature: GYAE6OF01D4330.7.10.A10.1.454.CMB.1.raw
  modified_base (352)..(359): a, c, t, g, unknown or other
  misc_feature (352)..(359): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctcctcagcctccaccaagggcccatccggtccttccccctggccacccctcctccaagacgccacctcgtgggggcacagcggccctgggctgcctggtcaaggactacttcctagacgacacgctgagcgggctggcaaggcgcatagnnnnnnnn

SEQ ID NO: 759 - DNA, 346 bp, Homo sapiens
  misc_feature: GYAE6OF01EDW6N.7.10.A10.1.454.CMB.1.raw
  modified_base (343)..(346): a, c, t, g, unknown or other
  misc_feature (343)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactgggggccagggaaccctcgtcaccgtctcctcagcctccaccaaggcccatcggtcttccccctggccaccctcctccaagagcacctctgggggcacagcggccctgggctgcctggtcaaggactactcctagagacacgctgagcgggctggcaaggcgcatagnnnn

SEQ ID NO: 760 - DNA, 349 bp, Homo sapiens
  misc_feature: GYAE6OF01DNW2U.7.10.A10.1.454.CMB.1.raw
  modified_base (342)..(349): a, c, t, g, unknown or other
  misc_feature (342)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccctggccaccctcctccaagagcacctctgggggcacagcggccctgggctgcctggtcaaggctacttcctagagacacgctgagcgggctggcaaggcgcatagnnnnnnnn

SEQ ID NO: 761 - DNA, 352 bp, Homo sapiens
  misc_feature: GYAE6OF01BN088.7.10.A10.1.454.CMB.1.raw
  modified_base (345)..(352): a, c, t, g, unknown or other
  misc_feature (345)..(352): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactacttcctagagacacgctgagcgggctggcaaggcgcatagnnnnnnnn

SEQ ID NO: 762 - DNA, 402 bp, Homo sapiens
  misc_feature: GYAE6OF01B2Y53.7.10.A10.1.454.CMB.1.raw
  modified_base (355)..(402): a, c, t, g, unknown or other
  misc_feature (355)..(402): n is a, c, g, or t
tcagcgtgtctctacacgaccggtgctcgatttagcgtcgatctcagggacaacgccaaggtaagtcactgtattctacaaatgaacagcctgagagcccgaggacacggccgtggtattactgtgtgaggagataagtccgggtatcacttggatagaagtgcttattacattgactactgggaccagggaaccctcgtcaccgtctcctcagcctccaccaagggcccactccggtccttcccccgtggccacccctccgtccaagagcacctctgggggcacgagcggaccctggctgcctggtcaaggactacttccagagcacgctgacgcggctggcaaggcgcatagnnnnnnnnnnnnnnnnnnnnnnnnnnnnnnnnnnnnnnnnnnnnnnnn

SEQ ID NO: 763 - DNA, 356 bp, Homo sapiens
  misc_feature: GYAE6OF01BSJTK.7.10.A10.1.454.CMB.1.raw
  modified_base (240)..(240): a, c, t, g, unknown or other
  misc_feature (240)..(240): n is a, c, g, or t
  modified_base (269)..(269): a, c, t, g, unknown or other
  misc_feature (269)..(269): n is a, c, g, or t
  modified_base (349)..(356): a, c, t, g, unknown or other
  misc_feature (349)..(356): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccggtatcacttggatagaagtgcttattacattgactacgtggggccagggaaccctcgtcaccgtctcctcagcctccaccaaggcccatcggtcctttcccccnggccaccctcctaccaagacgcacctcgnggggcacagccggcctgggctgcctggtcaaggactacttacctagacgacacgctgagcggctggcaaggcgacatagnnnnnnnn

SEQ ID NO: 764 - DNA, 347 bp, Homo sapiens
  misc_feature: GYAE6OF01B5672.7.10.A10.1.454.CMB.1.raw
  modified_base (344)..(347): a, c, t, g, unknown or other
  misc_feature (344)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactacttcctagagacacgctgagcgggctggcaaggcgcatagnnnn

SEQ ID NO: 765 - DNA, 345 bp, Homo sapiens
  misc_feature: GYAE6OF01BP2IA.7.10.A10.1.454.CMB.1.raw
  modified_base (342)..(345): a, c, t, g, unknown or other
  misc_feature (342)..(345): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggcaccctcctccaagagcacctctgggggcacagcggccctgggctgcctggtcaaggactacttcctagagacacgctgagcgggctggcaaggcgcatagnnnn

SEQ ID NO: 766 - DNA, 393 bp, Homo sapiens
  misc_feature: GYAE6OF01ET0P1.7.10.A10.1.454.CMB.1.raw
  modified_base (352)..(352): a, c, t, g, unknown or other
  misc_feature (352)..(352): n is a, c, g, or t
  modified_base (354)..(393): a, c, t, g, unknown or other
  misc_feature (354)..(393): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatccggtcttccccctggccaccctcctccaagagcacctctgggggcacagcgccctgggctgcctggtcaggactactcctagagacacgctgagcgggctcggagcccaaaggcgtcgataggcngnnnnnnnnnnnnnnnnnnnnnnnnnnnnnnnnnnnnnnnn

SEQ ID NO: 767 - DNA, 419 bp, Homo sapiens
  misc_feature: GYAE6OF01BAU4Q.7.10.A10.1.454.CMB.1.raw
  modified_base (363)..(363): a, c, t, g, unknown or other
  misc_feature (363)..(363): n is a, c, g, or t
  modified_base (369)..(377): a, c, t, g, unknown or other
  misc_feature (369)..(377): n is a, c, g, or t
  modified_base (380)..(419): a, c, t, g, unknown or other
  misc_feature (380)..(419): n is a, c, g, or t
tcagcgtgtctctacacgaccggtgctcgattttagcgtcgatctctaggggtacgaacgccaagaagtcactgtagtctacaaatgaacagcctgagagccgaggacacggccgtgtattactgtgtgagagataagtccgggtatcacttggatagaagtgcttattacgattggactactggggccagggaaccctcgtcaccgtctcctcagcctccaccaaggggccccagtcggtcttcccccgtggccacccctcctccaagacgccaccgtcgtgggggcaccagaccggcccgtggggctggcctggtcaaggacctacttcctagagacacgctgaggcggctcggcaaggcncatagnnnnnnnnngcnnnnnnnnnnnnnnnnnnnnnnnnnnnnnnnnnnnnnnnn

SEQ ID NO: 768 - DNA, 347 bp, Homo sapiens
  misc_feature: GYAE6OF01CILK9.7.10.A10.1.454.CMB.1.raw
  modified_base (343)..(347): a, c, t, g, unknown or other
  misc_feature (343)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggccaccctcctccaagagcacctctgggggcacagcggccctgggctgcctggtcaaggactacttcctagagacacgctgagcgggctggcaaggcgcatagnnnnn

SEQ ID NO: 769 - DNA, 340 bp, Homo sapiens
  misc_feature: GYAE6OF01ER6UL.7.10.A10.1.454.CMB.1.raw
  modified_base (335)..(340): a, c, t, g, unknown or other
  misc_feature (335)..(340): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtctcccctgcacctctccagagcacctctggggcacagcggccctgggctgcctggtcaggactacttcctagagacacgctggagcgggctggcaaggcgcatagnnnnnn

SEQ ID NO: 770 - DNA, 348 bp, Homo sapiens
  misc_feature: GYAE6OF01ELAHM.7.10.A10.1.454.CMB.1.raw
  modified_base (343)..(348): a, c, t, g, unknown or other
  misc_feature (343)..(348): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnnnn

SEQ ID NO: 771 - DNA, 356 bp, Homo sapiens
  misc_feature: GYAE6OF01EID5J.7.10.A10.1.454.CMB.1.raw
  modified_base (338)..(338): a, c, t, g, unknown or other
  misc_feature (338)..(338): n is a, c, g, or t
  modified_base (344)..(356): a, c, t, g, unknown or other
  misc_feature (344)..(356): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggcaccctcctccaagagcacctctggggcacgagcggccctgggctgcctggtcaaggctacttcctagacgacacgctgagcgggctggcaagggcncatagnnnnnnnnnnnnn

SEQ ID NO: 772 - DNA, 350 bp, Homo sapiens
  misc_feature: GYAE6OF01BIPN3.7.10.A10.1.454.CMB.1.raw
  modified_base (343)..(350): a, c, t, g, unknown or other
  misc_feature (343)..(350): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccggtatcacttggatagaagtgcttattacattgactactggggccagggaacccctcgtcaccgtctcctcagccctccaccaagggcccatcggtcttccccctggcaccctcctccaagagcacctctgggggcacagcggcctgggctgcctggtcaaggactacttcctagagacacgctgagcgggctggcaaggcgcatagnnnnnnnn

SEQ ID NO: 773 - DNA, 351 bp, Homo sapiens
  misc_feature: GYAE6OF01C8QUK.7.10.A10.1.454.CMB.1.raw
  modified_base (262)..(262): a, c, t, g, unknown or other
  misc_feature (262)..(262): n is a, c, g, or t
  modified_base (345)..(351): a, c, t, g, unknown or other
  misc_feature (345)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcaccnctgggggcacagcggccctgggctgcctggtcaaggacctacttccctagagacacgctgagcgggctggcaaggcgcatagnnnnnnn

SEQ ID NO: 774 - DNA, 349 bp, Homo sapiens
  misc_feature: GYAE6OF01EVHPL.7.10.A10.1.454.CMB.1.raw
  modified_base (344)..(349): a, c, t, g, unknown or other
  misc_feature (344)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactacttcctagagacacgctgagcgggctggcaaggcgcatagnnnnnn

SEQ ID NO: 775 - DNA, 352 bp, Homo sapiens
  misc_feature: GYAE6OF01BS5QN.7.10.A10.1.454.CMB.1.raw
  modified_base (325)..(325): a, c, t, g, unknown or other
  misc_feature (325)..(325): n is a, c, g, or t
  modified_base (348)..(352): a, c, t, g, unknown or other
  misc_feature (348)..(352): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccggtatcacttggatagaagtgcttattacattgactactggggccagggaaccctcgtcaccgtctcctcagcctccaccaagggcccatcggtcttccccctggccaccctcctccaagacgcacctcgtgggggcacaggccggccctggggctgcctggtcaaggactacttccgtagagacactcngagcggctggcaaggcgcatagnnnnn

SEQ ID NO: 776 - DNA, 351 bp, Homo sapiens
  misc_feature: GYAE6OF01CRV9X.7.10.A10.1.454.CMB.1.raw
  modified_base (265)..(265): a, c, t, g, unknown or other
  misc_feature (265)..(265): n is a, c, g, or t
  modified_base (338)..(338): a, c, t, g, unknown or other
  misc_feature (338)..(338): n is a, c, g, or t
  modified_base (344)..(351): a, c, t, g, unknown or other
  misc_feature (344)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtccttccccctggccaccctcctccaagagcacctntgggggcacagcggccctgggctgcctggtcaaggctacttcctagagacacgctgagcgggctggcaaggcncatagnnnnnnnn

SEQ ID NO: 777 - DNA, 339 bp, Homo sapiens
  misc_feature: GYAE6OF01EG79V.7.10.A10.1.454.CMB.1.raw
  modified_base (333)..(339): a, c, t, g, unknown or other
  misc_feature (333)..(339): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccacaaggccatcggtctcccctgcaccctcctcagagcacctctggggcacagcggccctggctgcctggtcaaggactactcctagagacacgctgagcgggctggacaaggcgcatagnnnnnnn

SEQ ID NO: 778 - DNA, 347 bp, Homo sapiens
  misc_feature: GYAE6OF01D16HR.7.10.A10.1.454.CMB.1.raw
  modified_base (341)..(347): a, c, t, g, unknown or other
  misc_feature (341)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcgtcttcccctgccaccctcctccagagcacctctggggcacagccggccctgggctgcctggtcaaggctacttcctagagacacgctggacgcgggctggcaaggcgtcatagnnnnnnn

SEQ ID NO: 779 - DNA, 384 bp, Homo sapiens
  misc_feature: GYAE6OF01CS56P.7.10.A10.1.454.CMB.1.raw
  modified_base (284)..(284): a, c, t, g, unknown or other
  misc_feature (284)..(284): n is a, c, g, or t
  modified_base (364)..(384): a, c, t, g, unknown or other
  misc_feature (364)..(384): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataaggtccgggtatcacttggatagaagtgcttatacattgactacgtggggccagggaaccctcgtccaccgtctcctcacgccctccaccgaaggcccagtccggtccttccccctggccacccctcctcaagacgcacccgtgcggggcaacncggcgccctgggctgcctggtccaaggcttacttcctaagacgacacgctggacgcgggtctggacaaggcgacaagtgnnnnnnnnnnnnnnnnnnnnn

SEQ ID NO: 780 - DNA, 399 bp, Homo sapiens
  misc_feature: GYAE6OF01DK9PV.7.10.A10.1.454.CMB.1.raw
  modified_base (381)..(399): a, c, t, g, unknown or other
  misc_feature (381)..(399): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtccttccccgtggccacccctcctccaagacgccaccgtcgtgggggccacgacggccggccccgtggggcctcgcccgtgggtaccaagggtaccttaccttccgtaggacgaccacgcgtggacggcgggcgtggcgaaggcgcagtagnnnnnnnnnnnnnnnnnnn

SEQ ID NO: 781 - DNA, 354 bp, Homo sapiens
  misc_feature: GYAE6OF01CYRIE.7.10.A10.1.454.CMB.1.raw
  modified_base (347)..(354): a, c, t, g, unknown or other
  misc_feature (347)..(354): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagccctccaccaagggcccatccggtcttccccctggccaccctcctccaagagcacctctgggggcacagcggcccctgggctgcctggtcaaggactacttcctagagacacgctgagcgggctggcaaggcgcatagnnnnnnnn

SEQ ID NO: 782 - DNA, 356 bp, Homo sapiens
  misc_feature: GYAE6OF01DI3SQ.7.10.A10.1.454.CMB.1.raw
  modified_base (348)..(356): a, c, t, g, unknown or other
  misc_feature (348)..(356): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactgggccagggaaccctcgtcaccgtctcctcagcctccaccaaggcccatcggtctccccctggccaccctcctaccaagacgcacctctgggggcacagcgccctgggctgcctggtcaaggcctacttcctaagacgacgacgctagagcgggctggccaaggcgtcatagnnnnnnnnn

SEQ ID NO: 783 - DNA, 351 bp, Homo sapiens
  misc_feature: GYAE6OF01A6LVT.7.10.A10.1.454.CMB.1.raw
  modified_base (345)..(351): a, c, t, g, unknown or other
  misc_feature (345)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatccggtcttccccctggccaccctcctccaagacgccacctcgtggggcacgagcggccctgggctgcctggtcaggacctactcctagagacacgctgagcgggctggcaaggcgcatgnnnnnnn

SEQ ID NO: 784 - DNA, 347 bp, Homo sapiens
  misc_feature: GYAE6OF01ATZX4.7.10.A10.1.454.CMB.1.raw
  modified_base (338)..(338): a, c, t, g, unknown or other
  misc_feature (338)..(338): n is a, c, g, or t
  modified_base (344)..(347): a, c, t, g, unknown or other
  misc_feature (344)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctcgtgggggcacagcggccctgggctgcctggtcaaggctacttcctagagacacgctgagcgggctggcaaggcncatagnnnn

SEQ ID NO: 785 - DNA, 349 bp, Homo sapiens
  misc_feature: GYAE6OF01EBHED.7.10.A10.1.454.CMB.1.raw
  modified_base (343)..(349): a, c, t, g, unknown or other
  misc_feature (343)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggcaccctcctccaagagcacctcgtgggggcacagcggccctgggctgcctggtcaaggactacttcctagagacacgctgagcgggctggcaaggcgcatagnnnnnnn

SEQ ID NO: 786 - DNA, 381 bp, Homo sapiens
  misc_feature: GYAE6OF01EKPPI.7.10.A10.1.454.CMB.1.raw
  modified_base (362)..(381): a, c, t, g, unknown or other
  misc_feature (362)..(381): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctcctcagcctccaccaagggcccatccggtccttccccctggccacccctcctccaacgagccacctcgtcgggggcaacaggcggccctcgggctcgccctgggtaccaaggacctacttcctagagacacgctggagcgggctggcgaaggcgcatgnnnnnnnnnnnnnnnnnnnn

SEQ ID NO: 787 - DNA, 351 bp, Homo sapiens
  misc_feature: GYAE6OF01BFJJC.7.10.A10.1.454.CMB.1.raw
  modified_base (344)..(351): a, c, t, g, unknown or other
  misc_feature (344)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaacccctcgtcaccgtctcctcagcctccaccaagggcccatcggtcttccccctggcaccctcctccagagcacctctgggggcacgagcggccctgggctgcctggtcaggactacttcctagagacacgctgagcgggctggcaagggcgcatagnnnnnnnn

SEQ ID NO: 788 - DNA, 472 bp, Homo sapiens
  misc_feature: GYAE6OF01A7A26.7.10.A10.1.454.CMB.1.raw
  modified_base (253)..(253): a, c, t, g, unknown or other
  misc_feature (253)..(253): n is a, c, g, or t
  modified_base (393)..(393): a, c, t, g, unknown or other
  misc_feature (393)..(393): n is a, c, g, or t
  modified_base (421)..(421): a, c, t, g, unknown or other
  misc_feature (421)..(421): n is a, c, g, or t
  modified_base (423)..(429): a, c, t, g, unknown or other
  misc_feature (423)..(429): n is a, c, g, or t
  modified_base (431)..(472): a, c, t, g, unknown or other
  misc_feature (431)..(472): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataaggtccgggtatcacttggataggaagtgtacttattactattgactacgtggggccagggaaccctcgtcaccgtctcctcacgcctccacgaacggcccatccggtccttcccctggcccncccctcctaccaagacgcctaccgtcggtggggaccacgacggcccgggcccgttggggcctcggcccgtaggtaccgaaagggtaccttaaccttcccgtaaggaaccgacctaccggcgttagggacggccggggtcngggaccaaaggggcctacgaagtagcgngnnnnnnngnnnnnnnnnnnnnnnnnnnnnnnnnnnnnnnnnnnnnnnnnn

SEQ ID NO: 789 - DNA, 341 bp, Homo sapiens
  misc_feature: GYAE6OF01EJ4SS.7.10.A10.1.454.CMB.1.raw
  modified_base (237)..(237): a, c, t, g, unknown or other
  misc_feature (237)..(237): n is a, c, g, or t
  modified_base (260)..(260): a, c, t, g, unknown or other
  misc_feature (260)..(260): n is a, c, g, or t
  modified_base (330)..(330): a, c, t, g, unknown or other
  misc_feature (330)..(330): n is a, c, g, or t
  modified_base (334)..(341): a, c, t, g, unknown or other
  misc_feature (334)..(341): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctcctcagcctccaccaaggcccatcggtctccccngccaccctctccagagcacctcnggggcacagcggccctgggctgcctgtcaaggactacttcagagacacgctggagcgggctggcaaggcnatgnnnnnnnn

SEQ ID NO: 790 - DNA, 400 bp, Homo sapiens
  misc_feature: GYAE6OF01CUTXZ.7.10.A10.1.454.CMB.1.raw
  modified_base (378)..(400): a, c, t, g, unknown or other
  misc_feature (378)..(400): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctcctcagcctccaccaagggcccagtccggtccttcccccgtggccacccctcctccaaagacgcaccgtcgtgggggcacgagccggacccgttgggctcggccctggtccaaagggtacttaccttaccgtagagaccacgctggagcgggctggacaaggccgtcataggcnnnnnnnnnnnnnnnnnnnnnnn

SEQ ID NO: 791 - DNA, 363 bp, Homo sapiens
  misc_feature: GYAE6OF01B471D.7.10.A10.1.454.CMB.1.raw
  modified_base (347)..(347): a, c, t, g, unknown or other
  misc_feature (347)..(347): n is a, c, g, or t
  modified_base (353)..(363): a, c, t, g, unknown or other
  misc_feature (353)..(363): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctggtcaccgtctcctcagcctccaccaaggcccatcggtcttccccctggccacccctcctccaagacgcacctcgtgggggcacgagccggccctgggctcgcctggtcaaggacctacttcctagagacacgactggagcgggctgcgaaggcgnagtagnnnnnnnnnnn

SEQ ID NO: 792 - DNA, 362 bp, Homo sapiens
  misc_feature: GYAE6OF01AQB4U.7.10.A10.1.454.CMB.1.raw
  modified_base (356)..(362): a, c, t, g, unknown or other
  misc_feature (356)..(362): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctcctcagcctccaccaacgggcccagtccggtccttccccctggccaccctcctccaagacgccacctcgtgggggcacagccggccctgggctgccgtggtcaaggactaccttcctagagacacgctgagcgggctggcaaggcgcagtagnnnnnnn

SEQ ID NO: 793 - DNA, 412 bp, Homo sapiens
  misc_feature: GYAE6OF01CQS97.7.10.A10.1.454.CMB.1.raw
  modified_base (395)..(412): a, c, t, g, unknown or other
  misc_feature (395)..(412): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtccaccgtctcctcagcctccaccgaacgggcccattccggtccttcccccctggcccacccctcctaccaagcgccacccgtcggtgggggccaacgacggccggcccctggggcctgcccgtggtacaacggtaccttacctttccgaaggacgaccaccgtccgtggacggcggggtctgggacaacggcgacaatgnnnnnnnnnnnnnnnnnn

SEQ ID NO: 794 - DNA, 369 bp, Homo sapiens
  misc_feature: GYAE6OF01E1SO6.7.10.A10.1.454.CMB.1.raw
  modified_base (340)..(340): a, c, t, g, unknown or other
  misc_feature (340)..(340): n is a, c, g, or t
  modified_base (364)..(364): a, c, t, g, unknown or other
  misc_feature (364)..(364): n is a, c, g, or t
  modified_base (367)..(369): a, c, t, g, unknown or other
  misc_feature (367)..(369): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctcctcagcctccaaccgaagggcccagttccggtccttccccctggccacccctcctccaagagccacctcgtgggggcacaggccggccctggggctcgccgtggtaccaaggctacgttcctagacgtaccaccgngacgcgggtctggcaagggcatanagnnn

SEQ ID NO: 795 - DNA, 458 bp, Homo sapiens
  misc_feature: GYAE6OF01ET7AL.7.10.A10.1.454.CMB.1.raw
  modified_base (393)..(393): a, c, t, g, unknown or other
  misc_feature (393)..(393): n is a, c, g, or t
  modified_base (402)..(458): a, c, t, g, unknown or other
  misc_feature (402)..(458): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccacgggaaccctcgtcaccgtctcctcacgcctccaaccgaacgggcccctaagtcccggtccttcccccctggcccaaccccctcctaccgaagacgcctaccgtcgtgggggccacgacgtccgggccctgggcctggccctaggtaccaaaggtaccttacgttcccaagagtaccacgctggaggcgggtctggaccgaaagggcccgnaagtagcgnnnnnnnnnnnnnnnnnnnnnnnnnnnnnnnnnnnnnnnnnnnnnnnnnnnnnnnnn

SEQ ID NO: 796 - DNA, 503 bp, Homo sapiens
  misc_feature: GYAE6OF01BBDGN.7.10.A10.1.454.CMB.1.raw
  modified_base (273)..(273): a, c, t, g, unknown or other
  misc_feature (273)..(273): n is a, c, g, or t
  modified_base (449)..(449): a, c, t, g, unknown or other
  misc_feature (449)..(449): n is a, c, g, or t
  modified_base (452)..(452): a, c, t, g, unknown or other
  misc_feature (452)..(452): n is a, c, g, or t
  modified_base (454)..(503): a, c, t, g, unknown or other
  misc_feature (454)..(503): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctcctcacgcctccaccgaagggcccagtccggtccttccccccgtggccctacccctcctaccaacggacnccaccgtcgtcgggggccaacgacggcccggcccctggggcctcggcccgttagggtaccgtaaacggtacctttaacccgttaccccgtaaggacgtaacccgaccggtccgtacgggaaccgggtcccgggggccttacggggaacccgaaaggggccgaaccgtaagtaacgngancnnnnnnnnnnnnnnnnnnnnnnnnnnnnnnnnnnnnnnnnnnnnnnnnnn

SEQ ID NO: 797 - DNA, 384 bp, Homo sapiens
  misc_feature: GYAE6OF01EDSXM.7.10.A10.1.454.CMB.1.raw
  modified_base (245)..(245): a, c, t, g, unknown or other
  misc_feature (245)..(245): n is a, c, g, or t
  modified_base (366)..(366): a, c, t, g, unknown or other
  misc_feature (366)..(366): n is a, c, g, or t
  modified_base (368)..(384): a, c, t, g, unknown or other
  misc_feature (368)..(384): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccacgggaaccctcgtccaccgtcctcctcacgcctccaccaaggcccatccggtccttcccccnggccacccctcctccaagacgccaccgtcgtcgggcacgcgccggccgtggcgtcgtccgtcggtcgtacctactacgtagacgacgcgcgtggcggcggcgtcggacgacggcgacgagngnnnnnnnnnnnnnnnnn

SEQ ID NO: 798 - DNA, 370 bp, Homo sapiens
  misc_feature: GYAE6OF01DMLR7.7.10.A10.1.454.CMB.1.raw
  modified_base (356)..(356): a, c, t, g, unknown or other
  misc_feature (356)..(356): n is a, c, g, or t
  modified_base (362)..(370): a, c, t, g, unknown or other
  misc_feature (362)..(370): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaacccctcgtcaccgtctcctcacgccctccaccaagggccccatccggtccttccccctggccacccctccctcccaagacgcacctcgtgggggcacagcggccctgggctcgccgtggtcaaggactaccttccgtagagacacgctggaggcggtcgtggcaaggcncatagnnnnnnnnn

SEQ ID NO: 799 - DNA, 456 bp, Homo sapiens
  misc_feature: GYAE6OF01CWOLT.7.10.A10.1.454.CMB.1.raw
  modified_base (422)..(456): a, c, t, g, unknown or other
  misc_feature (422)..(456): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaaccgaagggcccaagtccggtacctttccccccgtggccacccctccctaccaaaggtacgccaaccgtcgtcggggggaccacgacggccggacccgttgggcgtcgcccgtcggtaccgaaacgggtaaccttaccgtttacccgtaagaacgaaccgacggccttagggacgcggggactcgggacaagggccgacaaagtggannnnnnnnnnnnnnnnnnnnnnnnnnnnnnnnnnn

SEQ ID NO: 800 - DNA, 522 bp, Homo sapiens
  misc_feature: GYAE6OF01DVC5U.7.10.A10.1.454.CMB.1.raw
  modified_base (477)..(477): a, c, t, g, unknown or other
  misc_feature (477)..(477): n is a, c, g, or t
  modified_base (480)..(522): a, c, t, g, unknown or other
  misc_feature (480)..(522): n is a, c, g, or t
tcagcgtgtctctacacgaccggtgctcgatttagcgtcgatctcagggacaacgccaagaagtcactgtatctaacaaatgaacagcctgagagccgaggacacggccgtgtattactgtgtgagagataaggtccgggtatcacttggatagaagtgtcttattacattgactacgtggggccacgggaccctcgtcaccgtctcctcacgccctaccaaccgaacgggccctacgtcccggttccctttcccccgtcggccctaccccctccctaccgaaacggaccgcctacccgttcgggtcggggggaccaaccggaccgggcccgggtccccggtcggggtccgttccggcccgttacgggtaccgtaaaccgggtaccctttaaccctttaccgtaacggaacggaaccaccggtcgtacgggacgggtccgggtcggtacgggaccggaacgggccgacgtaagtagnacnnnnnnnnnnnnnnnnnnnnnnnnnnnnnnnnnnnnnnnnnnn

SEQ ID NO: 801 - DNA, 517 bp, Homo sapiens
  misc_feature: GYAE6OF01D5S7W.7.10.A10.1.454.CMB.1.raw
  modified_base (470)..(517): a, c, t, g, unknown or other
  misc_feature (470)..(517): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataggtccggtatctgttgatagagtgtacttattacattgacgttacggtcgggggacccgaacgggtaccccttcgtacctacccggtccttcctcgaccgtccccacccgaaccggaccgggtccctacgttcccggttcccctttcccccgagtcccctaccccttccaacgaaggacgccctaccgttcgggcggggaccaacgccgggcccgccggtcggctccggccgttacggtaccgaacggtactttacccgttacacgggaacaccggtaccggtcggtacggtacggggccgggtcgttacgggaccggaaggtcccgtaagtagtggannnnnnnnnnnnnnnnnnnnnnnnnnnnnnnnnnnnnnnnnnnnnnnn

SEQ ID NO: 802 - DNA, 635 bp, Homo sapiens
  misc_feature: GYAE6OF01CN96U.7.10.A10.1.454.CMB.1.raw
  modified_base (440)..(440): a, c, t, g, unknown or other
  misc_feature (440)..(440): n is a, c, g, or t
  modified_base (471)..(471): a, c, t, g, unknown or other
  misc_feature (471)..(471): n is a, c, g, or t
  modified_base (488)..(488): a, c, t, g, unknown or other
  misc_feature (488)..(488): n is a, c, g, or t
  modified_base (494)..(494): a, c, t, g, unknown or other
  misc_feature (494)..(494): n is a, c, g, or t
  modified_base (516)..(516): a, c, t, g, unknown or other
  misc_feature (516)..(516): n is a, c, g, or t
  modified_base (525)..(525): a, c, t, g, unknown or other
  misc_feature (525)..(525): n is a, c, g, or t
  modified_base (542)..(542): a, c, t, g, unknown or other
  misc_feature (542)..(542): n is a, c, g, or t
  modified_base (563)..(563): a, c, t, g, unknown or other
  misc_feature (563)..(563): n is a, c, g, or t
  modified_base (629)..(629): a, c, t, g, unknown or other
  misc_feature (629)..(629): n is a, c, g, or t
tcagcgtgtctctacacgaccggtgctcgatttagcgtcgatctctaggggacaacggccaaggaagtcccacctggttactcgtactaaatgaactaggcctgagagccgaggacacggccgtcgtaattaacgtggtgtgagaggattaagggtccgggtatcgacttgggtattaggtaagtgtacttttaagtacattgacttacgtggggccagggaaccctcgtcgaccggtctccgtcggagccgtccgacccgaagggcccctacgggttccgttccttcccccgtcggcctacccctccgtaccgaacgacgcctaccgtcggtcgggtccaacgtacgaccggtccttacgggtctcgtccgtcggtacctaacggtccgtaccgttaccccgaaggtaccgtaccgacggtacggtggaacgggtcggngttcggacgtaacgggtacgacgtaagtagntagcagatatctatacngtcatngagcggtcatactcggaactcncgacgtacnacagacgcactcgtaancgtacagacgcgagtcgacgngagtcgtagagacgacgacgcgtctagtgtacgtggtagagagtagtagagtaggtaggtggcggngcggcg

SEQ ID NO: 803 - DNA, 459 bp, Homo sapiens
  misc_feature: GYAE6OF01CSWMD.7.10.A10.1.454.CMB.1.raw
  modified_base (435)..(459): a, c, t, g, unknown or other
  misc_feature (435)..(459): n is a, c, g, or t
tcagcgtgtctctacacgaccggtgctcgatttagcgtcgatctcagggacaacgccaagaagtcactgtatctaacaaatgaacagcctgaagagccgaggacacggccgtgtattactgtgtgagagataaggtccggtatcattggatagaagtgtcttattactagttgactacgtcggggaccaacgggaccctcgtccaccgtcctcctcgactcccaccaaccgaacgggtcccacttccggttacccttccccgcggcccctaacccctcctaaccgaagacgtcctaacccgtcgggtacgggggaccaacggcggccggcccggtagggctcggtaccgtaggtacgaaacggtccttaaccgttccgaagaacgaccgacgacgtacgggacggccggtgacggaacgaacgggctaacagagnnnnnnnnnnnnnnnnnnnnnnnnn

SEQ ID NO: 804 - DNA, 707 bp, Homo sapiens
  misc_feature: GYAE6OF01BT5YA.7.10.A10.1.454.CMB.1.raw
  modified_base (480)..(480): a, c, t, g, unknown or other
  misc_feature (480)..(480): n is a, c, g, or t
  modified_base (487)..(487): a, c, t, g, unknown or other
  misc_feature (487)..(487): n is a, c, g, or t
  modified_base (542)..(542): a, c, t, g, unknown or other
  misc_feature (542)..(542): n is a, c, g, or t
tcagcgtgtctctacacgaccggtgctcgatttagcgtcgatctcagggacaacgccaagaagtcactgtatctacaaatgaacagcctgagagccggaggacaccggccgtgtattactgtgtgagagataagtccgggtatctacttggatagaagtgtcttattacattgactacgtgggccaacgggaccctcgtccaccgttcctcctcgacgtccctacccgaaccgaacgggccctagttccgggttccctttcccccgtcggccctaccccgttccctaccgaacgtacgaccctaccgtcgggtacgggaccacggaccggcccggtcccggtcgggtccgttcggtaccggttacggtaaccgtaacggttacctttaccgttaaccgaacggaaccggtaccgtaccggtacgtacgggcggtaccgggtcgtacggaacggacgggtcctaacgtaagtagctcgacngacgcgntacgcgtctagcgtcgacgacgacgacgacgacgacgacgagtacgcgtacgtancgtacgtcgcgtagtacgtgtcgtacgtcgtacggtacgacgtcggacgacgtacgtacgtcgtacgttacgtctaccgtacgtaccgacccgtaccgtaccgttacgtacggtaacgtccgtaccgacgtaccgtactaccgtacccgtacgtccggtccgtag

SEQ ID NO: 805 - DNA, 485 bp, Homo sapiens
  misc_feature: GYAE6OF01CWULV.7.10.A10.1.454.CMB.1.raw
  modified_base (293)..(293): a, c, t, g, unknown or other
  misc_feature (293)..(293): n is a, c, g, or t
  modified_base (445)..(445): a, c, t, g, unknown or other
  misc_feature (445)..(445): n is a, c, g, or t
  modified_base (448)..(485): a, c, t, g, unknown or other
  misc_feature (448)..(485): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataaggtccgggtatcacttggatagaagtgcttatacattgactacgtggggccagggaaccctgtcaccgtctcctcagccctaccaccaagggcccagtccggtccttccccctggccacccctcctaccgaaagacgccacccgtcgtcggggggccaacgnggcccgggcccttggggcctcggcccgttagggtaccgaaacggggtacctttaacctttacccccgttaaggaacgaacccgtaacccggcgtacggggaaggcccgggacggttcgggaaccgaaagggcccgaaccgtttaatacgagntcnnnnnnnnnnnnnnnnnnnnnnnnnnnnnnnnnnnnnn

SEQ ID NO: 806 - DNA, 446 bp, Homo sapiens
  misc_feature: GYAE6OF01BEH8V.7.10.A10.1.454.CMB.1.raw
  modified_base (402)..(402): a, c, t, g, unknown or other
  misc_feature (402)..(402): n is a, c, g, or t
  modified_base (404)..(446): a, c, t, g, unknown or other
  misc_feature (404)..(446): n is a, c, g, or t
tcagcgtgtctctacacgaccggtgctcgatttagcgtcgatctcaggggacaacgccaagaagtcactgtatctacaaatgaacagcctgagagccgaggacacggccgtgtattactgtgtgagagataagtccgggtatcacttggatagaagtgcttattacattgactacgtggggccaacgggaacccctcgtcaccgtctcctcagccctccaccaacgggcccaatccggtcttccccctggccacccctcctaccaagacgcctaccgtcggtcgggggcaaccgacggtcccgggccctcgggggcctcgggtccctaggggttcaaacgggtaccttaaccttcctagaacgacacgcgtgagccgggctgggacgaaggcgtacagtagnannnnnnnnnnnnnnnnnnnnnnnnnnnnnnnnnnnnnnnnnnn

SEQ ID NO: 807 - DNA, 512 bp, Homo sapiens
  misc_feature: GYAE6OF01BP2AV.7.10.A10.1.454.CMB.1.raw
  modified_base (479)..(512): a, c, t, g, unknown or other
  misc_feature (479)..(512): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtccaccgtctcctcacgccctccaaccgaacgggccccacgttccggttccctttcccccccgtggccctacccccgttccctacccgaaaggacgcctaacccgttcggtcggggggccaaccgtacgggcccgggccccgtcggggccttcggtccccgttgggtacccgtaaaacgggtaaccttacccttacccggtaagggaaccggtaaccgaccggacgttacgggacgggccgggggtaccgtggggaacccgtaaacggggccgtacctaagaggnnnnnnnnnnnnnnnnnnnnnnnnnnnnnnnnnn

SEQ ID NO: 808 - DNA, 362 bp, Homo sapiens
  misc_feature: GYAE6OF01BNF2Y.7.10.A10.1.454.CMB.1.raw
  modified_base (254)..(254): a, c, t, g, unknown or other
  misc_feature (254)..(254): n is a, c, g, or t
  modified_base (339)..(339): a, c, t, g, unknown or other
  misc_feature (339)..(339): n is a, c, g, or t
  modified_base (345)..(362): a, c, t, g, unknown or other
  misc_feature (345)..(362): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctgtcaccgtctcctcagcctccaccgaaggcccatcggtcttccccctgcaccctcctccaagngcaccgtctgggggcacagcggccctgggctgccgtggtcaaggctacttcctagacgacacgctgagcgggctggcaaggccgnactagnnnnnnnnnnnnnnnnnn

SEQ ID NO: 809 - DNA, 414 bp, Homo sapiens
  misc_feature: GYAE6OF01DQ8E5.7.10.A10.1.454.CMB.1.raw
  modified_base (391)..(391): a, c, t, g, unknown or other
  misc_feature (391)..(391): n is a, c, g, or t
  modified_base (393)..(414): a, c, t, g, unknown or other
  misc_feature (393)..(414): n is a, c, g, or t
tcagcgtgtctctacacgaccggtgctcgatttagcgtcgatctcagggacaacgccaagaagtcactgtatctacaaatgaacagcctgagagccgaggacacggccgtgttattactgtgtgagagataaggtccggtatcacttggatagaagtgcttattacattgactacgtcgggccagggaaccctcgtcaccgtctcctcacgccctccaccgaacggcccagttccggtccccttcccccgtggacccctacccctccctaccgaagacgtcctacccgtcggtcgggaccaccgccggccggccgtggcctcgcgtacggtacgacgtacttactacgagacacgcgcgtcggacggcggacgtacggacgacggcacgangnnnnnnnnnnnnnnnnnnnnnn

SEQ ID NO: 810 - DNA, 542 bp, Homo sapiens
  misc_feature: GYAE6OF01EQDKG.7.10.A10.1.454.CMB.1.raw
  modified_base (515)..(542): a, c, t, g, unknown or other
  misc_feature (515)..(542): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataaggtccgggtatctacttggatagaagtgcttattacattacgactacggtcggaccggaaccgggtacccttccgtaccgtacccgttccttccctacgacccgtcccccacccgaaacccgggaacccggaccctaccggtttccccggtttccccctttaccccggccgtacccccctacccccttaccccgtaaccgaacggtaccgacccctaccggttcgggggaccgggaccgaaccggcccgggtccccgggtccgggtcggtaccgtccggtccggttacggtaaccggtaaccgttaccctttaccgttacggaacggaccgaccgccggtaggtcgggacgggccggtcggtacgggacgacggacgtagtagnnnnnnnnnnnnnnnnnnnnnnnnnnnn

SEQ ID NO: 811 - DNA, 404 bp, Homo sapiens
  misc_feature: GYAE6OF01CUYL8.7.10.A10.1.454.CMB.1.raw
  modified_base (305)..(305): a, c, t, g, unknown or other
  misc_feature (305)..(305): n is a, c, g, or t
  modified_base (380)..(404): a, c, t, g, unknown or other
  misc_feature (380)..(404): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataggtccgggtatcacttggatagaagtgctttatactattgactacgtggggccagggaaccctcgtcacccgtctcctcagccctcccaaccgaacgggcccactccggtccttcccccgtggccaccctcctccaagacgccacctcggtcgggggccacgacggccgtcccgngggctcgccgtggtcaaggaccttacgttacctagagacacgtcctaggcggcgggctgggacaggcgtcatagnnnnnnnnnnnnnnnnnnnnnnnnn

SEQ ID NO: 812 - DNA, 476 bp, Homo sapiens
  misc_feature: GYAE6OF01CLOD9.7.10.A10.1.454.CMB.1.raw
  modified_base (171)..(171): a, c, t, g, unknown or other
  misc_feature (171)..(171): n is a, c, g, or t
  modified_base (305)..(305): a, c, t, g, unknown or other
  misc_feature (305)..(305): n is a, c, g, or t
  modified_base (425)..(476): a, c, t, g, unknown or other
  misc_feature (425)..(476): n is a, c, g, or t
tcagcgtgtctctacacgaccggtgctcgatttagcgtcgatctcagggacaacgccaagaagtcactgtatctacaaatgaacagcctgagagccggaggaccacggccgtagtattactgtgtgagagataaggtccgggtatcacttaggatagaagtgtcttatacnttcgaacgtcggtcggggccgaacgggtaacccttcgtccgacccgttcctcctcacgccctacccaccgacggccctacgtccggtcccttcccccgtgcccctacccctcctaccgagacgccaccgtcggnggggcacgacggcccggtccggtgggtcctcggtccgtaggtaccgaacgtaccttaaccgttcgacgaacgacgaccgtcgtcggcgggacggtcgtagggaacgaggccgtacagagnnnnnnnnnnnnnnnnnnnnnnnnnnnnnnnnnnnnnnnnnnnnnnnnnnnn

SEQ ID NO: 813 - DNA, 387 bp, Homo sapiens
  misc_feature: GYAE6OF01EQEPQ.7.10.A10.1.454.CMB.1.raw
  modified_base (262)..(262): a, c, t, g, unknown or other
  misc_feature (262)..(262): n is a, c, g, or t
  modified_base (355)..(357): a, c, t, g, unknown or other
  misc_feature (355)..(357): n is a, c, g, or t
  modified_base (359)..(387): a, c, t, g, unknown or other
  misc_feature (359)..(387): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtacaccgtctcctcagcctccaccgaaggcccagtccggtccttccccctggccacccctcctacaagngcacctcgtgggggacacgagccggccctggggctgcctggtacaaggactactccaagacgacacgctgagcgggctggcaaggcgcatagnnnannnnnnnnnnnnnnnnnnnnnnnnnnnnn

SEQ ID NO: 814 - DNA, 408 bp, Homo sapiens
  misc_feature: GYAE6OF01B2B9Z.7.10.A10.1.454.CMB.1.raw
  modified_base (346)..(349): a, c, t, g, unknown or other
  misc_feature (346)..(349): n is a, c, g, or t
  modified_base (351)..(351): a, c, t, g, unknown or other
  misc_feature (351)..(351): n is a, c, g, or t
  modified_base (353)..(353): a, c, t, g, unknown or other
  misc_feature (353)..(353): n is a, c, g, or t
  modified_base (355)..(357): a, c, t, g, unknown or other
  misc_feature (355)..(357): n is a, c, g, or t
  modified_base (359)..(359): a, c, t, g, unknown or other
  misc_feature (359)..(359): n is a, c, g, or t
  modified_base (362)..(408): a, c, t, g, unknown or other
  misc_feature (362)..(408): n is a, c, g, or t
tcagcgtgtctctacacgaccggtgctcgatttagcgtcgatctcagggacaacgccaagaagtcactgtatctacaaatgaacagcctgagagccgaggacacggcccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactacttcctagagacacgctgagcgggcgtggcaaggcgcatagnnnngnancnnngncgnnnnnnnnnnnnnnnnnnnnnnnnnnnnnnnnnnnnnnnnnnnnnnn

SEQ ID NO: 815 - DNA, 475 bp, Homo sapiens
  misc_feature: GYAE6OF01DZ02U.7.10.A10.1.454.CMB.1.raw
  modified_base (164)..(164): a, c, t, g, unknown or other
  misc_feature (164)..(164): n is a, c, g, or t
  modified_base (441)..(441): a, c, t, g, unknown or other
  misc_feature (441)..(441): n is a, c, g, or t
  modified_base (447)..(475): a, c, t, g, unknown or other
  misc_feature (447)..(475): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccggtatcattggatagagtgtcttattatnttacgactacgtcggggccgaaggaccctcgtccacccgtctcctcacgtccctaccaaccgacggcccacgtcccgttcccttccccctacggccctaccccttccaccgaacgcgtcctaccgtcgggcgggggactaccgaccggtcccggtccccggtggggtccttcggtacccgttacggtaccgaaaccggttaacccttccgtttaaccgtacgaccgtaccgaccgtccgtaggacggggccggtccggtaggacggtaacgggccanaagtgnnnnnnnnnnnnnnnnnnnnnnnnnnnnn

SEQ ID NO: 816 - DNA, 202 bp, Homo sapiens
  misc_feature: GYAE6OF02FKJWC.7.10.A10.1.454.CMB.1.raw
  modified_base (200)..(202): a, c, t, g, unknown or other
  misc_feature (200)..(202): n is a, c, g, or t
tcagcgtgtctctacacgaccggtgctcgatttagcgtcgatctcagggtccgggagatcatgagggtgtccttgggttttggggaagaggaagactgacggtcccccaggagttcaggtgctgggcacagcggccctgggctgcctggtcaaggactacttcctagagacacgctgagcgggctggcaaggcgcatagnnn

SEQ ID NO: 817 - DNA, 346 bp, Homo sapiens
  misc_feature: GYAE6OF02FYUT4.7.10.A10.1.454.CMB.1.raw
  modified_base (342)..(346): a, c, t, g, unknown or other
  misc_feature (342)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnnn

SEQ ID NO: 818 - DNA, 371 bp, Homo sapiens
  misc_feature: GYAE6OF02G2MFS.7.10.A10.1.454.CMB.1.raw
  modified_base (349)..(371): a, c, t, g, unknown or other
  misc_feature (349)..(371): n is a, c, g, or t
tcagcgtgtctctacacgaccggtgctcgatttagcgtcgatctcagggacaacgccaagaagtcactgtatctacaaatgaacgacgcctgagagccgaggacgacggccgtgtattactgtgtgagagataagtccgggtatcacttggatagaagtgcttattacattgactactggggccagggaaccctcgtcaccgtctcctcagcctccaccaaggcccatcggtcttccccctggcaccctcctccaagagcacctctggggcacagcggccctgggctgcctggtacaaggactaccttcctagacgacacgctgagcgggctggcaaggcgacagtagnnnnnnnnnnnnnnnnnnnnnnn

SEQ ID NO: 819 - DNA, 360 bp, Homo sapiens
  misc_feature: GYAE6OF02I7ATA.7.10.A10.1.454.CMB.1.raw
  modified_base (347)..(360): a, c, t, g, unknown or other
  misc_feature (347)..(360): n is a, c, g, or t
tcagcgtgtctctacacgaccggtgctcgatttagcgtcgatctcagggacgaacgccaagaagtcactgtatctacaaatgaacagccctgagagccgaggacacggcccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgccctggtcaaggactacttcctagagacacgctgagcgggctggcaaggcgcatagnnnnnnnnnnnnnn

SEQ ID NO: 820 - DNA, 354 bp, Homo sapiens
  misc_feature: GYAE6OF02H8R92.7.10.A10.1.454.CMB.1.raw
  modified_base (345)..(354): a, c, t, g, unknown or other
  misc_feature (345)..(354): n is a, c, g, or t
tcagcgtgtctctacacgaccggtgctcgatttagcgtcgatctcagggacaacgccaagaagtccactgtatctacaaatgaacagcctgagagccgaggacacggccgtgtattaactgtgtgagagataagtccgggtatcacttggatagaagtgcttattacattgactactggggccagggaaccctcgtcaccgtctcctcagcctccaccaagggcccagtccggtcttccccctggcaccctcctcaagagcacctctggggcacagcggccctgggctgcctggtcaaggactactccctagagacacgctgagcgggctggcaaggcgcatagnnnnnnnnnn

SEQ ID NO: 821 - DNA, 342 bp, Homo sapiens
  misc_feature: GYAE6OF02FFDKW.7.10.A10.1.454.CMB.1.raw
  modified_base (342)..(342): a, c, t, g, unknown or other
  misc_feature (342)..(342): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagn

SEQ ID NO: 822 - DNA, 349 bp, Homo sapiens
  misc_feature: GYAE6OF02JKU6I.7.10.A10.1.454.CMB.1.raw
  modified_base (342)..(349): a, c, t, g, unknown or other
  misc_feature (342)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnnnnnn

SEQ ID NO: 823 - DNA, 345 bp, Homo sapiens
  misc_feature: GYAE6OF02HVTIQ.7.10.A10.1.454.CMB.1.raw
  modified_base (343)..(345): a, c, t, g, unknown or other
  misc_feature (343)..(345): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnn

SEQ ID NO: 824 - DNA, 345 bp, Homo sapiens
  misc_feature: GYAE6OF02GL8E8.7.10.A10.1.454.CMB.1.raw
  modified_base (343)..(345): a, c, t, g, unknown or other
  misc_feature (343)..(345): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggttaaggactacttcctagagacacgctgagcgggctggcaaggcgcatagnnn

SEQ ID NO: 825 - DNA, 347 bp, Homo sapiens
  misc_feature: GYAE6OF02F67MU.7.10.A10.1.454.CMB.1.raw
  modified_base (344)..(347): a, c, t, g, unknown or other
  misc_feature (344)..(347): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnn

SEQ ID NO: 826 - DNA, 429 bp, Homo sapiens
  misc_feature: GYAE6OF02IVFDT.7.10.A10.1.454.CMB.1.raw
  modified_base (361)..(361): a, c, t, g, unknown or other
  misc_feature (361)..(361): n is a, c, g, or t
  modified_base (364)..(364): a, c, t, g, unknown or other
  misc_feature (364)..(364): n is a, c, g, or t
  modified_base (367)..(367): a, c, t, g, unknown or other
  misc_feature (367)..(367): n is a, c, g, or t
  modified_base (369)..(369): a, c, t, g, unknown or other
  misc_feature (369)..(369): n is a, c, g, or t
  modified_base (372)..(373): a, c, t, g, unknown or other
  misc_feature (372)..(373): n is a, c, g, or t
  modified_base (376)..(387): a, c, t, g, unknown or other
  misc_feature (376)..(387): n is a, c, g, or t
  modified_base (389)..(429): a, c, t, g, unknown or other
  misc_feature (389)..(429): n is a, c, g, or t
tcagcgtgtctctacacgaccggtgctcgatttagcgtcgatctcagggactaacgtccggaagaaggtcactgtactactacgaaatgaacagcctggagagccgagggaccacggccgtgtattactcgtgggtgagaggataaggtccgggtatcgacttggataggaagtgcttattacattgactactggggccagggaacccctgtcaccgtctccctcagcctccaccaagggcccagtcggtccttccccctggcacccctcctccaagagcacctgtgggggcacagcggcctgggctgctggtcaaggctactccagagacacgctgacgcgggctggcaaggcgcatagntantanangcnnagnnnnnnnnnnnntnnnnnnnnnnnnnnnnnnnnnnnnnnnnnnnnnnnnnnnnn

SEQ ID NO: 827 - DNA, 347 bp, Homo sapiens; identical to SEQ ID NO: 756
  misc_feature: GYAE6OF02GGEPG.7.10.A10.1.454.CMB.1.raw
  modified_base (343)..(347): a, c, t, g, unknown or other
  misc_feature (343)..(347): n is a, c, g, or t

SEQ ID NO: 828 - DNA, 359 bp, Homo sapiens
  misc_feature: GYAE6OF02G0L2S.7.10.A10.1.454.CMB.1.raw
  modified_base (346)..(359): a, c, t, g, unknown or other
  misc_feature (346)..(359): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccaggggaaccctcgtcaccgtctcctcagcctccaccaagggcccatcggtcttccccctggcaccctcctccaagagcacctctgggggcacagacggccctgggctgccctggtcaaggactacttcctagagacacgctgagcgggctggcaaggcgcatagnnnnnnnnnnnnnn

SEQ ID NO: 829 - DNA, 347 bp, Homo sapiens
  misc_feature: GYAE6OF02FK6UB.7.10.A10.1.454.CMB.1.raw
  modified_base (341)..(347): a, c, t, g, unknown or other
  misc_feature (341)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggctacttcctagagacacgctgagcgggctggcaaggcgcatagnnnnnnn

SEQ ID NO: 830 - DNA, 348 bp, Homo sapiens; identical to SEQ ID NO: 720
  misc_feature: GYAE6OF02I9Q99.7.10.A10.1.454.CMB.1.raw
  modified_base (342)..(348): a, c, t, g, unknown or other
  misc_feature (342)..(348): n is a, c, g, or t

SEQ ID NO: 831 - DNA, 345 bp, Homo sapiens; identical to SEQ ID NO: 823
  misc_feature: GYAE6OF02HPG4B.7.10.A10.1.454.CMB.1.raw
  modified_base (343)..(345): a, c, t, g, unknown or other
  misc_feature (343)..(345): n is a, c, g, or t

SEQ ID NO: 832 - DNA, 346 bp, Homo sapiens
  misc_feature: GYAE6OF02G54TC.7.10.A10.1.454.CMB.1.raw
  modified_base (344)..(346): a, c, t, g, unknown or other
  misc_feature (344)..(346): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagtctccaccaagggcccatcggtcttccccctggcaccctcctccaagagcacctctgggggcacagcggccctgggctgcctggtcaaggactacttcctagagacacgctgagcgggctggcaaggcgcatagnnn

SEQ ID NO: 833 - DNA, 346 bp, Homo sapiens; identical to SEQ ID NO: 713
  misc_feature: GYAE6OF02IZAR1.7.10.A10.1.454.CMB.1.raw
  modified_base (343)..(346): a, c, t, g, unknown or other
  misc_feature (343)..(346): n is a, c, g, or t

SEQ ID NO: 834 - DNA, 346 bp, Homo sapiens
  misc_feature: GYAE6OF02GEMAV.7.10.A10.1.454.CMB.1.raw
  modified_base (343)..(346): a, c, t, g, unknown or other
  misc_feature (343)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgccctggtcaaggactacttcctagagacacgctgagcgggctggcaaggcgcatagnnnn

SEQ ID NO: 835 - DNA, 345 bp, Homo sapiens; identical to SEQ ID NO: 743
  misc_feature: GYAE6OF02IPUMU.7.10.A10.1.454.CMB.1.raw
  modified_base (342)..(345): a, c, t, g, unknown or other
  misc_feature (342)..(345): n is a, c, g, or t

SEQ ID NO: 836 - DNA, 346 bp, Homo sapiens
  misc_feature: GYAE6OF02IG498.7.10.A10.1.454.CMB.1.raw
  modified_base (344)..(346): a, c, t, g, unknown or other
  misc_feature (344)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttccctagagacacgctgagcgggctggcaaggcgcatagnnn

SEQ ID NO: 837 - DNA, 346 bp, Homo sapiens
  misc_feature: GYAE6OF02FSUTH.7.10.A10.1.454.CMB.1.raw
  modified_base (344)..(346): a, c, t, g, unknown or other
  misc_feature (344)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccccctggcaccctcctccaagagcacctctgggggcacagcggccctgggctgcctggtcaaggactacttcctagagacacgctgagcgggctggcaaggcgcatagnnn

SEQ ID NO: 838 - DNA, 347 bp, Homo sapiens
  misc_feature: GYAE6OF02HERHT.7.10.A10.1.454.CMB.1.raw
  modified_base (343)..(347): a, c, t, g, unknown or other
  misc_feature (343)..(347): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagaacacgctgagcgggctggcaaggcgcatagnnnnn

SEQ ID NO: 839 - DNA, 347 bp, Homo sapiens; identical to SEQ ID NO: 756
  misc_feature: GYAE6OF02GNZPG.7.10.A10.1.454.CMB.1.raw
  modified_base (343)..(347): a, c, t, g, unknown or other
  misc_feature (343)..(347): n is a, c, g, or t

SEQ ID NO: 840 - DNA, 347 bp, Homo sapiens
  misc_feature: GYAE6OF02HXCIM.7.10.A10.1.454.CMB.1.raw
  modified_base (342)..(347): a, c, t, g, unknown or other
  misc_feature (342)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnnnn

SEQ ID NO: 841 - DNA, 351 bp, Homo sapiens
  misc_feature: GYAE6OF02HB48Q.7.10.A10.1.454.CMB.1.raw
  modified_base (343)..(351): a, c, t, g, unknown or other
  misc_feature (343)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnnnnnnn

SEQ ID NO: 842 - DNA, 348 bp, Homo sapiens
  misc_feature: GYAE6OF02IIO0I.7.10.A10.1.454.CMB.1.raw
  modified_base (340)..(348): a, c, t, g, unknown or other
  misc_feature (340)..(348): n is a, c, g, or t
tcagcgtgtctctacacgaccggtgctcgatttagcgtcgatctcagggacaacgccaagaagtcactgtatctacaatgaacagcctgagagccgaggacacggccgtgtattactgtgtgagagataagtccgggtatcacttggatagaagtgcttattacattgactactggggccagggaccctcgtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnnnnnnn

SEQ ID NO: 843 - DNA, 347 bp, Homo sapiens
  misc_feature: GYAE6OF02HDSH7.7.10.A10.1.454.CMB.1.raw
  modified_base (344)..(347): a, c, t, g, unknown or other
  misc_feature (344)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgccctggtcaaggactacttcctagagacacgctgagcgggctggcaaggcgcatagnnnn

SEQ ID NO: 844 - DNA, 373 bp, Homo sapiens
  misc_feature: GYAE6OF02IBM1K.7.10.A10.1.454.CMB.1.raw
  modified_base (279)..(279): a, c, t, g, unknown or other
  misc_feature (279)..(279): n is a, c, g, or t
  modified_base (351)..(373): a, c, t, g, unknown or other
  misc_feature (351)..(373): n is a, c, g, or t
tcagcgtgtctctacacgaccggtgctcgatttagcgtcgatctcagggggacaacgccaacgaagtcactgtatctacaaatgaacagcctgacgagccgaggacacggccggtgtattactgtgtgagagataagtccgggtatcaacttggatagaagtgcttattacattgactactggggccagggaaccctcgtcaccgtctcctcagcctccacaaggcccatcggtcttccccctggcaccctcctccaagagcacctcttgggggcacancggccctgggctgcctgggtcaaggactacttccctagagacacgctgagcgggactggcaaggcgcatagnnnnnnnnnnnnnnnnnnnnnnn

SEQ ID NO: 845 - DNA, 347 bp, Homo sapiens; identical to SEQ ID NO: 840
  misc_feature: GYAE6OF02I5B8U.7.10.A10.1.454.CMB.1.raw
  modified_base (342)..(347): a, c, t, g, unknown or other
  misc_feature (342)..(347): n is a, c, g, or t

SEQ ID NO: 846 - DNA, 349 bp, Homo sapiens; identical to SEQ ID NO: 734
  misc_feature: GYAE6OF02F5XIB.7.10.A10.1.454.CMB.1.raw
  modified_base (343)..(349): a, c, t, g, unknown or other
  misc_feature (343)..(349): n is a, c, g, or t

SEQ ID NO: 847 - DNA, 347 bp, Homo sapiens
  misc_feature: GYAE6OF02GXF11.7.10.A10.1.454.CMB.1.raw
  modified_base (343)..(347): a, c, t, g, unknown or other
  misc_feature (343)..(347): n is a, c, g, or t
tcagcgtgtctctacacgaccggtgctcgatttagcgtcgatctcagggacaacgtcaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttcctagagacacgctgagcgggctggcaaggcgcatagnnnnn

SEQ ID NO: 848 - DNA, 348 bp, Homo sapiens
  misc_feature: GYAE6OF02F1MYI.7.10.A10.1.454.CMB.1.raw
  modified_base (343)..(348): a, c, t, g, unknown or other
  misc_feature (343)..(348): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccccctggcaccctcctccaagagcacctctgggggcacagcgccctgggctgcctggtcaaggactacttcctagagacacgctgagcgggctggcaaggcgcatagnnnnnn

SEQ ID NO: 849 - DNA, 347 bp, Homo sapiens; identical to SEQ ID NO: 756
  misc_feature: GYAE6OF02I372K.7.10.A10.1.454.CMB.1.raw
  modified_base (343)..(347): a, c, t, g, unknown or other
  misc_feature (343)..(347): n is a, c, g, or t

SEQ ID NO: 850 - DNA, 342 bp, Homo sapiens
  misc_feature: GYAE6OF02H9UGD.7.10.A10.1.454.CMB.1.raw
  modified_base (340)..(342): a, c, t, g, unknown or other
  misc_feature (340)..(342): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttatacattgactactggggccagggaaccctcgtcaccgtctcctcagcctccaccaagggccatcggtcttccccctggcaccctcctcaagagcacctctgggggcacagcggccctgggctgcctggtcaaggactactccctagagacacgctgagcgggctggcaaggcgcatagnnn

SEQ ID NO: 851 - DNA, 349 bp, Homo sapiens
  misc_feature: GYAE6OF02HFI8T.7.10.A10.1.454.CMB.1.raw
  modified_base (343)..(349): a, c, t, g, unknown or other
  misc_feature (343)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcgaccctgggctgcctggtcaaggactacttcctagagacacgctgagcgggctggcaaggcgcatagnnnnnnn

SEQ ID NO: 852 - DNA, 422 bp, Homo sapiens
  misc_feature: GYAE6OF02GVM83.7.10.A10.1.454.CMB.1.raw
  modified_base (264)..(264): a, c, t, g, unknown or other
  misc_feature (264)..(264): n is a, c, g, or t
  modified_base (376)..(378): a, c, t, g, unknown or other
  misc_feature (376)..(378): n is a, c, g, or t
  modified_base (381)..(422): a, c, t, g, unknown or other
  misc_feature (381)..(422): n is a, c, g, or t
tcagcgtgtctctacacgaccggtgctcgatttagcgtcgatctccagggtacgaacgccaagaagtcactgtatcctacaaatgaacagccctgagagccgaggacacggccgtgtattactgtgtgagagataagtccgggtatcgacttggatagaagttgcttattacatttgactactggggccagggaaccctgtcaccgtctcctcagcctccgaccaagggcccatcggtcttcccccgtggcaccctctccaagngcacctctgggggcactagcggtccctgggcctgccctggtccaagggcctacgttcccgtagacgacgaacggccttggaagtcggggctgggccaagggtcgacataggnnngannnnnnnnnnnnnnnnnnnnnnnnnnnnnnnnnnnnnnnnnn

SEQ ID NO: 853 - DNA, 349 bp, Homo sapiens; identical to SEQ ID NO: 822
  misc_feature: GYAE6OF02JAVS4.7.10.A10.1.454.CMB.1.raw
  modified_base (342)..(349): a, c, t, g, unknown or other
  misc_feature (342)..(349): n is a, c, g, or t

SEQ ID NO: 854 - DNA, 348 bp, Homo sapiens
  misc_feature: GYAE6OF02JB190.7.10.A10.1.454.CMB.1.raw
  modified_base (344)..(348): a, c, t, g, unknown or other
  misc_feature (344)..(348): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctcccaagagcacctctgggggcacagcggccctgggctgcctggtcaaggactacttcctagagacacgctgagcgggctggcaaggcgcatagnnnnn

SEQ ID NO: 855 - DNA, 368 bp, Homo sapiens
  misc_feature: GYAE6OF02JK3HJ.7.10.A10.1.454.CMB.1.raw
  modified_base (358)..(368): a, c, t, g, unknown or other
  misc_feature (358)..(368): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttatactattgactactggggccagggaaccctcgtcaccgtctcctcagcctccaccaaggcccatccggtccttcccccctggccacccctcctccaagacgccaaccctcgtcgggggcaccgagccggccctgggctggcctggtccaaggctacttcctagcgacacgctgacgcgggctggcaaggcgcatagnnnnnnnnnnn

SEQ ID NO: 856 - DNA, 346 bp, Homo sapiens
  misc_feature: GYAE6OF02F5LEP.7.10.A10.1.454.CMB.1.raw
  modified_base (344)..(346): a, c, t, g, unknown or other
  misc_feature (344)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccccctggcaccctcctccaagagcacctctgggggcacagcgaccctgggctgcctggtcaaggactacttcctagagacacgctgagcgggctggcaaggcgcatagnnn

SEQ ID NO: 857 - DNA, 350 bp, Homo sapiens
  misc_feature: GYAE6OF02HM3KO.7.10.A10.1.454.CMB.1.raw
  modified_base (350)..(350): a, c, t, g, unknown or other
  misc_feature (350)..(350): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaacggccactcggtccttccccctcggccaccctcctccaagagcacctcgtggggggcacagcgggcccctgggctgcctggtcaaggactacttcctagagacacgctgagcgggctggcaaggcgcatagn

SEQ ID NO: 858 - DNA, 347 bp, Homo sapiens; identical to SEQ ID NO: 840
  misc_feature: GYAE6OF02F41MI.7.10.A10.1.454.CMB.1.raw
  modified_base (342)..(347): a, c, t, g, unknown or other
  misc_feature (342)..(347): n is a, c, g, or t

SEQ ID NO: 859 - DNA, 351 bp, Homo sapiens
  misc_feature: GYAE6OF02H6EC3.7.10.A10.1.454.CMB.1.raw
  modified_base (344)..(351): a, c, t, g, unknown or other
  misc_feature (344)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagccacctctgggggcacagcggccctgggctgcctggtcaaggactacttcctagagacacgctgagcgggctggcaaggcgcatagnnnnnnnn

SEQ ID NO: 860 - DNA, 348 bp, Homo sapiens
  misc_feature: GYAE6OF02H9T0M.7.10.A10.1.454.CMB.1.raw
  modified_base (342)..(348): a, c, t, g, unknown or other
  misc_feature (342)..(348): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactattccctagagacacgctgagcgggctggcaaggcgcatagnnnnnnn

SEQ ID NO: 861 - DNA, 352 bp, Homo sapiens
  misc_feature: GYAE6OF02HBZOI.7.10.A10.1.454.CMB.1.raw
  modified_base (345)..(352): a, c, t, g, unknown or other
  misc_feature (345)..(352): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtccttccccctggccaccctcctccaagagcacctctgggggcacagcggccctgggctgcctggtcaaggactacttcctagagacacgctgagcgggctggcaaggcgcatagnnnnnnnn

SEQ ID NO: 862 - DNA, 348 bp, Homo sapiens; identical to SEQ ID NO: 770
  misc_feature: GYAE6OF02FSKRM.7.10.A10.1.454.CMB.1.raw
  modified_base (343)..(348): a, c, t, g, unknown or other
  misc_feature (343)..(348): n is a, c, g, or t

SEQ ID NO: 863 - DNA, 345 bp, Homo sapiens; identical to SEQ ID NO: 823
  misc_feature: GYAE6OF02FZUIS.7.10.A10.1.454.CMB.1.raw
  modified_base (343)..(345): a, c, t, g, unknown or other
  misc_feature (343)..(345): n is a, c, g, or t

SEQ ID NO: 864 - DNA, 347 bp, Homo sapiens
  misc_feature: GYAE6OF02JAI87.7.10.A10.1.454.CMB.1.raw
  modified_base (343)..(347): a, c, t, g, unknown or other
  misc_feature (343)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggccatcggtcttccccctggcaccctcctccaagagcacctctgggggcacagcggccctgggctgcctggtcaaggactacttccctagagacacgctgagcgggctggcaaggcgcatagnnnnn

SEQ ID NO: 865 - DNA, 344 bp, Homo sapiens
  misc_feature: GYAE6OF02GWTBH.7.10.A10.1.454.CMB.1.raw
  modified_base (340)..(344): a, c, t, g, unknown or other
  misc_feature (340)..(344): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggcaccctcctccaagagcacctctggggcacagcggccctgggctgcctggtcaggactacttcctagagacacgctgagcgggctggcaaggcgcatagnnnnn

SEQ ID NO: 866 - DNA, 351 bp, Homo sapiens; identical to SEQ ID NO: 841
  misc_feature: GYAE6OF02HNXKL.7.10.A10.1.454.CMB.1.raw
  modified_base (343)..(351): a, c, t, g, unknown or other
  misc_feature (343)..(351): n is a, c, g, or t

SEQ ID NO: 867 - DNA, 348 bp, Homo sapiens
  misc_feature: GYAE6OF02IX48Q.7.10.A10.1.454.CMB.1.raw
  modified_base (343)..(348): a, c, t, g, unknown or other
  misc_feature (343)..(348): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagccacctctgggggcacagcggccctgggctgccctggtcaaggctacttcctagagacacgctgagcggctggcaaggcgcatagnnnnnn

SEQ ID NO: 868 - DNA, 381 bp, Homo sapiens
  misc_feature: GYAE6OF02JB8IT.7.10.A10.1.454.CMB.1.raw
  modified_base (355)..(381): a, c, t, g, unknown or other
  misc_feature (355)..(381): n is a, c, g, or t
tcagcgtgtctctacacgaccggtgctcgatttagcgtcgatctccagggacgaacgccaagaagtcactgtatctacaaatgaacagccctgagagccgaggacacggccgtgtattactgtgtgagagataagtccgggtatcacttggatagaagtgcttattacattgactactggggccagggaaccctcgtcaccggtctcctcagccctccaccaagggcccatcggtcttccccctggcaccctcctcccaagacgcaccctcgtgggggcacagcggccctgggctgccctggtcaaggactactcccgtagagacacgcgtgagcgggctggcaaggcgcatagnnnnnnnnnnnnnnnnnnnnnnnnnnn

SEQ ID NO: 869 - DNA, 348 bp, Homo sapiens
  misc_feature: GYAE6OF02FQU3K.7.10.A10.1.454.CMB.1.raw
  modified_base (337)..(337): a, c, t, g, unknown or other
  misc_feature (337)..(337): n is a, c, g, or t
  modified_base (343)..(348): a, c, t, g, unknown or other
  misc_feature (343)..(348): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggctacttcctagagacacgctgagcgggctggcaagggcncatagnnnnnn

SEQ ID NO: 870 - DNA, 350 bp, Homo sapiens
  misc_feature: GYAE6OF02GBYVH.7.10.A10.1.454.CMB.1.raw
  modified_base (342)..(350): a, c, t, g, unknown or other
  misc_feature (342)..(350): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggactacttcctagagacacgctgagcgggctggcaaggcgcatagnnnnnnnnn

SEQ ID NO: 871 - DNA, 365 bp, Homo sapiens
  misc_feature: GYAE6OF02ICI1X.7.10.A10.1.454.CMB.1.raw
  modified_base (271)..(271): a, c, t, g, unknown or other
  misc_feature (271)..(271): n is a, c, g, or t
  modified_base (352)..(365): a, c, t, g, unknown or other
  misc_feature (352)..(365): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtctaccgtctcctcacgcctccaccaagggccctatcggtccttccccctggaccaccctcctccaacgagccacctntcgggggcacagcgcctgggcctgctagtcaaggactacttccagagacacgctgagcgggctggcaacggcgctaagagnnnnnnnnnnnnnn

SEQ ID NO: 872 - DNA, 347 bp, Homo sapiens
  misc_feature: GYAE6OF02FIKPL.7.10.A10.1.454.CMB.1.raw
  modified_base (343)..(347): a, c, t, g, unknown or other
  misc_feature (343)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggccccatcggtcttcccccctggcaccctcctccaagagcacctctggggcacagcggccctgggctgcctggtcaaggctacttcctagagacacgctgagcgggctggcaaggcgcatagnnnnn

SEQ ID NO: 873 - DNA, 344 bp, Homo sapiens
  misc_feature: GYAE6OF02G0JGD.7.10.A10.1.454.CMB.1.raw
  modified_base (340)..(344): a, c, t, g, unknown or other
  misc_feature (340)..(344): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgtactactggggccagggaaccctcgtcaccgtctcctcagcctccaccaagggcccatcggtcttccccctggcaccctcctccaagagcacctctggggcacagcgcctggctgcctggtcaaggactacttcctagagacacgctgagcgggctggcaaggcgcatagnnnnn

SEQ ID NO: 874 - DNA, 372 bp, Homo sapiens
  misc_feature: GYAE6OF02JML76.7.10.A10.1.454.CMB.1.raw
  modified_base (298)..(298): a, c, t, g, unknown or other
  misc_feature (298)..(298): n is a, c, g, or t
  modified_base (339)..(339): a, c, t, g, unknown or other
  misc_feature (339)..(339): n is a, c, g, or t
  modified_base (342)..(372): a, c, t, g, unknown or other
  misc_feature (342)..(372): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaggccatcgtctccccctgcacctctccaagagcacctcgtggggcacagccggcctgggctcgctgacagtctacgtcganacgactacgcgtaggcgtcggctacggacgaggcacgtagngcnnnnnnnnnnnnnnnnnnnnnnnnnnnnnnn

SEQ ID NO: 875 - DNA, 471 bp, Homo sapiens
  misc_feature: GYAE6OF02IJTPS.7.10.A10.1.454.CMB.1.raw
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
  modified_base (413)..(413): a, c, t, g, unknown or other
  misc_feature (413)..(413): n is a, c, g, or t
  modified_base (417)..(419): a, c, t, g, unknown or other
  misc_feature (417)..(419): n is a, c, g, or t
  modified_base (421)..(422): a, c, t, g, unknown or other
  misc_feature (421)..(422): n is a, c, g, or t
  modified_base (424)..(431): a, c, t, g, unknown or other
  misc_feature (424)..(431): n is a, c, g, or t
  modified_base (433)..(471): a, c, t, g, unknown or other
  misc_feature (433)..(471): n is a, c, g, or t
tcagcgtgtctctacacgaccggtgctcgatttagcgtcgatctcagggacaacgccaagaagtcactgtatctacaaatgaacagcctgagagccgaggacacggccgtgtattacctgtgtggagaggataaggtccgggtatcacttggattagaagtgcttattacattgactactggggccaggggaacccctgtcaccgtctcctcagccctccaccaagggcccagtccggtcttccccctggccacccctcctaccaagagccacctgtcgggggccacgacgccggccccgtgggcctgccgttcgggtcaaagggccttacgttccctaaggacgtaccacggcttgacgggcgggctgggacaaggggccacaggttacgncgncgncatcggangcatcgntcgnnntnnannnnnnnncnnnnnnnnnnnnnnnnnnnnnnnnnnnnnnnnnnnnnnn

SEQ ID NO: 876 - DNA, 347 bp, Homo sapiens
  misc_feature: GYAE6OF02HMFMI.7.10.A10.1.454.CMB.1.raw
  modified_base (344)..(347): a, c, t, g, unknown or other
  misc_feature (344)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttccctagagacacgctgagcgggctggcaaggcgcatagnnnn

SEQ ID NO: 877 - DNA, 349 bp, Homo sapiens
  misc_feature: GYAE6OF02GX8CV.7.10.A10.1.454.CMB.1.raw
  modified_base (344)..(349): a, c, t, g, unknown or other
  misc_feature (344)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttccctagagacacgctgagcgggctggcaaggcgcatagnnnnnn

SEQ ID NO: 878 - DNA, 351 bp, Homo sapiens
  misc_feature: GYAE6OF02GRHWE.7.10.A10.1.454.CMB.1.raw
  modified_base (344)..(351): a, c, t, g, unknown or other
  misc_feature (344)..(351): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactactcctagagacacgctgagcgggctggcaaggcgcatagnnnnnnnn

SEQ ID NO: 879 - DNA, 342 bp, Homo sapiens
  misc_feature: GYAE6OF02I651K.7.10.A10.1.454.CMB.1.raw
  modified_base (255)..(255): a, c, t, g, unknown or other
  misc_feature (255)..(255): n is a, c, g, or t
  modified_base (337)..(342): a, c, t, g, unknown or other
  misc_feature (337)..(342): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaanagccacctctggggcacagcggcctgggctgctggtcaaggctacttccagagacacgctgagcggctggcaagcgcatagnnnnnn

SEQ ID NO: 880 - DNA, 354 bp, Homo sapiens
  misc_feature: GYAE6OF02FQZXS.7.10.A10.1.454.CMB.1.raw
  modified_base (345)..(354): a, c, t, g, unknown or other
  misc_feature (345)..(354): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgccctggtcaaggactacttccctagagacacgctgagcgggctggcaaggcgcatagnnnnnnnnnn

SEQ ID NO: 881 - DNA, 346 bp, Homo sapiens
  misc_feature: GYAE6OF02HDMIX.7.10.A10.1.454.CMB.1.raw
  modified_base (339)..(346): a, c, t, g, unknown or other
  misc_feature (339)..(346): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctgcaccctcctccaagagcacctctggggcacagcggccctgggctgccctggtcaaggactactcctagagaacgctgagcgggctggcaaggcgcatagnnnnnnnn

SEQ ID NO: 882 - DNA, 351 bp, Homo sapiens
  misc_feature: GYAE6OF02JADX7.7.10.A10.1.454.CMB.1.raw
  modified_base (344)..(351): a, c, t, g, unknown or other
  misc_feature (344)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactgggaccagggaaccctcgtcaccgtctcctcagcctccaccaagggcccatcggtcttccccctggcaccctcctccaagacgcacctctggggcacagcggccctgggctgccctggtcaaggactacttcctagagacacgctgagcgggctggcaaggcgcatagnnnnnnnn

SEQ ID NO: 883 - DNA, 345 bp, Homo sapiens; identical to SEQ ID NO: 823
  misc_feature: GYAE6OF02GK698.7.10.A10.1.454.CMB.1.raw
  modified_base (343)..(345): a, c, t, g, unknown or other
  misc_feature (343)..(345): n is a, c, g, or t

SEQ ID NO: 884 - DNA, 351 bp, Homo sapiens
  misc_feature: GYAE6OF02I604R.7.10.A10.1.454.CMB.1.raw
  modified_base (345)..(351): a, c, t, g, unknown or other
  misc_feature (345)..(351): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaacgggcccatcggtccttccccctggccaccctcctccaagacgcacctcgtgggggcacagcggccctgggctgcctggtcaaggactactcctagagacacgctgagcgggctggcaggcgcatgnnnnnnn

SEQ ID NO: 885 - DNA, 423 bp, Homo sapiens
  misc_feature: GYAE6OF02IWM5W.7.10.A10.1.454.CMB.1.raw
  modified_base (390)..(390): a, c, t, g, unknown or other
  misc_feature (390)..(390): n is a, c, g, or t
  modified_base (398)..(399): a, c, t, g, unknown or other
  misc_feature (398)..(399): n is a, c, g, or t
  modified_base (401)..(402): a, c, t, g, unknown or other
  misc_feature (401)..(402): n is a, c, g, or t
  modified_base (404)..(405): a, c, t, g, unknown or other
  misc_feature (404)..(405): n is a, c, g, or t
  modified_base (407)..(407): a, c, t, g, unknown or other
  misc_feature (407)..(407): n is a, c, g, or t
  modified_base (409)..(423): a, c, t, g, unknown or other
  misc_feature (409)..(423): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgcaccgtctcctcacgcctccaccgaagggcccagtccggtcccttcccccgtggcccacccctcctaccgaaagcgccacctcgcggggccacgacgcccggcccgtgggacctcgcccgtggtaccgaaggtaccttaccgttcccgtaagacgtaccaccggctaggacggccggggctcgggacgaagggtcncaagtagnngnngnncngnnnnnnnnnnnnnnn

SEQ ID NO: 886 - DNA, 452 bp, Homo sapiens
  misc_feature: GYAE6OF02HVGRF.7.10.A10.1.454.CMB.1.raw
  modified_base (403)..(403): a, c, t, g, unknown or other
  misc_feature (403)..(403): n is a, c, g, or t
  modified_base (405)..(452): a, c, t, g, unknown or other
  misc_feature (405)..(452): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaacccctcgtcgaccgtctcctcagccctaccaccaacgggcccatccggtccttccccccgtggccaccccttccctaccaaagacgccaccgtcgtggggggaccacgacgccgggcccctgggcctgccctggtcaaggtaccttaccgttcctaggagtaccgacgccgtaggacggccggggtcgtcgggacgtaagggccgacgagtaggncnnnnnnnnnnnnnnnnnnnnnnnnnnnnnnnnnnnnnnnnnnnnnnnn

SEQ ID NO: 887 - DNA, 356 bp, Homo sapiens
  misc_feature: GYAE6OF02GZXAM.7.10.A10.1.454.CMB.1.raw
  modified_base (346)..(356): a, c, t, g, unknown or other
  misc_feature (346)..(356): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctgggggcacagcggccctgggctgcctggtcaaggactacttccctagacgacacgctgagcgggctggcaaggcgcatagnnnnnnnnnnn

SEQ ID NO: 888 - DNA, 357 bp, Homo sapiens
  misc_feature: GYAE6OF02IX75R.7.10.A10.1.454.CMB.1.raw
  modified_base (344)..(357): a, c, t, g, unknown or other
  misc_feature (344)..(357): n is a, c, g, or t
tcagcgtgtctctacacgaccggtgctcgatttagcgtcgatctccagggacaacgccaagaagtcactgtatctataaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggacctacttcctagagacacgctgagcgggctggcaaggcgcatagnnnnnnnnnnnnnn

SEQ ID NO: 889 - DNA, 359 bp, Homo sapiens
  misc_feature: GYAE6OF02HL3AB.7.10.A10.1.454.CMB.1.raw
  modified_base (350)..(359): a, c, t, g, unknown or other
  misc_feature (350)..(359): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtccttccccctggccacccctcctccaagagccacctcgtgggggcacagcggccctgggctgcctggtcaaggacctacttcctagagacacgctgagcgggctggcaaggccgcatagnnnnnnnnnn

SEQ ID NO: 890 - DNA, 351 bp, Homo sapiens
  misc_feature: GYAE6OF02FV6PT.7.10.A10.1.454.CMB.1.raw
  modified_base (340)..(340): a, c, t, g, unknown or other
  misc_feature (340)..(340): n is a, c, g, or t
  modified_base (346)..(351): a, c, t, g, unknown or other
  misc_feature (346)..(351): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctcgtgggggcacagcggcctgggctgccctggtcaaggactacttcctagagacacgctgagcgggctggcaaggcncatagnnnnnn

SEQ ID NO: 891 - DNA, 345 bp, Homo sapiens
  misc_feature: GYAE6OF02IJQTU.7.10.A10.1.454.CMB.1.raw
  modified_base (336)..(336): a, c, t, g, unknown or other
  misc_feature (336)..(336): n is a, c, g, or t
  modified_base (338)..(345): a, c, t, g, unknown or other
  misc_feature (338)..(345): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaccctcgtcaccgtctcctcagcctccaccaaggccatcggtcttcccctggcaccctcctccaagagcacctcgtggggcacagccggccctgggctgcctggtcaaggactacttctagagacacgctgagcgggctggcaaggcgcangnnnnnnnn

SEQ ID NO: 892 - DNA, 342 bp, Homo sapiens
  misc_feature: GYAE6OF02I08U4.7.10.A10.1.454.CMB.1.raw
  modified_base (248)..(248): a, c, t, g, unknown or other
  misc_feature (248)..(248): n is a, c, g, or t
  modified_base (336)..(342): a, c, t, g, unknown or other
  misc_feature (336)..(342): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctgtcaccgtctcctcagcctccaccaaggcccatcgtctcccctgcaccctcctcagngcacctcgtggggcacgagccggccctggctgcctggtcaaggactacttcctagagacacgctgaggcggctggcaaggcgcatagnnnnnnn

SEQ ID NO: 893 - DNA, 347 bp, Homo sapiens
  misc_feature: GYAE6OF02I81P2.7.10.A10.1.454.CMB.1.raw
  modified_base (343)..(347): a, c, t, g, unknown or other
  misc_feature (343)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccagagccacctctgggggcacagcggccctgggctgcctggtcaaggactacttcctagagacacgctgagcgggctggcaaggcgcatagnnnnn

SEQ ID NO: 894 - DNA, 349 bp, Homo sapiens
  misc_feature: GYAE6OF02IV1RU.7.10.A10.1.454.CMB.1.raw
  modified_base (341)..(349): a, c, t, g, unknown or other
  misc_feature (341)..(349): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctgggctgcctggtcaaggctacttcctagagacacgctgagcgggctggcaaggcgcatagnnnnnnnnn

SEQ ID NO: 895 - DNA, 349 bp, Homo sapiens
  misc_feature: GYAE6OF02GELHJ.7.10.A10.1.454.CMB.1.raw
  modified_base (345)..(349): a, c, t, g, unknown or other
  misc_feature (345)..(349): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagagcacctctgggggcacagcggccctgggctgcctggtcaaggactacttcctagagacacgctgagcgggctggcaaggcgcatagnnnnn

SEQ ID NO: 896 - DNA, 356 bp, Homo sapiens
  misc_feature: GYAE6OF02HR7PR.7.10.A10.1.454.CMB.1.raw
  modified_base (252)..(252): a, c, t, g, unknown or other
  misc_feature (252)..(252): n is a, c, g, or t
  modified_base (307)..(307): a, c, t, g, unknown or other
  misc_feature (307)..(307): n is a, c, g, or t
  modified_base (322)..(322): a, c, t, g, unknown or other
  misc_feature (322)..(322): n is a, c, g, or t
  modified_base (339)..(356): a, c, t, g, unknown or other
  misc_feature (339)..(356): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaacccctgtcaccgtctcctcagcctccacaagggcccatcggtctccccctgcaccctctccaagngccacctctggggcacagcggccctgggctgcctggtcaaggctacttcctaganacacgctgagcgggntggacaaggcgcatagnnnnnnnnnnnnnnnnnn

SEQ ID NO: 897 - DNA, 369 bp, Homo sapiens
  misc_feature: GYAE6OF02I1ME8.7.10.A10.1.454.CMB.1.raw
  modified_base (358)..(369): a, c, t, g, unknown or other
  misc_feature (358)..(369): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctcctcagcctccaccaagggcccatccggtccttcccccctggccacccctcctcccaagacgccaccctcgtgggggcacagccggccctgggctgcctggtcaaggactacttccgtagagacacgctgagccgggctggcaaggcgacatagnnnnnnnnnnnn

SEQ ID NO: 898 - DNA, 350 bp, Homo sapiens
  misc_feature: GYAE6OF02HNVJR.7.10.A10.1.454.CMB.1.raw
  modified_base (256)..(256): a, c, t, g, unknown or other
  misc_feature (256)..(256): n is a, c, g, or t
  modified_base (344)..(350): a, c, t, g, unknown or other
  misc_feature (344)..(350): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggccaccctcctccaagngcacctcgtgggggcacagcggcctgggctgcctggtcaaggactacttcctagagacacggctgagcgggctggcaaggcgcatagnnnnnnn

SEQ ID NO: 899 - DNA, 363 bp, Homo sapiens
  misc_feature: GYAE6OF02F4BNX.7.10.A10.1.454.CMB.1.raw
  modified_base (349)..(363): a, c, t, g, unknown or other
  misc_feature (349)..(363): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggccaccctcctccaagacgcacctcgtggggcacagcggccctgggctgcctggtcaaggacctacttcctagagacacgctggagcgggctggacaaggcgcatacgnnnnnnnnnnnnnnn

SEQ ID NO: 900 - DNA, 368 bp, Homo sapiens
  misc_feature: GYAE6OF02HBNCN.7.10.A10.1.454.CMB.1.raw
  modified_base (346)..(368): a, c, t, g, unknown or other
  misc_feature (346)..(368): n is a, c, g, or t
tcagcgtgtctctacacgaccggtgctcgatttagcgtcgatctccagggacaacggccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaaggcccatcggtcttccccctggccaccctcctccaagagcacctctgggggcacagcggccctgggctgcctggtacaaggactacttcctagagacacgctgagcgggctggcaaggcgcatagnnnnnnnnnnnnnnnnnnnnnnn

SEQ ID NO: 901 - DNA, 370 bp, Homo sapiens
  misc_feature: GYAE6OF02HOF8Q.7.10.A10.1.454.CMB.1.raw
  modified_base (343)..(343): a, c, t, g, unknown or other
  misc_feature (343)..(343): n is a, c, g, or t
  modified_base (352)..(352): a, c, t, g, unknown or other
  misc_feature (352)..(352): n is a, c, g, or t
  modified_base (358)..(370): a, c, t, g, unknown or other
  misc_feature (358)..(370): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatccggtccttccccctggccacccctcctccaagagccacctcgtcgggggcacacggcggcccgtgggctgcctggtacaaggacctacttcctagacgacacgctgacggcgggcnggcaaggcncatagnnnnnnnnnnnnn

SEQ ID NO: 902 - DNA, 358 bp, Homo sapiens
  misc_feature: GYAE6OF02GHH97.7.10.A10.1.454.CMB.1.raw
  modified_base (349)..(358): a, c, t, g, unknown or other
  misc_feature (349)..(358): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtccttccccctgccaccctcctccaagacgcacctcgtgggggcacgagcggcccgtgggctgcctggtcaaggactacttccgtagagaccgcgtgacggcggctggcaggcgcatagnnnnnnnnnn

SEQ ID NO: 903 - DNA, 361 bp, Homo sapiens
  misc_feature: GYAE6OF02FYLOY.7.10.A10.1.454.CMB.1.raw
  modified_base (348)..(361): a, c, t, g, unknown or other
  misc_feature (348)..(361): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagaggataagtccgggtatcacttggatagaagtgcttattacattgactactggggccagggaaccctcgtcaccgtctcctcagcctccaccaaggcccatcgtcttccccctggccaccctcctccaagcgcacctctgggggcacagccggccctgggctgcctggtcaaggctacttcctagagacacgctggaggcgggctggacaacggcgcactagnnnnnnnnnnnnnn

SEQ ID NO: 904 - DNA, 419 bp, Homo sapiens
  misc_feature: GYAE6OF02F8BR2.7.10.A10.1.454.CMB.1.raw
  modified_base (393)..(419): a, c, t, g, unknown or other
  misc_feature (393)..(419): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaacggcccatccggtccttcccccctggccaccctcctaccaagacgccacctcgtcgggcacgacggccggccgtcggtcgtcgtccgtggtacgaacggtaccttaccttaccgtaggacgaccgtacgtcgtaggacggtccgggacgtacggacgaacggcgactaagtagannnnnnnnnnnnnnnnnnnnnnnnnnn

SEQ ID NO: 905 - DNA, 438 bp, Homo sapiens
  misc_feature: GYAE6OF02IHUVV.7.10.A10.1.454.CMB.1.raw
  modified_base (284)..(284): a, c, t, g, unknown or other
  misc_feature (284)..(284): n is a, c, g, or t
  modified_base (386)..(391): a, c, t, g, unknown or other
  misc_feature (386)..(391): n is a, c, g, or t
  modified_base (393)..(393): a, c, t, g, unknown or other
  misc_feature (393)..(393): n is a, c, g, or t
  modified_base (396)..(438): a, c, t, g, unknown or other
  misc_feature (396)..(438): n is a, c, g, or t
tcagcgtgtctctacacgaccggtgctcgatttagcgtcgatctccagggacaacgccaagaagtcactgtatctacaaatgaacagcctgagagcccgaggacacggccgtgtatttactgtgtgagagataagtccgggtatcacttggatagaagtgcttatacattgactactggggccaggggaacccctcgtcaccgtctcctcacgccctccaccaagggcccagtccggtcccttcccccgtggccaccccttcctaccaacgagccaccttcggnggggggaccaggccggtcccgtggggcctcgtccgtggtccaggacctactttccgaggacgaaccacgtctaggcggcgggctggcgaaggcgacagtagnnnnnngnatnnnnnnnnnnnnnnnnnnnnnnnnnnnnnnnnnnnnnnnnnnn

SEQ ID NO: 906 - DNA, 362 bp, Homo sapiens
  misc_feature: GYAE6OF02GTSSQ.7.10.A10.1.454.CMB.1.raw
  modified_base (351)..(362): a, c, t, g, unknown or other
  misc_feature (351)..(362): n is a, c, g, or t
tcagcgtgtctctacacgaccggtgctcgatttagcgtcgatctccagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtccttccccctggccacccctcctccaagacgcacctcgtgggggcacagcggccctgggctgcctggtcaaggactacttctagacgacacgctgagcgggctggacaacggcgcatagnnnnnnnnnnnn

SEQ ID NO: 907 - DNA, 350 bp, Homo sapiens
  misc_feature: GYAE6OF02HL8TG.7.10.A10.1.454.CMB.1.raw
  modified_base (335)..(335): a, c, t, g, unknown or other
  misc_feature (335)..(335): n is a, c, g, or t
  modified_base (341)..(350): a, c, t, g, unknown or other
  misc_feature (341)..(350): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttccccctggcaccctcctccaagagcacctctggggcacagcggccctggctgcctggtcaaggactacttcctagagacacgctgagcgggctggcaaggcncatagnnnnnnnnnn

SEQ ID NO: 908 - DNA, 372 bp, Homo sapiens
  misc_feature: GYAE6OF02HZQKH.7.10.A10.1.454.CMB.1.raw
  modified_base (255)..(255): a, c, t, g, unknown or other
  misc_feature (255)..(255): n is a, c, g, or t
  modified_base (344)..(344): a, c, t, g, unknown or other
  misc_feature (344)..(344): n is a, c, g, or t
  modified_base (351)..(372): a, c, t, g, unknown or other
  misc_feature (351)..(372): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcacgtctcctcagcctccaccaacgggcccatccggtccttcccccctggccacccctccnccaagagcacctcgtggggcacagccggccctggctgcctggcaaggactacttccagacgaccacgctgacggcgggctggcaaggcncgatagnnnnnnnnnnnnnnnnnnnnnn

SEQ ID NO: 909 - DNA, 358 bp, Homo sapiens
  misc_feature: GYAE6OF02FT245.7.10.A10.1.454.CMB.1.raw
  modified_base (323)..(323): a, c, t, g, unknown or other
  misc_feature (323)..(323): n is a, c, g, or t
  modified_base (345)..(345): a, c, t, g, unknown or other
  misc_feature (345)..(345): n is a, c, g, or t
  modified_base (351)..(358): a, c, t, g, unknown or other
  misc_feature (351)..(358): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccaccaagggcccatcggtcttcccccctggccacccctcctcccaagacgcacctcgtgggggcacagccggccctgggctgccctggtcaaggactacttcctagagacncgctgagcgggctggcaaggcncatagnnnnnnnn

SEQ ID NO: 910 - DNA, 347 bp, Homo sapiens
  misc_feature: GYAE6OF02IIA4A.7.10.A10.1.454.CMB.1.raw
  modified_base (318)..(318): a, c, t, g, unknown or other
  misc_feature (318)..(318): n is a, c, g, or t
  modified_base (340)..(347): a, c, t, g, unknown or other
  misc_feature (340)..(347): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctgtcaccgtctcctcagcctccaccaagggcccatcggtcttccccctggccaccctcctccaagagccacctctgggggcacagcggccctgggctgcctggtcaaggcctactcctagagacacgntgagcggctgcaagcgcatagnnnnnnnn

SEQ ID NO: 911 - DNA, 640 bp, Homo sapiens
  misc_feature: GYAE6OF02I1DME.7.10.A10.1.454.CMB.1.raw
  modified_base (119)..(119): a, c, t, g, unknown or other
  misc_feature (119)..(119): n is a, c, g, or t
  modified_base (419)..(419): a, c, t, g, unknown or other
  misc_feature (419)..(419): n is a, c, g, or t
  modified_base (637)..(637): a, c, t, g, unknown or other
  misc_feature (637)..(637): n is a, c, g, or t
tcagcgtgtctctacacgaccggtgctcgatttagcgtcgatctccagggacaacgccaagaagtcactgtatctacaaatgaacagcctgagagccgaggacacggccgtgtattacngtgtgagagataagtccgggtatacacgttgatagaagtgacttattacattgactactgggccagggaaccctcgtcaccgtctacctcacgcctccacgaacggccagtcggtcttacccctggccaacctcctacgaacgaacgcaaccttcgcggggtacaacgagccggtacctcgggacgtcggacctcggttacgaaacggtaccgttaaccgttaccttaacgggacgttaaaccgacgtaccgttacggaaacggttccggggacttacggggaccaaacggggggtaccnccggaactttaaagggacgacacggttaaagccttaaggccaggaacgcttagacgacgcgagacgacgtacgacgactacactacgagtacgacgactacgacacgacacgtagtacactagctacgtagagacagacgacacgacgacacgtacgacgtacatacgtacgtacgtacgtacgtaacgacgaagacgtacgacgacgaacgtagtanacg

SEQ ID NO: 912 - DNA, 421 bp, Homo sapiens
  misc_feature: GYAE6OF02GCNMY.7.10.A10.1.454.CMB.1.raw
  modified_base (366)..(366): a, c, t, g, unknown or other
  misc_feature (366)..(366): n is a, c, g, or t
  modified_base (368)..(369): a, c, t, g, unknown or other
  misc_feature (368)..(369): n is a, c, g, or t
  modified_base (372)..(421): a, c, t, g, unknown or other
  misc_feature (372)..(421): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaacccctcgtcaccgtctcctcagccctccaccaagggcccatcggtccttccccctggcccacccctcctccaagagcacctcgtagggggcacagccggccctgggcctgcctggcaaggctaccgttctaggagacacgtctggacggcgggctgggacgaacggcgactaagtaggnanncannnnnnnnnnnnnnnnnnnnnnnnnnnnnnnnnnnnnnnnnnnnnnnnnn

SEQ ID NO: 913 - DNA, 449 bp, Homo sapiens
  misc_feature: GYAE6OF02HPV5Y.7.10.A10.1.454.CMB.1.raw
  modified_base (250)..(250): a, c, t, g, unknown or other
  misc_feature (250)..(250): n is a, c, g, or t
  modified_base (386)..(387): a, c, t, g, unknown or other
  misc_feature (386)..(387): n is a, c, g, or t
  modified_base (391)..(449): a, c, t, g, unknown or other
  misc_feature (391)..(449): n is a, c, g, or t
tcagcgtgtctctacacgaccggtgctcgatttagcgtcgatctcagggacaacgccaagaagtcactgtatctacaaaatgaacagcctgagagccgaggacacggccgtgtattactgtgtgagagataagtccgggtatcacttggatagaagtgctttattacattgactacgtgggggccagggaaccctcgtcaccgtctccctcagcctccaccgaacgggcccatccggttccttcccccgnggccacccctcctccaagcgccacctcggtgggggcctacgacgccggcccgtgggcctacggccttggtaccaaggtacctaccttccgtaagagaccacgcgtgacggcgggactggacgaaggcgcagtacgnngacnnnnnnnnnnnnnnnnnnnnnnnnnnnnnnnnnnnnnnnnnnnnnnnnnnnnnnnnnnn

SEQ ID NO: 914 - DNA, 445 bp, Homo sapiens
  misc_feature: GYAE6OF02IBXS9.7.10.A10.1.454.CMB.1.raw
  modified_base (265)..(265): a, c, t, g, unknown or other
  misc_feature (265)..(265): n is a, c, g, or t
  modified_base (383)..(383): a, c, t, g, unknown or other
  misc_feature (383)..(383): n is a, c, g, or t
  modified_base (392)..(445): a, c, t, g, unknown or other
  misc_feature (392)..(445): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaacccctcgtccaccgtctcctcagccctccaccaagggcccatccggtccttcccccgtggccacccctcctccaagngccaccgtcgtgggggcacgagtccggccccgtgggcctggtccctggtaccgaaggtacccttacgttaccccgtaggacgaccaccgtcgtcggacgcggggcttcggcgaaggcncgatacgcnnnnnnnnnnnnnnnnnnnnnnnnnnnnnnnnnnnnnnnnnnnnnnnnnnnnnn

SEQ ID NO: 915 - DNA, 399 bp, Homo sapiens
  misc_feature: GYAE6OF02HTQXL.7.10.A10.1.454.CMB.1.raw
  modified_base (346)..(399): a, c, t, g, unknown or other
  misc_feature (346)..(399): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctgtcacgtctcctcagcctccaccaagggcccatcggtcttccccctggccacccctcctccaagagccacctctgggggcacagcgcctgggctgcctggtcaaggactacttccagagcagctgacgcgggtctggcgaaggcgtacaataggnnnnnnnnnnnnnnnnnnnnnnnnnnnnnnnnnnnnnnnnnnnnnnnnnnnnnn

SEQ ID NO: 916 - DNA, 442 bp, Homo sapiens
  misc_feature: GYAE6OF02F286W.7.10.A10.1.454.CMB.1.raw
  modified_base (369)..(369): a, c, t, g, unknown or other
  misc_feature (369)..(369): n is a, c, g, or t
  modified_base (408)..(442): a, c, t, g, unknown or other
  misc_feature (408)..(442): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgacttattacattgactacgtggggccacgggaacccctcgtccaccgtctcctcacgccctccaccgaacgggccccagttccggttcccttccccccgtggccctacccctcctacccaagacgcctaacccgtcggtcggggaccacgcggcccggcccggtggtctcggcccgtggtaccgaacggtaccttaccttacgagacgaccncgcgtaggacggcgggcgtggacgaacggcactagtagnnnnnnnnnnnnnnnnnnnnnnnnnnnnnnnnnnn

SEQ ID NO: 917 - DNA, 467 bp, Homo sapiens
  misc_feature: GYAE6OF02GKH4X.7.10.A10.1.454.CMB.1.raw
  modified_base (283)..(283): a, c, t, g, unknown or other
  misc_feature (283)..(283): n is a, c, g, or t
  modified_base (403)..(404): a, c, t, g, unknown or other
  misc_feature (403)..(404): n is a, c, g, or t
  modified_base (407)..(407): a, c, t, g, unknown or other
  misc_feature (407)..(407): n is a, c, g, or t
  modified_base (411)..(453): a, c, t, g, unknown or other
  misc_feature (411)..(453): n is a, c, g, or t
  modified_base (455)..(467): a, c, t, g, unknown or other
  misc_feature (455)..(467): n is a, c, g, or t
tcagcgtgtctctacacgaccggtgctcgatttagcgtcgatctcagggacaacgccaaagaagtcactgtatctacaaatgaacagcctgagagccgaggacacggccgtgtattactgtgtgagagataagtccgggtatcacttggatagaagtgcttattacattgactacgtggggccagggaacccctcgtccaccgtcctcctcagccctccaccgaagggccccaatccggtccttcccccctggcccacccctccctccaagacgccacctcgngggggcacgagccggcccgtgggctgcccgtggtacgaaacggtacttaccttcctaaggacgaccaccggtctcggacggccggggtctgggaccgaacgggtaccgacgtagtaggcnngcntgcnnnnnnnnnnnnnnnnnnnnnnnnnnnnnnnnnnnnnnnnnnngnnnnnnnnnnnnn

SEQ ID NO: 918 - DNA, 398 bp, Homo sapiens
  misc_feature: GYAE6OF02JZZWW.7.10.A10.1.454.CMB.1.raw
  modified_base (209)..(209): a, c, t, g, unknown or other
  misc_feature (209)..(209): n is a, c, g, or t
  modified_base (257)..(257): a, c, t, g, unknown or other
  misc_feature (257)..(257): n is a, c, g, or t
  modified_base (340)..(340): a, c, t, g, unknown or other
  misc_feature (340)..(340): n is a, c, g, or t
  modified_base (348)..(348): a, c, t, g, unknown or other
  misc_feature (348)..(348): n is a, c, g, or t
  modified_base (351)..(398): a, c, t, g, unknown or other
  misc_feature (351)..(398): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacatttagactactggggccagggaaccctcgtcaccgtctccctnagcctccaccgaggccatccggtcttccccctgcaccctctccaagcncactcgtggggcacagcgccctgggctagccgtggtacgaaggactacttccagacgacacgctgacgcgggctggcaaggcncatacggncgnnnnnnnnnnnnnnnnnnnnnnnnnnnnnnnnnnnnnnnnnnnnnnnn

SEQ ID NO: 919 - DNA, 400 bp, Homo sapiens
  misc_feature: GYAE6OF02HTPFL.7.10.A10.1.454.CMB.1.raw
  modified_base (258)..(258): a, c, t, g, unknown or other
  misc_feature (258)..(258): n is a, c, g, or t
  modified_base (356)..(357): a, c, t, g, unknown or other
  misc_feature (356)..(357): n is a, c, g, or t
  modified_base (360)..(400): a, c, t, g, unknown or other
  misc_feature (360)..(400): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaatgcttattacatttgactactgggaccagggaaccctcgtcaccgtctcctcagcctccaccaagggcccatcggtcttccccctggcaccctcctccaagacncacctcgtcgggggcacagccggcccgtcgggctgccctaggtcaaggacctacttcctagagacacgctgacgcgggctgacgaaggcgacatacgnncgnnnnnnnnnnnnnnnnnnnnnnnnnnnnnnnnnnnnnnnnn

SEQ ID NO: 920 - DNA, 401 bp, Homo sapiens
  misc_feature: GYAE6OF02IUEC5.7.10.A10.1.454.CMB.1.raw
  modified_base (373)..(374): a, c, t, g, unknown or other
  misc_feature (373)..(374): n is a, c, g, or t
  modified_base (376)..(401): a, c, t, g, unknown or other
  misc_feature (376)..(401): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactactggggccagggaaccctcgtcaccgtctcctcagcctccacaggccatcgtccttccccctgccaccctcctccaagacgcacctcgtggggcacacgccggcccgtggggctcgccgtggtacaacggtaccttaccttccgtaggacgaccgaccgcgtggacggccggggcgtgggaccgaagggccgcaagtagnngnnnnnnnnnnnnnnnnnnnnnnnnnn

SEQ ID NO: 921 - DNA, 462 bp, Homo sapiens
  misc_feature: GYAE6OF02JSDXE.7.10.A10.1.454.CMB.1.raw
  modified_base (410)..(410): a, c, t, g, unknown or other
  misc_feature (410)..(410): n is a, c, g, or t
  modified_base (415)..(415): a, c, t, g, unknown or other
  misc_feature (415)..(415): n is a, c, g, or t
  modified_base (417)..(417): a, c, t, g, unknown or other
  misc_feature (417)..(417): n is a, c, g, or t
  modified_base (419)..(419): a, c, t, g, unknown or other
  misc_feature (419)..(419): n is a, c, g, or t
  modified_base (423)..(462): a, c, t, g, unknown or other
  misc_feature (423)..(462): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccgggtatcacttggatagaagtgcttattacattgactacgtggggccagggaaccctcgtcaccgtctccctcagcctccaccaacgggcccatccggtccttccccccgtggcccacccctcctcccaagacgcaccctcgtggggccacgagccggccgtgggcctggtaccctcgggtacaaacgggacttacccgttccgtaacgacgtaccgaccgtccgtggaaccggtccggggctacgggccaaacggggccgaccgtaaagtcggncgacngntngagnnnnnnnnnnnnnnnnnnnnnnnnnnnnnnnnnnnnnnnn

SEQ ID NO: 922 - DNA, 648 bp, Homo sapiens
  misc_feature: GYAE6OF02HC7QJ.7.10.A10.1.454.CMB.1.raw
  modified_base (250)..(250): a, c, t, g, unknown or other
  misc_feature (250)..(250): n is a, c, g, or t
  modified_base (270)..(270): a, c, t, g, unknown or other
  misc_feature (270)..(270): n is a, c, g, or t
  modified_base (449)..(449): a, c, t, g, unknown or other
  misc_feature (449)..(449): n is a, c, g, or t
  modified_base (513)..(513): a, c, t, g, unknown or other
  misc_feature (513)..(513): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataacgtccgggtatcacttggatagaagtgcttattacattgactacgtggggccgaacggtacctcgtcctaccgtcctcctcaccgcctaccacgacggcctacgtccgtcccttcccgngccctaccctccgacagacncctaccgtcggtcgggcacgcggcccggtccgtggctcgtccgtacggtactaacggtaccttaccgttaccgtacggaaccgaaccgccggtacgtagggaccggggtcccggtacgggttacggggaaacccgtacggggaccctaacgttaaacggccgtgacgacgttaaggacngtacgtcgcgtcacgacgtcgtcgcacgtacgctacgcgtcgtcgacgtcgagtcgtacgtcgngacgacgtacgtacgtacgtcgcgtgcgtacgtacgacgacgtacgtaccggcgacgtacgtcgtcgacgtaccgacgtcgttacgtcgtactcgtagtacgtcggtacgtactacgtaccgacgtacgtgtacg

SEQ ID NO: 923 - DNA, 487 bp, Homo sapiens
  misc_feature: GYAE6OF02ILWWF.7.10.A10.1.454.CMB.1.raw
  modified_base (450)..(487): a, c, t, g, unknown or other
  misc_feature (450)..(487): n is a, c, g, or t
tcagcgtgtctctacacgaccggtgctcgatttagcgtcgatctcagggacaacgccaagaagtcactgtatctacaaatgaacagcctgagagccgaggacacgggccgtgtattactgtgtgagagataagtccgggtatcacttggatagaagtgcttatacattgactacgtggggccagggaaccctcgtcaccgttcctcctcgagccctcccaaccgaacgggccccagttccggttcccttacccccccgtggacccaccccctcccttacccgaaagcgcctaccccttcggtcgggggcaacgacggcccgggtccccgtggggcctcgacccgttagggtccgaaacgggtcccttaccgttttcccgaaggaccgacgaccggtcctagggagggtccggggtccgttaggaccgaaagggtccggacctaaggtagnnnnnnnnnnnnnnnnnnnnnnnnnnnnnnnnnnnnnn

SEQ ID NO: 924 - DNA, 478 bp, Homo sapiens
  misc_feature: GYAE6OF02JDUJD.7.10.A10.1.454.CMB.1.raw
  modified_base (418)..(418): a, c, t, g, unknown or other
  misc_feature (418)..(418): n is a, c, g, or t
  modified_base (420)..(420): a, c, t, g, unknown or other
  misc_feature (420)..(420): n is a, c, g, or t
  modified_base (422)..(425): a, c, t, g, unknown or other
  misc_feature (422)..(425): n is a, c, g, or t
  modified_base (427)..(431): a, c, t, g, unknown or other
  misc_feature (427)..(431): n is a, c, g, or t
  modified_base (433)..(478): a, c, t, g, unknown or other
  misc_feature (433)..(478): n is a, c, g, or t
tcagcgtgtctctacacgaccggtgctcgatttagcgtcgatctcagggacaacgccaagaagtcactgtatctacaaatgaacagcctgagagaccgaggacacggccgtgtattactgtgtgagagataagtccgggtatcacttggatagaagtgcttattacattgacttacgtggggccgagggaaccctcggtcacccgtcctcctcacgcctacccaccgaacgggccctacgttcccggttcccttccccccgtaggcccacccctccctacccaaaggacgccaccctacggtgggggaccaccgagcccgggcccgttgggcctcggcctggcgaaacggaccttaaccgttccaaggactacgaccgtctaggcgcggggactcggacgaggcccgactaagtgacngngnnnncnnnnngnnnnnnnnnnnnnnnnnnnnnnnnnnnnnnnnnnnnnnnnnnnnnn

SEQ ID NO: 925 - DNA, 709 bp, Homo sapiens
  misc_feature: GYAE6OF02H1FUC.7.10.A10.1.454.CMB.1.raw
  modified_base (526)..(526): a, c, t, g, unknown or other
  misc_feature (526)..(526): n is a, c, g, or t
  modified_base (532)..(532): a, c, t, g, unknown or other
  misc_feature (532)..(532): n is a, c, g, or t
  modified_base (538)..(538): a, c, t, g, unknown or other
  misc_feature (538)..(538): n is a, c, g, or t
  modified_base (540)..(540): a, c, t, g, unknown or other
  misc_feature (540)..(540): n is a, c, g, or t
  modified_base (546)..(546): a, c, t, g, unknown or other
  misc_feature (546)..(546): n is a, c, g, or t
  modified_base (552)..(552): a, c, t, g, unknown or other
  misc_feature (552)..(552): n is a, c, g, or t
  modified_base (558)..(558): a, c, t, g, unknown or other
  misc_feature (558)..(558): n is a, c, g, or t
  modified_base (602)..(602): a, c, t, g, unknown or other
  misc_feature (602)..(602): n is a, c, g, or t
  modified_base (624)..(624): a, c, t, g, unknown or other
  misc_feature (624)..(624): n is a, c, g, or t
tcagcgtgtctctacacgaccggtgctcgatttagcgtcgatctcagggacaacgccaagaagtcactgtagtctacaaatgaacagcctgagagccgaggacaccggcgtgtattactgtgtgagagaataagtccggtatcacttggatagaagtgactttagttacattgactacgtggggccacgggaaccctcgtcaccgtctccgtcagtccctccgaccgtaacgggccctaagtcccgggtaccctttccccccgtaggccctaaccccccttccgtaccgaaagggtacctaacccgtaccggttccggggtacggggaaccgtaccggacgggtccccgggtacccggtacggggtccgtaccggtacccggttacgggtaaccggtaacggtaaccgttaaccgttaacccgtaaccggtaaacgtaccggtaaccggtccgtaacgggaccggtaccggggtaccgtacgggtaaccggtaaacggggccgtacgtaaggtacgacgtacgtcnctacgngtacgntnacgctnctagcntagtanctacgctaacgctacagtccgaagtgcgcgtaatcgtagaagtntcacacgtacgtatcgtagacncgtacgtacgacagacgacgacgacgtacgtacgagtaccgtacgacggtaccggacgtagctcctacgtacgtccgtacgtacg

SEQ ID NO: 926 - DNA, 392 bp, Homo sapiens
  misc_feature: GYAE6OF02F0CF1.7.10.A10.1.454.CMB.1.raw
  modified_base (367)..(392): a, c, t, g, unknown or other
  misc_feature (367)..(392): n is a, c, g, or t
tcagcgtgtctctacacgaccggtgctcgatttagcgtcgatctcagggacaacgccaagaagtcactgtatctacaaatgaacagcctgagagccgaggacacggccgtgtattactgtgtgagagataagtccggtatcacttggatagaagtgcttattacattgactacgtggggccagggaaccctcgtcaccgtctcctcagcctccacgacggcccagtccgtccttccccctggccaccctcctaccaagacgccacctcggtgggggaccacgagccggcccgtcgggctcgccgtggtcaacggcctacttccgtagacgacacgctggacggtcggctgggacgaggcgccatagnnnnnnnnnnnnnnnnnnnnnnnnnn

SEQ ID NO: 927 - DNA, 492 bp, Homo sapiens
  misc_feature: GYAE6OF01BFOBH.13.36.D03.1.454.CMB.1.raw
  modified_base (414)..(414): a, c, t, g, unknown or other
  misc_feature (414)..(414): n is a, c, g, or t
  modified_base (458)..(458): a, c, t, g, unknown or other
  misc_feature (458)..(458): n is a, c, g, or t
tcagtcacgtactacacgaccggtgctcgatttagctgcgtcacgatctctcttgggggggtcagagctctggggaggaactgctcagttaggacccagacggaaacatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagagcctggccaggctcccaggctcctcatttatggtgcatccactagggccactggtgtcccagtcaggttcaggcggcaggtgggtctggggacagacttcactctcaccatcagcagcctgcagtctagaanatattgacaactattattactgtcagcagtatagatatctccgntccaccttcggaccaagggaccacggctggaacg

SEQ ID NO: 928 - DNA, 542 bp, Homo sapiens
  misc_feature: GYAE6OF01BU8LF.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaggctgaggacactgcctatttattactgtgtgagtagtactttcttttccgttgtacttacggttctttctcgttccttggtaccttagtcgggggtccctaggggtaaccccg

SEQ ID NO: 929 - DNA, 503 bp, Homo sapiens
  misc_feature: GYAE6OF01EG8XT.13.36.D03.1.454.CMB.1.raw
tcagtcacgtactacacgaccggtgctcgatttagctgcgtcacgatctctcttggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatcccactagggccactggtgtcccagtcaggttcagcggcagtgggtctgggacagacttcactctcaccatcagcagcctgcagtctgaagtatttgcagtctattactgtcagcagtatagttactggacgtaaccgttcggccaagggacacggtactaggagaagttaaaggaacgtagg

SEQ ID NO: 930 - DNA, 534 bp, Homo sapiens
  misc_feature: GYAE6OF01ALEFR.13.36.D03.1.454.CMB.1.raw
  modified_base (219)..(219): a, c, t, g, unknown or other
  misc_feature (219)..(219): n is a, c, g, or t
  modified_base (399)..(399): a, c, t, g, unknown or other
  misc_feature (399)..(399): n is a, c, g, or t
tcagtcacgtactacacgaccggtgctcgatttagctgcgtcacgatctctcttggggggtcagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaangccaccctctcctgccagggccagtcagacagttagcaacaacgtagcctggtaccagcagaaacgtggccaggctcccaggctcctcatctatggtgcatccacacgggccactggtactcccagaccgttcagtggcaggtgggtctgggacagacttcactctcacatcagcagtcngcagtcgtgtagtatttgtctagtttattactgtctagtctagtataactaactcggaccttaccgtactagttcgtacgtacgttttcggaccgtaacgggaccgtaaccgtacggaagtacgtcgagtaacgg

SEQ ID NO: 931 - DNA, 517 bp, Homo sapiens
  misc_feature: GYAE6OF01D9COM.13.36.D03.1.454.CMB.1.raw
  modified_base (314)..(314): a, c, t, g, unknown or other
  misc_feature (314)..(314): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttanggtgcatccacgtacgggccacgtggtcgtcccagtcaggttcagcggaagtgggtctgggacagacttcactctcacatcagcagcctgcagtctagaagtatttgctagtctattactgtcagcagtatagttactaggtacgtaaccgttcggaccgaagggaccaggacgtaggaagtaagttaaacggagtggtacgg

SEQ ID NO: 932 - DNA, 509 bp, Homo sapiens
  misc_feature: GYAE6OF01BUMH6.13.36.D03.1.454.CMB.1.raw
  modified_base (220)..(220): a, c, t, g, unknown or other
  misc_feature (220)..(220): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactagtggagaaatagtgatgacgcagtctccagccaccctgtctgtgtctccaggggaaanagccaccctctcctgcagggccagtcagacagttagcaacaacgtagcctggtaccagcagaagcctggccaggcccccaggctcctcatctacgatgtattcaggaggaccactgacatcccagacaggttcagtggcagtgggtctgggacagacttcactctcaccatcagcagactggaacctgaagactttgctacttttattcttgtcactagttatgggtaggtcaaccgtactacttttggacctaggggaccaagctggagatcaagcgaatgtggctcg

SEQ ID NO: 933 - DNA, 522 bp, Homo sapiens
  misc_feature: GYAE6OF01EP0SA.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccgaggcctcctcatttatggtgcatcccacgtagggccacgtggtcgtcccagtcaggttcaggcggcaggtgggtctgggacagtacttcactctcacatcagcacgcctgcagtctagaagtatttgctagttctattactgtacagtcagttattagttacgtaggtacgtaaccgtcggaccgaagggacacggactaggaagaagttaaaggagtagg

SEQ ID NO: 934 - DNA, 562 bp, Homo sapiens
  misc_feature: GYAE6OF01EAMCL.13.36.D03.1.454.CMB.1.raw
  modified_base (280)..(280): a, c, t, g, unknown or other
  misc_feature (280)..(280): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtncgacaggctctggacaaggcttgagtggatgggatggatcgacatcaacacgtagggaacccaacgtatgccccgaagggtccttacgacgtaggtacggttttgtctttctccgtttggacctaccttctgttcacgtcacggcgtagtgtacagatcagcagaccgtaaaggctagaggactactcgcctatttattactgtgtagagtattattctttccgtgtacttacggttcttcgtgttccgttgacgttacggtcgggtccgtagggtaacccg

SEQ ID NO: 935 - DNA, 524 bp, Homo sapiens
  misc_feature: GYAE6OF01A3EXF.13.36.D03.1.454.CMB.1.raw
  modified_base (493)..(493): a, c, t, g, unknown or other
  misc_feature (493)..(493): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatgcccagggcttcacaggacgtttgtcttctccttggacacctctgtcagcacggcgtatgtacagatcagcagcctaaaggctagaggacactgcctatttattactgtgtgagagtattctttctgtacttacggtcttcgtntccttgacttacgtggggtccagggtacccg

SEQ ID NO: 936 - DNA, 532 bp, Homo sapiens
  misc_feature: GYAE6OF01BDIP1.13.36.D03.1.454.CMB.1.raw
  modified_base (427)..(427): a, c, t, g, unknown or other
  misc_feature (427)..(427): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagagcctggccaggctcccaggctcctcatttatggtgcatcccacgttacgggccacgtgggtcgtccccaggtcaggtttccaggcggcaggtgggtctggggacagtacttcactctcaccatcagcagcctgcagtctgaagtntttgctagtcttattactgtcagctagtattagttacgtaggacgtaacccgttcggacccgaagggacacggtacgtagggaagtaacgttaaaggacgtaggg

SEQ ID NO: 937 - DNA, 838 bp, Homo sapiens
  misc_feature: GYAE6OF01B600J.13.36.D03.1.454.CMB.1.raw
  modified_base (319)..(319): a, c, t, g, unknown or other
  misc_feature (319)..(319): n is a, c, g, or t
tcagtcacgtactacacgaccggtgctcgatttagctgcgtcacgatctctcttggggggtcagagctctggggaggaactgctcagttaggacccagacggaaccatggaagcccagcgcagcttctcttcctcctgctactctggctcccagatactactggagaaatagtgctgacgcagtctccagtccaccctgtctgtgtctccgaaggggaaatagccaaccctctcctgcagggccagtcagagtgttagcagcagcttagcctggtaccagcagaagcctggccaggcctcccaggctcctctatttagnggtcgctactcccaacgtacgggcctacgttcgggtcgtacccctaaggtcccgtaagggtttccaacgggtcccgggaccgtaaggggtttcggggggtaccgttacggggggaaccgtaacgggttaacccttttaccgtaacccgttacccgtttaacccgaaacccctaaacgttacccgtaaacggtacccgtaaaccggtccccgttacgggacccgtaacgggttacccgtttaagggttaaaacgggtttaacgtttttttacggaacccgttaacggtttaaccctttaaacgtttttaaccgtttacggttacccgtaacggtacccgttaaaggtttaaacgtttaaacggttttaaaccggttaacggggttaaaccggttaaaccccggtttaacccggggtaacccgggtaaaaccgggggtaaacccgtaaacccgggtaaaccggttaacggggtaaacgggttaaaacggtttaaaaaacggggtaaaccggtttaacgggg

SEQ ID NO: 938 - DNA, 772 bp, Homo sapiens
  misc_feature: GYAE6OF01AG6B9.13.36.D03.1.454.CMB.1.raw
tcagtcacgtactacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatcaccatctcctgcactggaaatgcagtgatgttggacttatgtaccttgtctcctggtaccgacaacacccaggaccaaacgcccccaaactctattagtttacggggtactaagtaacgccggtccctcgacgggtcttttcgtgtacttccgtctttcgtccttcgggtccttacccgtaagttccgttacgggacctaaaccgaccgggtccccttacccgtacgtaacctaacttcccgttccgttacgggacccttcccggaacgggccccggtaagggtaccggaacgggtccgttacggttaacgtttttttacgtcggttttacgtttacctaagtttacgtacggtaccggtaaggggtaaaggttaacggtttaggtaacgtttttaaggttaccggtttacggttttaagggggaaacggtttaccgggggtaacccttaaaacggggttcccgtaacccgggttttaccggttaccgggttaccgtaacccgggtaccccgtaaaccgggtacccccctaaacccccggtaccgttccggttacccgtaaccccgg

SEQ ID NO: 939 - DNA, 740 bp, Homo sapiens
  misc_feature: GYAE6OF01DVV6X.13.36.D03.1.454.CMB.1.raw
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactaggaaatagcagtgatgttgggtacttagtgtaccttgtcctccgtacggtaccgacaaccacccgaggaccaaaccgaccccctaaatcctaatttacgtttacggggtacaaagtaacgccggtaccctacgacgggtccttttcgtagtacttccgtctttctccgttcggtaccttaccgtaacgttcgtacggaccaaaccgtcccggtccccttacccgtacgaacctaacgttccgttaccgtacgggtacccttacccggaacgggtacccggaagggaacccggtagggtccgtttagtttaacgttttttacgttcggttttcgtttactaagttagtcggtaacggtaagggtaagggtagttagttaagtttacgttggttacggtttacgggaagggttaccgggtaaccgtaaacgggttcccgtacccggttaccggttcgggtaccgaaccggaccccgtaaacggtaccccctaaaccccgtacgttcgtacccttacccg

SEQ ID NO: 940 - DNA, 576 bp, Homo sapiens
  misc_feature: GYAE6OF01BIB6Z.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctccgtggacaagggcttgagtggatgggatggatcgacatcaacacgtacgggaacccaagtatcgcccgaggtcttacgacgaggtacggtttgtcttctccgttggacctaccgttctcgtcagccgtacggtcgtatgtacagtactcagcagcctaaaggctagaggacacgtgaccttatttactacgtgtgtagagtagttctttcgtttacctgtaccgttacggttctttccgttcgttaccttaggtaccttacggtcggggccgtacgggtaaccccg

SEQ ID NO: 941 - DNA, 601 bp, Homo sapiens
  misc_feature: GYAE6OF01BQH5K.13.36.D03.1.454.CMB.1.raw
  modified_base (281)..(281): a, c, t, g, unknown or other
  misc_feature (281)..(281): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctggggtctgagttgaagaaacctggggcctcagtgaaggtttcctgcaaggcgtctggatacacgttcactacttatgctatgaattgggtncgacaggctcctggacaagggcttgagtggatgggatggatcgacatcaacacgtgggaacccaagtatgacccgagggcttcgacagggtacggtttgtcttctccgttggactaccgtctagttcgaaggtccacgggtcgtagtcgttacaggactcgagcagaccgtaaaggcctggaggacacgtcgcctaattttacttacgtggttagtcgtagacgttatttcccgttttacgtcgtaacgttaccgggttactttccgtacgtttcccgttacgtaccgttagtccgggggtacctaacgggggtaacccg

SEQ ID NO: 942 - DNA, 589 bp, Homo sapiens
  misc_feature: GYAE6OF01A6IRM.13.36.D03.1.454.CMB.1.raw
  modified_base (340)..(340): a, c, t, g, unknown or other
  misc_feature (340)..(340): n is a, c, g, or t
  modified_base (380)..(380): a, c, t, g, unknown or other
  misc_feature (380)..(380): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatggttgggacttatgtaccttgtctcctggtaccgacaacacccaggacaaacgcccccaaatccattagtttacgggcaataacgcgccctcgaggtctttcngatcgtcttctctggctcaagtctggcaacacgcctcccngacatctctcggactccgacggccgaggacgagggcttagtaatttttacgtgtttgttacattacgtgacgaagggtaagggtagttagtagtttatggttacgtttagggaaggttcgggaaacctaaggttccgtacccggttcgttgggtaccaaccggtcccctaaacgggtaccccctaaacccctcgttcgtaccgtacccg

SEQ ID NO: 943 - DNA, 662 bp, Homo sapiens
  misc_feature: GYAE6OF01BOLBP.13.36.D03.1.454.CMB.1.raw
  modified_base (256)..(256): a, c, t, g, unknown or other
  misc_feature (256)..(256): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaccgtggggcctcagtgaaggtctcctgcaaggcttccggatacaccctnaatggaaactatgtccactatgtgcgacaggccccaggacaagggcttcgtggtggagtgggggtggactacgaacccgtaagtaggtggtagaacaacaaaacgttagtaggaagaaaggtaaagtttgggaacggggtcccgggtacaaccgtagtacggaaccgaagggaccacgtaccaatacaatacgacgtccttacagtacggaactacgaaccagtacgtacgacctcgtacggaaccgacgaccggtccgtagttaacttacgtcggtacggtaccggtaacgtaaacctcgtaaccgtaccttaacgttacgtttaggtaacggttttcggggaccgtacgggtccggtcccgtacggtccgtacccgttcctccgtaccgcgtcccgtaccccgg

SEQ ID NO: 944 - DNA, 774 bp, Homo sapiens
  misc_feature: GYAE6OF01D1P8S.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatacgcaaccctctcctgcagggccagtcagagtgttagcagcagcttagcctaggtaccagcagacgcctggccaggcctcccgaggtcctcctctagtttacgtggtgccatcccgacgtacgggccctaacgttcgggtcgtccccgaggttccgtagggttcacggtccgggcgtaacgggttggggttaccgtaggggaaccgtaacggtacccgtttaccgaccgtttacctacccgtaaccgtaacgttaccgaacggtaccgaacggtccccgttaggtaccgtaacgggttccgttaaggtaaacggtttacgtttttacggaccgttaacggtttacctttaacgttttaaccgttacggttaccgtaacggtaccgttaaacggtttaaacgttacggttttaaccggtacggggttaaacccggttaaacccggtttacccgggtaaaccccggtaaaacgggggttacccaaaccggggttaaccggtttaaacgggaaaggtttaaaaccgggtttaaaacggggtaaacgttaacggggg

SEQ ID NO: 945 - DNA, 694 bp, Homo sapiens
  misc_feature: GYAE6OF01A63DF.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctccgtggacaagggcttgaggtggatgggatggatcgacatcaaacacgtacgggaacccaacgtatcggaccccgagggtcttacgacgaagggtaccggttttgtcctttccgttcccgttgggaccctacccttcgttcgtccgaggccgtaaccgggtcgttaatcggttaacaaggtaactccgaaggccgaaggtacccctaaaagggtcctagggaacggtaccacgttcgtacccgttaatttttacgttacgttgggtcggttaacggaaggttagttaccttttccgtttttacccgttagtaacccgtttacgggttaactttccgttacggtttccccgtttaggtaacccgtttacgggtaccgggggtcccgtaaacgggggttaaccccgg

SEQ ID NO: 946 - DNA, 645 bp, Homo sapiens
  misc_feature: GYAE6OF01D7HFB.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaaccgtggggcctcgagtgaaggtttcctgcaaggcgtctggatacacgttcactacttatgctatgaagttgggtgcgacgaggcctccgtggacgaagggtcttgaggtggagtgggatgggatcgacatacaacacgtacgggaaacccaagtatcgacccgagggtccttacaacgtaggtacggtttcgtcctttcgtccgttaggacctacccttcgttcgtcgacggccgaacgggtcgtaatcggtaacagtactcgaagccaacggtacccgtaaagggctaaggaacggaactacgtgacccttagttttactacgtggtagtagtagtagttactttccgtttccgttacgtaaccgtttacggttcctttcgttacgttcccgttagtaccgttacgggttccgggacccgtaaccgggtaacccgg

SEQ ID NO: 947 - DNA, 510 bp, Homo sapiens
  misc_feature: GYAE6OF01DHS2B.13.36.D03.1.454.CMB.1.raw
  modified_base (267)..(267): a, c, t, g, unknown or other
  misc_feature (267)..(267): n is a, c, g, or t
  modified_base (361)..(361): a, c, t, g, unknown or other
  misc_feature (361)..(361): n is a, c, g, or t
  modified_base (477)..(477): a, c, t, g, unknown or other
  misc_feature (477)..(477): n is a, c, g, or t
tcagtcacgtactacacgaccggtgctcgatttagctgcgtcacgatctctcttgggggggtcacaagaggcagcgctctcgggacgtctccaccatggcctgggctctgctcctcctcagcctcctcactcagggcacaggatcctgggctcagtctgccctgactcagcctcgctcagtgtccgggtctcctggacagtcagtcaccatctcctgcactggaaccagcagtgatgttggtgttataactatgtctctgtaccaanacaccagcaaacgccccaaatcatgatttatgatgtacagtaagcggccctcgacgggtccctgactccgcttctctcgcctcagtctgacacncggcctccctgacctatctcgtggcctccgaggtcctgacggtatggagttcgtagtactttatactgactgtctacatactgcaggtcacgctacgacttagtactggtaccggngggaacgggaccaggcctcgaccgtcgtaacgg

SEQ ID NO: 948 - DNA, 637 bp, Homo sapiens
  misc_feature: GYAE6OF01C7KKU.13.36.D03.1.454.CMB.1.raw
  modified_base (202)..(202): a, c, t, g, unknown or other
  misc_feature (202)..(202): n is a, c, g, or t
  modified_base (364)..(364): a, c, t, g, unknown or other
  misc_feature (364)..(364): n is a, c, g, or t
tcagtcacgtactacacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccatgtctgggtctccgtggacngtcgatcacatctctgcactaggaaatagctagtgatggttgggacttagtgtacttgtctccgtaggtaccgacaaccaccgacggacctaaaccgacccccaaattctaattacgtttacgggtacaaagtaagccgtacctgacggtcttctgacttcncttctcgtcgctcagtctgacacgccgctcctagactactctcgcgacctcgacggccggtaaggcgtacgtacgttcgttacgtttttacgtgtttacgttactaagtagtcgacgtaagggaaacgggttgtacgtatttagttacggttacgttaagggacggtaccgggtaaccaacgggttcctaacccggtttcggttacggtaccgtaacccgggaccccgtaaaccgggtacccctaaacccgttcgtcgttaacccgtaccccg

SEQ ID NO: 949 - DNA, 659 bp, Homo sapiens
  misc_feature: GYAE6OF01D532C.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatagcaaccctctcctgcagggccagtcagagtgttagcagcagcttagcctggtaccagcagaacgcctggccagggcctcccgaggcctcctctattttagtggtgcctactcccgaacgtacgggccctacgttcgggtcgtccccgaggtccgtacgggttcacgggccgggtctaagggttcggggttacgtaggggaaccgtacggtaccgttaccgtaccttcctaccgacctacgtacgacgacgaacggtaccgtacggaacccgtacggtaacgttacgtttacgtacttaacttttacgtttccgttacgtacctaccgtaggttacgtacgggttacggtaccgtaaccgttaccgtacgttttcggaccggtaacggggaccgtaacggacgtaggaacgtacgtacgaagtcgtaacgtggtacgg

SEQ ID NO: 950 - DNA, 742 bp, Homo sapiens
  misc_feature: GYAE6OF01EHW5Z.13.36.D03.1.454.CMB.1.raw
  modified_base (561)..(561): a, c, t, g, unknown or other
  misc_feature (561)..(561): n is a, c, g, or t
tcagtcacgtactacacgaccggtgctcgatttagctgcgtcacgatctctcgttgggggggtcagagctctggggaggaactgctcagttaggacccagacggaaccatggaagccccagcgcagcttctcttcctcctgctactctggctcccagatactactggagaaatgtgctgacgcagtctccagtccaccctgtctgtgtctacgaggggaatcgaccaccctctcctgcgacgggccagtcgagtagtgttagcgagcgacgtacttacggccgtaggtaccagaccgaaggaacgccgtgggacccgtacggcccgtacccgacggtcccttccgtacttagtttacgtggtaccgtactaccgtcccgtaacgttaccggcctaacggttcggtacgtaccccgtacggttaccggtacggttcacgggtccggacggtaggttcgggtccggtagggtaccgtacgtacctttcgaaccgtttcgtacccaccgtacgtacgtaacgccgtacggtccctacggtaccgtagttcgttaagaacgtttntttaccggctttaacggttacctttaggttacccgttaggacgtaacggtccttaaaggttacgtttaccggttaacgtaccgggtaacctttaaacccgggttcccggaacggaaaccgggtaaccgtaacggtacggtaagggttaaccgtaaaagggtttaaaccgggtacgttaggg

SEQ ID NO: 951 - DNA, 574 bp, Homo sapiens
  misc_feature: GYAE6OF01DSHDH.13.36.D03.1.454.CMB.1.raw
tcagtcacgtactacacgaccggtgctcgatttagctgcgtcacgatctctcttgggggggtcagagctctgggggaggaactgctcagttaggacccagacggaaccatggaagccccagcgcagcttctcttcctcctgctactctggctcccagatactactggagaaatagtgctgacgcagtctccagtcaccctgtctgtgtctcgtaggggaaatgccaaccctctcctgcagggccagtcagagtgttagcagcagcttagcctggtaccagcagagcctggccaggcctcccgaggcctcctcatctacgatgtattcgaggacgaccacgtgacactcccagactaggttcaggtcggctaggtcgggtcgtagggactagtaccttcactcgtacaacctatcacgcgaagacgtaggaacctagaagtctttagacttactttacttcgttgtactacctagttacgtacggttaggtacctaccgtacttacggtttcggacccgtaggggtaccctaaggtcgtacgggtaatacgtacaacggtaccgtaagttacggg

SEQ ID NO: 952 - DNA, 588 bp, Homo sapiens
  misc_feature: GYAE6OF01DVQTX.13.36.D03.1.454.CMB.1.raw
  modified_base (336)..(336): a, c, t, g, unknown or other
  misc_feature (336)..(336): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttggacttatgaccttgtctcctggtaccgacaacaccaggcaaacgccccaaactcattacgtttacgggacaataacgcggccctcagggtctttcngtatcgtcttctctggctccaagtctgacaacgcgccctcctgactaactctcgtgacctccgaggccgaggacgaggtcttgtactttttactgtttgttacattagtgacgaaggtaagggtagttgtaatttagttggttacgtttagggaacggttcgggaacctaacgggttccgtaaccggttcgtttacgggtacacccgaacccgtaacggaccccctaacccctacgttcgtacctaccccgg

SEQ ID NO: 953 - DNA, 632 bp, Homo sapiens
  misc_feature: GYAE6OF01D5XO0.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagccaaccctctcctgcagggccagtcagagtgttagcagcagcttagccgtaggtacccagacaggaacgccgtggcccagggcctaccccgaggtcctcccgttctaattttagtggtgaccactcccaacggtacgggccctacgtcggtcgtccctaggttcctacgggttccaggcggacgtacgggttgggttaccgtggggaacgtaacggtacctttaccacgttcctaccgtacctataccgacgcgacgtccctcgacctagttactagtaagtagttttcgacgtacgttcttattactgtacacgtactaagttagtacgttacgtacggtacgtaaccgtacgggtaaccgaacgggacgaacggtacgtagggaagtaacggttaaaggtacgtaggg

SEQ ID NO: 954 - DNA, 688 bp, Homo sapiens
  misc_feature: GYAE6OF01AXAUK.13.36.D03.1.454.CMB.1.raw
  modified_base (236)..(237): a, c, t, g, unknown or other
  misc_feature (236)..(237): n is a, c, g, or t
  modified_base (242)..(242): a, c, t, g, unknown or other
  misc_feature (242)..(242): n is a, c, g, or t
tcagtcacgtactacacgaccggtgctcgatttagctgcgtcacgatctctcttgggggggtcgacaagaggcagcgctctcgggacgtctccaccatggcctgggctctgctgctcctcactctcctcactcaggacacagggtcctgggcccagtctgccctgactcagcctgcctccgtgttctgggtctcctagggactagtcgatcacccatcctcctgacactggaaacnncagtnatctggactatatctgtctcctgtaccaacaccaccaggcaacggccccagacgtcatctatttaggtggggactaagtacggcggaccgtacgacgggtatttaccgacttccgcttcgtcgtggtccttcgaacgtttcgaggtaccaacgtacccgggtcccttcccgttacgaacctaacgttcctccggttacgttcccgtaaccgcgggtacgtaccgggtaacggtaccgggtaacggtccgttacggtaacctttacggtaactccggttcgtctaccgttacctagttacgacggttacgttacgtttccgttcgttcgggtgtttcccgttaacgggggcgggttaaccggggtactaaacggttcccgggtaacgtttcccgacgggtttaaccccgggtaacccgttacgggccggttccccgtaacccccggg

SEQ ID NO: 955 - DNA, 519 bp, Homo sapiens
  misc_feature: GYAE6OF01BFOXZ.13.36.D03.1.454.CMB.1.raw
  modified_base (394)..(394): a, c, t, g, unknown or other
  misc_feature (394)..(394): n is a, c, g, or t
  modified_base (401)..(401): a, c, t, g, unknown or other
  misc_feature (401)..(401): n is a, c, g, or t
  modified_base (421)..(421): a, c, t, g, unknown or other
  misc_feature (421)..(421): n is a, c, g, or t
  modified_base (427)..(427): a, c, t, g, unknown or other
  misc_feature (427)..(427): n is a, c, g, or t
  modified_base (433)..(433): a, c, t, g, unknown or other
  misc_feature (433)..(433): n is a, c, g, or t
  modified_base (437)..(437): a, c, t, g, unknown or other
  misc_feature (437)..(437): n is a, c, g, or t
  modified_base (440)..(440): a, c, t, g, unknown or other
  misc_feature (440)..(440): n is a, c, g, or t
  modified_base (443)..(443): a, c, t, g, unknown or other
  misc_feature (443)..(443): n is a, c, g, or t
  modified_base (451)..(451): a, c, t, g, unknown or other
  misc_feature (451)..(451): n is a, c, g, or t
  modified_base (454)..(454): a, c, t, g, unknown or other
  misc_feature (454)..(454): n is a, c, g, or t
  modified_base (461)..(461): a, c, t, g, unknown or other
  misc_feature (461)..(461): n is a, c, g, or t
  modified_base (495)..(495): a, c, t, g, unknown or other
  misc_feature (495)..(495): n is a, c, g, or t
  modified_base (510)..(510): a, c, t, g, unknown or other
  misc_feature (510)..(510): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatggttgggacttatgaccttgtcctcctcggtaccgacaaccaccccaggacaaaccgacccccaaactcaatttagtttacggggtacaaataacgccggccctacgagggtctttcgagatccgcttctctgctccaagtctgcacacggcctccngacatcnctgactcgaggcgaggacgngctgtnttttangttntcntangcaggagngtntatagtnttattaggagtcggactaggtctacgtctggtcncgaccacgaccaccnctgtctacg

SEQ ID NO: 956 - DNA, 657 bp, Homo sapiens
  misc_feature: GYAE6OF01CXAS5.13.36.D03.1.454.CMB.1.raw
  modified_base (414)..(414): a, c, t, g, unknown or other
  misc_feature (414)..(414): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaaccgtggggcctcagtgtaaggtttcctgcgaaggcgtctggatacacgttcactacttatgctatgtaagttgggtgcgacgaggcctccgtggaacaagggtcttggagtggagtgggatggatcgactatcaacgtacgtacgggaaaccctaacggtacgtcggacccgagggtaccttacgaacgtacgggttacggttttntcctttccgtcgttacggacctaccgtcgttagtcacgtcgacgggtcgttagtacgtacagtactcgaacgtcgaacggtaccgtaaacggcgtaggaacggacctacgtacggtaccttaagttttactacgttggtacgtagtaagtagtcttttcgttaccgttacgttaccgttacggtttacttcgttcgttccgttacggtaccgttacggtacggggcccgtacggggtaacccg

SEQ ID NO: 957 - DNA, 558 bp, Homo sapiens
  misc_feature: GYAE6OF01B8Q8I.13.36.D03.1.454.CMB.1.raw
  modified_base (220)..(220): a, c, t, g, unknown or other
  misc_feature (220)..(220): n is a, c, g, or t
  modified_base (319)..(319): a, c, t, g, unknown or other
  misc_feature (319)..(319): n is a, c, g, or t
  modified_base (329)..(329): a, c, t, g, unknown or other
  misc_feature (329)..(329): n is a, c, g, or t
  modified_base (364)..(364): a, c, t, g, unknown or other
  misc_feature (364)..(364): n is a, c, g, or t
  modified_base (381)..(381): a, c, t, g, unknown or other
  misc_feature (381)..(381): n is a, c, g, or t
  modified_base (415)..(415): a, c, t, g, unknown or other
  misc_feature (415)..(415): n is a, c, g, or t
tcagtcacgtactacacgaccggtgctcgatttagctgcgtcacgatctctcgttgggggggtcagagctctggggaggaactgctcagttaggacccagacggaaccatggaagccccagcgcagcttctcttcctcctgctactctggctcccagatactagtggagaaatgtgatgacgcagtctccagccaccctgtctgtgtctcgaaggggaancgcccacctctcctgccagggccagtcagacagttagacaacaacgtagcccgtaggtaccagcaaggaaaccgtggccaggcctcccgaggcctcctnatctatggtncatcccacgaggcccatggactcccgagaccgttnagtcggcaggtgggtcngggacagtacttcactctcacctatcagcagtcngacagtctagagttattttgacttagtttatacgttgtactagtctagttagttacgttagtacggtaacgtaccgttaccggacgtaacgggacacggtagtaggtaagtaagttaaacggacgttgtacggtgtcggtacc

SEQ ID NO: 958 - DNA, 750 bp, Homo sapiens
  misc_feature: GYAE6OF01EE4B7.13.36.D03.1.454.CMB.1.raw
  modified_base (357)..(357): a, c, t, g, unknown or other
  misc_feature (357)..(357): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttggacttagtcgtaccttcgtctcctacggtaccgaacaaccacccaggaccaaacgcccccaaatcctatttaacgttacgggtacaacgtaacgccgtacctcgtagggtctttcgngtactcgtcttctcgtgcctcgtaagtcgtacggacctaacgaccggtcccttcccgtacgaacctaacttcctcgtacggtaacctccggaacgggtaccggaacggaaccggaggtaccgtttacggtttaacttttttaccgtggttttacgtttacctaagttaacgtcggaacggtaaagggtaagggtaaggttagggttaatttaacggttacggttttacgggtttaacggggtaaagggttcccggggtaaaacccgttaccggggttaaccccgttaccccgggtttacccggtttcgggtaaccccgaacccggtaaccccggtaaacccgggtaacccccgtaaacccccgttacgtttacccgtacctttaaacccccgg

SEQ ID NO: 959 - DNA, 610 bp, Homo sapiens
  misc_feature: GYAE6OF01D5CKZ.13.36.D03.1.454.CMB.1.raw
  modified_base (209)..(209): a, c, t, g, unknown or other
  misc_feature (209)..(209): n is a, c, g, or t
  modified_base (267)..(267): a, c, t, g, unknown or other
  misc_feature (267)..(267): n is a, c, g, or t
  modified_base (443)..(443): a, c, t, g, unknown or other
  misc_feature (443)..(443): n is a, c, g, or t
  modified_base (594)..(594): a, c, t, g, unknown or other
  misc_feature (594)..(594): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcatgtctggtctcctggacaggtcatcaccntctcctgcactggaaaatgcagtgatgttgggactatgaccttgtctcctgtaccganaacaccaggcaaagcccccaaagtcatttacgtttacggggtcaaagtaagcggccctcgagggcttttctgactcgtcttctcgtggctccaagtctggacaacaccggcctcctgacaactctctacggtactcgacggaccgaggaacgaggtcctaggtattttttaaccgngtttcgttccaagtactggtaccgaagggaaggtagtagtaacgtttaagtcgtttaccgtttaggtaaacggttgggaaaccctaagggtcccttaccggtccgttttcggtaccaacggtaccccgaaacggtaccccaaacccccgtnttcggtccttaacccg

SEQ ID NO: 960 - DNA, 625 bp, Homo sapiens
  misc_feature: GYAE6OF01EZ8CO.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctccgtggacaagggcttgagtggatgggatggatcgacatcaacacgtacgggaacccaacggtatcggccccgaagggtcctttacgacgtacgggtacggttttcgtctttcgtccgttcggtacctaccgttcgtcgtcacgccgtacgggtcgtaatgtacagactcaagcgacgtaccgtaaaggctaggacgactacgtcgaccttatttactacgtggtcgtagagtacgttactttccgttttaccgtgtaccgtttaccggttactttccgttacgttacccgtttaggacctttaacgggtcggggtacccgtacggggtaaccccg

SEQ ID NO: 961 - DNA, 590 bp, Homo sapiens
  misc_feature: GYAE6OF01B0D7N.13.36.D03.1.454.CMB.1.raw
  modified_base (181)..(181): a, c, t, g, unknown or other
  misc_feature (181)..(181): n is a, c, g, or t
  modified_base (363)..(363): a, c, t, g, unknown or other
  misc_feature (363)..(363): n is a, c, g, or t
  modified_base (378)..(378): a, c, t, g, unknown or other
  misc_feature (378)..(378): n is a, c, g, or t
  modified_base (394)..(394): a, c, t, g, unknown or other
  misc_feature (394)..(394): n is a, c, g, or t
tcagtcacgtactacacgaccggtgctcgatttagctgcgtcacgatctctcgttgggggggagaggagcccagcactgggattccgaggtatttccattcggtgatcagcactgaacacagaggactcaccatggagttttggctgagctgggttttccttattactattttaaaaggtntcagtgtgaggtgcagttggtggagtctgggaggaggcttggtccagggccgggggggtccctgagactctcatgtgcggcctcgtgggctcaccgtcaacaccaactacatgagctgggtccgccaggctccgagggaagaggccggagtgggtctcagttatttatgtcgacgtgccacnttcacgcagactcgngaggggccgttcaccntctcagagacaatccaagaacacggtgtatcttacaaatgaaccactgagaggtacgaggacgacggccgtacttattacgtgtacgagaaagactaggacagaggaccgggtaccccggtaaaggtcgggggtacccgttggggtacgggttacggggtttactttccggtttaggtcccgttggtacccggggg

SEQ ID NO: 962 - DNA, 637 bp, Homo sapiens
  misc_feature: GYAE6OF01CLKYM.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaaccctctcctgcagggccagtcagagtgttagcagcagcttagcctggaccagcagagcctggccaggcctcccgaggcctcctctattttagtggtgcacgtcccaccgtacgggcccacgttcggggtcgtccccgagttccgaggtttcacgggccggcgtacgggttcggggtccgtaggggacctaggtaccgtttccgaccttccgtacctacctattaccaaggccaacgcccgtgccgtacgtcgtaggaacgttacttttgaccttagttaccgtttagtttaccgttgttcctagtccgtagttaacgttacggtttaacgtacgggtaacgtaacccgttcgggaacccgtaacgggtaaccgacgtaccggtagggaagtaacgttaaagggacgttacggg

SEQ ID NO: 963 - DNA, 695 bp, Homo sapiens
  misc_feature: GYAE6OF01AY4MQ.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatcgtgggtctgagttagaacgaaccgtggggcctcgaggtgtaacggtttccagcgaaggcgtcgtggactactacgttctactacttatgtctagtgtaagttgggcgccgacgacggtcctccggtaggaacgtaaggggtcgttaggagtggagtgggtatggactacgactacgtacgaaccgtaccgtaacgggaaccctaacggtacgtaccggacccgtacgggtacttaccgacgtacgggttacgtttcgtccctttaccgtccgttacggaccctaccgtcgttacgacgtacggccgtacgggttactaacgtacgacgtagtactaccgagtaccgtaacggtaccgtaacggctacgggaacgtacctacgttacgtacctttaagtttacgttagtggtagtagttagtcgtttacttcgtttaccgtacgtacctttcggttccttcgttacgttaccgttacgaccgtagggtccggaccgtcggtacccgg

SEQ ID NO: 964 - DNA, 677 bp, Homo sapiens
  misc_feature: GYAE6OF01BVQ82.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgtagttgaagaaaccgtggggcctcagtgaaggtttcctgcaaggcgtcgtggatactacgttcacttacttatgctatgtaagttgggtgcgacaggctccgtggacgaagggtcttgaggtggagtgggatggatcgacatcaacacgtacgggaacccaacgtagtcgacccgagggtcttacgacgaggtacggtttcgtactttcctccgttaggacctaccttgttcggctaggtccgtacgggcttaagtgtaacgagtacgtacgacgacgacgtaccgtaaaggcttagggaacggacctaacgttcgtaaccttattttacgttaacgtggttacgtaggtaagtacgtttagttttcccgtttaccgttggttaaaccggtttacccggtttaccgtttacgttacgtttcccggttaacttaccgggttacccggtacgggggtaaccccggtacggggttaaccccgg

SEQ ID NO: 965 - DNA, 886 bp, Homo sapiens
  misc_feature: GYAE6OF01EDOZ4.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtcgtccactcccgaggtgacacgtggtgacaatcgtggtctggtagttagaacgaaccgtgggcctcgagtgtaacggtttcctggacgaaggtcgtacgtggtaactaccgtacgttactaacgttactttagtcgtactagtaggtaaggttggggtcgacggacgtaggtccgtccgtagggaacgaacgggttcgttaggagggtggaggttaggaggtaggacttacgacgtaactacgtaaccgaaccggtaccgggaaacccgtaacgtacgtaccgtaccccgggtaggtcctacgtaacggtacgggtttaacggttttcgttccgtttacccgttaccgttacgggtaacccttaccgttcgtaccgttacgaccggtaccggtaacgggttacgttaaacgttacggtaaccggtaacgtacgttaccggaaacgtaaccgtaccggtaaacccggttaaggggtaacgtaacgggtaaccggtaacccgtaaccggtttcgtaaacccttttaagtttttaccgttaacgggttccggttagtaaacgggtcgttttaacgtttaccggtttttaccccgtttaacgtttaaccggtttaccccggtttaacggtttccgttttacccggtaccgttttaaccccggtttaccgggttaccggttaacccgggtccgggggtttaaaaccccggcccgggggttttaaaccccgg

SEQ ID NO: 966 - DNA, 522 bp, Homo sapiens
  misc_feature: GYAE6OF01AU8R4.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctgggccacgggccccccaggcctaccgtcatctacgatgtattcgaggaggaccactgacatcccagacaggttcagtggcaggtgggtctgggacagacttcactctcaccatcagcagactggaacctgaagtactttgctactttacttctgtcacctagttatggtacgtcctacgtactacgtttcggccgtagggaccagcgtaggacgatacgaagcgaagtggtacgg

SEQ ID NO: 967 - DNA, 609 bp, Homo sapiens
  misc_feature: GYAE6OF01DUSDG.13.36.D03.1.454.CMB.1.raw
  modified_base (233)..(233): a, c, t, g, unknown or other
  misc_feature (233)..(233): n is a, c, g, or t
  modified_base (378)..(378): a, c, t, g, unknown or other
  misc_feature (378)..(378): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttccngcaaggctctggatacacgtttcactacttatgctatgaattgggtgcgacaggctccgtggacaagggccttggacggtggagtgggatggatcgacatcaacactggaaccagtatgcccagggcttcgacaggtacggtttntcttactccttggacctactcgtcgtcagccgaggtcgtatacgtacagatcagtcacgaccgtaaagccgtagacggactactcgacctatttacttagtcgttgtagtaacgggtattacttttccgtttaccgttacggtaaccctttacgggtttccctttacgtttacgttccgtttcgttaaacccttcgggttacgggggtccccgtaaggggttaacccccgg

SEQ ID NO: 968 - DNA, 772 bp, Homo sapiens
  misc_feature: GYAE6OF01CXLD8.13.36.D03.1.454.CMB.1.raw
  modified_base (220)..(220): a, c, t, g, unknown or other
  misc_feature (220)..(220): n is a, c, g, or t
  modified_base (287)..(287): a, c, t, g, unknown or other
  misc_feature (287)..(287): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaaccgtggggcctnagtgtaaggtttcctgcaagggcgtctggatacgacgttcacttacttatgctatgtaattggggtncgacaggtcctccgtggaacaaggggcttggagtgggatggggatgggatacggatatccaaacgacgtacggggaaacccctaaggtactacgggacccgaggggtaccttacgaacgtacggggttaccggtttcggttcctttacccgttcgtttacgggaaccctcccgttacgttcgtccgacggtaccgtacggggtactttagtacggtaacgagtaactccgtacggaccgaacggtaacccgttaaacgggtcgttacgggaaccgtaaccgtaaccgttaccggtaaccgtttaattttaacgtttacgttgggttacggttaggaacggttacggttatttttacccttttaccggttaaccggttaaccgtttaaccgggtttacccttttccggtttacggtttacccgtttacggttaaccggttccgggttaacccgggggtacccgttaaccccggggggttaaccccg

SEQ ID NO: 969 - DNA, 574 bp, Homo sapiens
  misc_feature: GYAE6OF01A6W06.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatcggcccagggctttcgacgagggtacggtttgtcttctccttggacctaccgtctgtcagccacgggctatgtacagatcagcagccgtaaagctagacgacacgtgcctaattttactacgtgtgtagtagtagtactttcccgtttcgtgtaaccgttcggttactttcgtacgtttccttacgtaccgttaccggtcgggggtcccgtacggggttaccccg

SEQ ID NO: 970 - DNA, 700 bp, Homo sapiens
  misc_feature: GYAE6OF01CLYB3.13.36.D03.1.454.CMB.1.raw
  modified_base (220)..(220): a, c, t, g, unknown or other
  misc_feature (220)..(220): n is a, c, g, or t
  modified_base (300)..(300): a, c, t, g, unknown or other
  misc_feature (300)..(300): n is a, c, g, or t
tcagtcacgtactacacgaccggtgctcgatttagctgcgtcacgatctctcttggggacccaacaaccacacccctcctaagaagaagccctagaccacagctccacaccatggactggacctggaggatcctcttcttggtggcagcagcaacaggtgtccactcccaggtgcaactggtgcaatctgggtctgagttgaaagaaacctggggccctnagtgaacggtttcctgacaaggcgtctggatactacgttcacttacttatgtactattagaagtttgggcgacgtaacgnggcctccgtggacgaaggtcttggagtggagtgggaatggtatcggaactatacgaacgtacgtacggaaccctaaggtactacggtacccgacgggttccttacgaaccggtacgggttaaccggttttcggtcctttccgttaccgtcgggacctaccgttcgtcgttacgacgtcgaaccggggtctaagtacgttacaaggtacttacgagaccgaagtaaccgtaaggtcgtaggaacgaacctacgtctaccgttaagttttacttacggttagtaggtaacgtaggtaactttacgtttccgtttccgttagtaccgttaaccggtttcttaccggtttccgttccttaaccggtacgttacccgggtaacgggtcccgtaagggtaacccgg

SEQ ID NO: 971 - DNA, 616 bp, Homo sapiens
  misc_feature: GYAE6OF01A6T5T.13.36.D03.1.454.CMB.1.raw
tcagtcacgtactacacgaccggtgctcgatttagctgcgtcacgagtctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctggagttgaagaacctggggcctcagtgaaggtttcctgcaaggcgtctggatacacgttcactacttatgctatgaattgggtgcgacaggctctggacaagggcttgagtggatgggatggatcgacagtcaaacgacgtagggaaacccctaagtactcggacccagggtcctttaccgacgtaagggtacggtttgtacctttcgtacccgttggacctacctctggtacagcgtacggcgtatgtaacagactcagtcagtaccgtaaagcctagaggacacgtggacctagttttaacttcttaggtcgtagagtagtctttactttcccgttgtaccgttaaccggttcttcgttcggtttacccctttaggtacccgttacgggtcgggggtccccaacggggttaaccccg

SEQ ID NO: 972 - DNA, 662 bp, Homo sapiens
  misc_feature: GYAE6OF01DE4B8.13.36.D03.1.454.CMB.1.raw
  modified_base (309)..(309): a, c, t, g, unknown or other
  misc_feature (309)..(309): n is a, c, g, or t
  modified_base (343)..(343): a, c, t, g, unknown or other
  misc_feature (343)..(343): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatcctcctgccactggaaacagcagtgatcgttggacttatagtacttgtctctgtaccaacaccaccaggcaacgcccccagacgtcatcattttagnggggacaagtacggcggccgtcgagggtctttcngtacgtcgtctttctcgtggtcctacctaagttcgtcggactaaccgaccgggtcccttacccgtagtaacccgtaattccgttcccgttacggacccttaccgggacgggacccgggaaggtaaccggtaacggtccgtttagtttaacgttttttaccgtggttttacttcctaagttcgttcgacgtaagggtaaggtaagtttgtaacgtttagttgttcggttttaagggaaaggttcgggtaaacccgttaaggtccgttacccgtcggtttacggtaccacgggtacccacgggtacccctaccccgtaacg

SEQ ID NO: 973 - DNA, 822 bp, Homo sapiens
  misc_feature: GYAE6OF01CIWTA.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttagaaagaaaccgtggggcctcgagtgaaggtttcctgacgaaggcgtcgtggatacacgttcactacttatgactagtgtaagttgggtcgacggtacgacgggtccttccggtagggaacgtaagggggtcttagggaggttcgggaagttaggggagttagggacttaccggaactaacgttaccgaaaaccgtaaccggttaaccggggaaaaccccctaaacggttacgttaccgggaccccggtaaggggttaccctttaccgaaccggtaacggggtttaccgggtttttcgtttacccgttttacccggtttacccggtttacggggtaacccttaccccgttaccgtttcggtaccgaaccggtacccggtaaccggggtaccgtttaagtacggtaacgacggtacttaccgacgtaccgaacgtacggtaaacggtcgtaggaacggactaccgtacgtaccttagttttacttacgtaggttagtaggtacgtacgttacttttccgtttacgttacgttaaccggttacgttccgttttcccgtaggtttaccccgttcggttaaccgttaccgggttaccggggtacccggtaacgggttaaccccgg

SEQ ID NO: 974 - DNA, 580 bp, Homo sapiens
  misc_feature: GYAE6OF01EAT87.13.36.D03.1.454.CMB.1.raw
tcagtcacgtactacacgaccggtgctcgatttagctgcgtcacgatctctcttggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatgcaacctctcctgcagggccagtcagagtgttagcagcaataattagcctggtaccagcagaagcctggccacggcccccaggctccgtcactctacgatcgtattcgaaggacggaccactgacatcccaagacaggttcagtgcgagtgggtctgggacagtactcgactctacgacatcagcagactacggaacctagaacgttacgtttagacttacgtttaactttctacgttactaaccgtagttagttacgggttacggtccctaaccgttactaccgtttttagggccccgtaagggggacccctaaggccgtaggaacgtaactaccgaaagtcggtaaacgtggtaacggg

SEQ ID NO: 975 - DNA, 888 bp, Homo sapiens
  misc_feature: GYAE6OF01D1RMN.13.36.D03.1.454.CMB.1.raw
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctggtctctggacagtcgatcaccatctcctgcacgtaggaaatgacagtgagttggttagggtacttagtcgtacctttgtccttccgtacggtacccgaaccaaccacccgacggaccaaaccgacccccaaatctagtttaacgtttacgggtacaaagttaacggccgtcccgtacgtacgggttctttcgtacgacttccgtctttccgtcgttcggtcctaccgtaagtcgtacggacctaaaccgtccggtaccccttacccgtacgaaccgttaacgttccctttaccggtaccggttaaccccgtaccccggaaacgggtacccccggggaagggggtaaacccggttacgggttaccgttttaacggtttttaacgttttttttaacccggttgggtttttaaccggttactttaaacggtttacgtacgggttaaaccggtaaacgggggtaaaggtttacgggtttaacggtttaagtttttaacggtttcgggttttaaccgtttaaagggggtaaaccgggtttaaccgggggtaaaaccccgtttaacgggggttaccccgtttaacccccgggttaccgggttttacccgggaaccggtaaaccccgggtaaccccccggtaaaaccggttaacccccccgttaaaaccccccggttcgttaacccggtttcccctttaaacccccgg

SEQ ID NO: 976 - DNA, 655 bp, Homo sapiens
  misc_feature: GYAE6OF01CCFXQ.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctggagttgaagaaaccgtggggcctcagtgaaggtttcctgcaaggcgtctggatacacgttcactacttatgctatgtaagttggggtgcgacgaggcctccgtaggacgtaagggtcgttggaggtggagtggggagtggatcgacatacgaacacgtacgggaacccaacgtagtcgacccgaggctacgacgtaggtcggtttcgtccttctccgtggacctacctctcgtcacgtacgacggtcgttatcggtacaggtactaccgaagccgtaacgaaccgttaaacgggctaacgggacggacctacgtccgtaccttaagttttactaccgttagtggtacggaagtacgttcttttcccgtttacgttcgtaaccgtttaacggttcctttccgttagttcccgttaggtaaccgttaccgggtcggggtaaccccgtcggggtaaccccg

SEQ ID NO: 977 - DNA, 648 bp, Homo sapiens
  misc_feature: GYAE6OF01AVM5R.13.36.D03.1.454.CMB.1.raw
  modified_base (281)..(281): a, c, t, g, unknown or other
  misc_feature (281)..(281): n is a, c, g, or t
  modified_base (285)..(285): a, c, t, g, unknown or other
  misc_feature (285)..(285): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcaacagcaacaggtgtccactcccaggtgcaactggtgcaatctgggtctgagttgaagaaaccgtggggcctcagtgaaggtttcctgcaaggcgtctggatacacgttcactacttatgctatgaattgggtncganaggctccgtggacaagggcttggagtggatggatggatcgactatacaacgtacgtagggaacccaagtatcgacccgagggtcttacgacgtaacgggtacggtttcgtacctttcgtaccgttaggacctacttcgtgtcacggtcacgggtcgttatggtaacagtatcacggcacggaaccgttaaaggcgttaaggacggacacttaggtaccttaagtttacgttacgttggttacgtagtaaggtaacgttattttcccgtttacgttacggtaaccgtttaccgggtttacttccgttacgttaccctttaggactttaccgggtccgggtaccgtaaccgggtaacccttgggg

SEQ ID NO: 978 - DNA, 680 bp, Homo sapiens
  misc_feature: GYAE6OF01CT4TX.13.36.D03.1.454.CMB.1.raw
  modified_base (235)..(235): a, c, t, g, unknown or other
  misc_feature (235)..(235): n is a, c, g, or t
  modified_base (325)..(325): a, c, t, g, unknown or other
  misc_feature (325)..(325): n is a, c, g, or t
  modified_base (330)..(330): a, c, t, g, unknown or other
  misc_feature (330)..(330): n is a, c, g, or t
tcagtcacgtactacacgaccggtgctcgatttagctgcgtcacgatctctcgttgggggggtcagagctcgtggggaggaactgctcagttaggacccagacggaaccatggaagcccagcgcagcttctcttcctcctgctactctggctcccagatactactggagaaatgtgctgacgcagtctccagtcaccctgtctgtgtctccgaggggaaatgccaaccctctccngcagggccagtcagagtgttagcagcagtcttagcctggtaccagcaggacgccgtggccaggcctcccgaggtcctccgtctatttagnggtcnctactccgacgtacgggcctacgtcggtcgtccccgagtccgaggtttaccgagggtccggacgtaagggttcggggtacgtacggggtacgtacgggtacctttaccgaccgttccctacccgtaacctacgttaccgaacgtaccgtacggtcccgttgacccgtaggttaccgtaggtaacgtttacgttttcgaacttacggttacttacgtttaacctgtttaccgaggtacctaaggtttaacgtacggtttacgtacgggtaacgttaacccggttcggaaacccggtaagggaaccgaacgtaacgggtaggtaagttaaacggtaaacggtgttaaccggg

SEQ ID NO: 979 - DNA, 994 bp, Homo sapiens
  misc_feature: GYAE6OF01D3IZD.13.36.D03.1.454.CMB.1.raw
tcagtcacgtactacacgaccggtgctcgattttagctgcgtcacgatctctcgttggggacccaacaaccacacccctcctaagaagaacgcccctagaccacagctccacaccatggactggacctggaggatcctcttcgttggtggcagcagcaacaggtgtccactcccaggtgcaacgtggtgctaatcgtgggtctggtagttagaaacggtaaccgtgggccctgaggtgtaacggtttcctgcgaaggtcgtcgtggatactacgttcacgttacttagcgctagtgtaagttgggtcgcgaacgacggtcctccggtaggaacgaagggtcttagggagggttagggagttaggggagttacgggaacgttcggaaccgtaagttaacccgaaaaaccgtaccggtaccgggaaaaccccctaaggttactaccgggaaccccggtaggggttaacctttacccggaaacgggttaacggggtttaccggtttttccgtacccgttttccgtttacccgggtttaccggtaacccgttaacccgttccggtttaccgggtacccgtaaccgggacccggtaaaccggggttccggtttaaacgttacgggttaaaccgaaacggttaacgtaaccgggtaaacggtacccgtaaaccgggttaacccgttaaaagggggtcccgtttaacgggaaaccgggtaacccgttaaccggttaccgggttaaacccttttaaacggttttttaaccggttttaaacgttcgggttttaaggttaaccggttaaacgggtttaaacccggtttttccgttttaccccggttttttacccggttaaacccggtttaaacccggtttttacccgggttaaaccctttttcccggggtttacccgttttaacccggttacggttttaacccccggtaagggggtttaacccccgggggttaacccgttaaccccggggggtttaaaccccgg

SEQ ID NO: 980 - DNA, 685 bp, Homo sapiens
  misc_feature: GYAE6OF01AOI2T.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtcgtctcgaaggggaaatcgcaaccctctcctgcagggccagtcagagtgttagcagcagtcttacgcctaggtaccagacaggaacgccgtggccgaggcctcccgaggcctcctacgtatttacgtgggtcactactacccgacgtacgggcctacgttcgggtcgtacccgtaggtcgtacggttcgacggtcgggacgtacgggtcggggttccgtagggaacctacggtacctttacgtaccgtacctaccgaaccgtaacgtaccgaacggtccgtaaccggtccctaccggtaccggtacgttacgtacggtaaacgtttacggttttcgaccgttaacgtttaccgtttagttaaccggtttcgtacggtacgtacgtaacgtttaacgttacgttacgttacggtacgttacccggtacggtaccgaacgggtacaggtacgtaggtaagtaacgttaaacgggcgtacggg

SEQ ID NO: 981 - DNA, 665 bp, Homo sapiens
  misc_feature: GYAE6OF01CQRHX.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaagatctcctgcaaggtcttctggttacaccttttagcagctatcttatcagcgtgggtgacgacgacggtcccccgtagggaccggacggaccgtcggaggtggacgtggggagtggatcgacgtaccctaacgaacggaacacgagactagtgaacacgaacctcgaggacagtacttacaccagtacggacgaacacgaacactaactaccgaacgaaacacgaacgtacctaagacggtagggacggaggaacgggacgcccgtaagaaggtaactaaggtaccggaaccggtaccgaccgggttccgttaagttagttacgttgggtaggaccggtaggtacgggttacggggtaggacgggtcggttaaggggttaaggtaacgttaacgtaccggttaaaatttaaaacctttaacggttaaacgtttaaacggg

SEQ ID NO: 982 - DNA, 646 bp, Homo sapiens
  misc_feature: GYAE6OF01CE67F.13.36.D03.1.454.CMB.1.raw
  modified_base (144)..(144): a, c, t, g, unknown or other
  misc_feature (144)..(144): n is a, c, g, or t
  modified_base (235)..(235): a, c, t, g, unknown or other
  misc_feature (235)..(235): n is a, c, g, or t
  modified_base (535)..(535): a, c, t, g, unknown or other
  misc_feature (535)..(535): n is a, c, g, or t
tcagtcacgtactacacgaccggtgctcgatttagctgcgtcacgatcgtctcgttgggggggtcacaagaggcagcgctctcgggacgtctccaccatggcctgggctctgctgctcctcactctcctcactcgaggacacgngggtcctgggcccagtctcgccctgacctcgacgcctcgccctccgtgttcggtcggtgggttcctaccgtggacgaggtcgactccactnttcctcctgacacgtagaaactcgctagtgtagtggttaggtacttagcgtacttgtctcgtacgaccaccacaccgacgaccaaccgaccctaatcgtaacttaggttacggtaacaacgtacgcccgtaccgtagtacggttaccttcgacgtcgtccgtcttacgtcgtacggtacctaccgtaatcgtacgtaccgaaccgtccgtaccctacgtaacgtactaccgtcgtacgtacgtactccgaacggccgaaggacgtgtactttacgttactttcgtgtttctactaagttntaacggacggtaaggtacgtagttacttagttaggtcgttaggtaggtacgacggtacacggtcgtcgtacgttcgacgaccaccgtaccgcctaactcgtctaccgtccg

SEQ ID NO: 983 - DNA, 667 bp, Homo sapiens
  misc_feature: GYAE6OF01AW2M8.13.36.D03.1.454.CMB.1.raw
  modified_base (384)..(384): a, c, t, g, unknown or other
  misc_feature (384)..(384): n is a, c, g, or t
  modified_base (650)..(650): a, c, t, g, unknown or other
  misc_feature (650)..(650): n is a, c, g, or t
tcagtcacgtactacacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccatgtcgtgggtcctccgtggacagtcgatccacctatctcctgccacgtaggaaatagcagtgtagttggttggactttagtcgtaccttgtcctccgtacggtaccgaaccaaccaaccccgaggaccaaaaccgaccccctaaactctaagtttacgttacggggtactaaagtacgcccggtaccctcgaggttctttcngtactcgtcttctcgtcgcctaccgtagtcgtacgaccaaccgtccggtccctccgtacgactactcgtcgtacgtacctaccggacggccggaagggaccgaggtacttgttacgttttacgtgtttagttactagttagcggtaacggaagggtaaggttagttacgttaagttagttgttacggttaggaagggttaccggaaccgttacggtcctaccggttcgtcggtaccgaccgaccccgtacggacccctaaccccgngttccgtaccgttcccg

SEQ ID NO: 984 - DNA, 654 bp, Homo sapiens
  misc_feature: GYAE6OF01EVWY3.13.36.D03.1.454.CMB.1.raw
  modified_base (372)..(372): a, c, t, g, unknown or other
  misc_feature (372)..(372): n is a, c, g, or t
  modified_base (431)..(431): a, c, t, g, unknown or other
  misc_feature (431)..(431): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaaccgtggggcctcagtgaaggtttcctgcgaaggcgtctggatacacgttcactacttatgctagtgtaattggggtgcgacgaggcctcctgggaacgaagggcttggaggttgggagttggggatgggatcggacatacaacgacgtacgggaacccaacgtntcgcccgagggcttcgaacggacggtacggtttctccgttctcgttcgacctaccgttntcggtacaggcgtaacgggtcttagtagtaaccgtaggactcgaacgaccgtagtaccgtaaaggtcccgtgggaacgtaaccacgttccggacctttaagttttaccgttagtggtaggttcaagggtatttactttccgtttttaccgtaggtaaccctttacggttcttcgttcgttaccgtttagcccggttaggtaccggggcctacggggtaccccg

SEQ ID NO: 985 - DNA, 688 bp, Homo sapiens
  misc_feature: GYAE6OF01CHXQR.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaacgtggtgcaatcgtgggtctgagttgaaagaaccgtggggcctctagtggtaaggtttcctggacaaggtcgtcgtggatacctacgttctactacttagtgtctatagtaagttggggtgcgacgacggccttccggtaggaacgtaaggggtcttaggaggtaggtaggtggggaagtggtacgtcgaacatacgaaacgtacggtaaccgggaaaccctaacggtacgcggacccggtagggtcctacgacgtacgggttacgtttcgtcgttccgttccgtcggtacctcctcgttcgtcgaacgtccggtacgggtcgtaatcggtaacgagacgtcgacgacgaacgtaccgtaaggctaggaacggtacctacgtcgtaacttagttagttacgtggtgtacgagttacttactttccgtttcgttacgtaccgtttaccgttcgttccgttacgtttaccgtaggtttaccgacgggttcgggtaccgaaccggggttaccg

SEQ ID NO: 986 - DNA, 716 bp, Homo sapiens
  misc_feature: GYAE6OF01EREPK.13.36.D03.1.454.CMB.1.raw
  modified_base (542)..(542): a, c, t, g, unknown or other
  misc_feature (542)..(542): n is a, c, g, or t
tcagtcacgtactacacgaccggtgctcgatttagctgcgtcacgatctctcgttggggggggtcacaagaggcagcgctctcgggacgtctccaccatggcctgggctctgctgctcctcactctcctcactcaggacacagggtcctgggcccagtctgccctgactcagcctgcctccatgtctgggtcctcctggacagtcgatcaccatcctcctgcactaggaaatagcagtgtagtggttggtaacttatcgtaccttgtcctaccgtcggtaaccaaccaaccacccgacggaaccaaaccgaccccctaaacgtctagttttaacggttaaccgggtactaaacgtaacggccggtaccctacggtaacgggttcttacgagacttccgtcttcgactcggcctacgtaagtccgaggaccaaaccgccgtcccctaccgtagaactaacttccgtcgtacgtcctacccgacgggacgaacgggaccggtagtcgttacgttacgtttttcgtgttttcgtactagttacgnggtaaccgtaagggtaaggtagttagtaagtttacgttggttaccgtttaaggggaaacgggtccgggtaaaccggttacggtacccggttacccggtttacggttccggtacccgaacccgaaccccggtaacccggacccccttaaacccgtcgttcgtacccgttaacccg

SEQ ID NO: 987 - DNA, 804 bp, Homo sapiens
  misc_feature: GYAE6OF01AZWBB.13.36.D03.1.454.CMB.1.raw
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtcgtgggtctcgtggacagtcgatcaccatcctcctgccacgtcgggaccagcgtagtgaccggttcgtggtacaagactagttcgtcctccgtacggtaacccaaaccaaccgaccccgaacgggaccaaacccggaccccccaaaactactaattaaagttttacgtagttaacttttaccaaccttaacgtcccggtaccccttacgtaacgggtttacgttaactttaccttaaacgttcccgtaccttaccgtacgttccggtacctaaccgtaacgttccgtacgggaaccaacccggacccggtcccttccccgtacgaacccgtacgttcccgtcggtaccgggtacccttacccggaacggaccggacggaacgggacgggtacggtacgtacgttaacgttttacgtacggtccggtacccggtcctaccggtacggtaaccgttattaccggtacccgttaaccgtttagtccggtttaccggttaccgggttaaccgttcggtaccggtaaacccggttaacgggtcccccgttaccggttacccggttaaccgggtaccgaaccccggtaacccccgaaccgggtaaccccccctaacccgtacccgg

SEQ ID NO: 988 - DNA, 611 bp, Homo sapiens
  misc_feature: GYAE6OF01BM832.13.36.D03.1.454.CMB.1.raw
  modified_base (439)..(439): a, c, t, g, unknown or other
  misc_feature (439)..(439): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcgaaggcgtctggatacacgttcactacttatgctatgaagttgggtgcgacgaggctccgtggacaagggtcttggaggtggagtgggatggatcgactatacaacgacgtacgggaacccaacgtatcgacccgaggtcttacgacgtaggtacggtttgtcttcgtcgttcggacctaccttcgtcgtcacgtctacgggtntacgtcgaacagatcgagcacgacgtaagctagacgctacgtcgacttaatttagttacgtcgtagtcggtaatacggttctttccgttttacgtcgttaaccgttacggttacctttccgtacgtttcttacggtaccttacgggtcggggtcccgtaacggggttacccg

SEQ ID NO: 989 - DNA, 609 bp, Homo sapiens
  misc_feature: GYAE6OF01BSZCU.13.36.D03.1.454.CMB.1.raw
  modified_base (329)..(329): a, c, t, g, unknown or other
  misc_feature (329)..(329): n is a, c, g, or t
  modified_base (333)..(333): a, c, t, g, unknown or other
  misc_feature (333)..(333): n is a, c, g, or t
  modified_base (356)..(356): a, c, t, g, unknown or other
  misc_feature (356)..(356): n is a, c, g, or t
  modified_base (380)..(380): a, c, t, g, unknown or other
  misc_feature (380)..(380): n is a, c, g, or t
  modified_base (456)..(456): a, c, t, g, unknown or other
  misc_feature (456)..(456): n is a, c, g, or t
tcagtcacgtactacacgaccggtgctcgatttagctgcgtcacgatctcgtcgttgggggggtcagagctctggggaggaactgctcagttaggacccagacggaaccatggaagccccagcgcagcttctcttcctcctgctactctggctcccagatactactggagaaatgtgctgacgcagtctccagtccaccctgtctgtgtctccgaaggggaaatcggccaaaccctctccgtgcgagggccagtcagagtgtagcagcagcttagcctggtaccagcagaacgccgtggccaggcctcccgaggtcctcctctaatttnggtncactccacgtaggccagtcggtntcccgagtctacggtcgagccggntagggtcggtccgtgggactacggtacttccgactcgtacactatcgagcacgtctgctagtctagtaatgttttnactagttacttacttacgtggttaaccagtacctagttaagtaacggtttagtaccgggtaacgttaacccggtttccgggaaaccgaaacggggtaaccctaacggtaaccggtagggtaaagtaaacggttaaaagggtacgttaacgggg

SEQ ID NO: 990 - DNA, 683 bp, Homo sapiens
  misc_feature: GYAE6OF01AJGOQ.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctggtctgagttagaagaaaccgtggggcctcgagtggtaaggtttcctgcaaggcgtctggatacacgttcacttacgttatgctatagtaagttgggtgtcgacaggtcctccgtaggaccgaagggtcttagaggtggagtgggagtggatacgacatacaacacgtacggaacccagtactcgcccgtaggcttacgacgaggtacggttcgtcgttccgtcgttgacctaccgtctcgtcacgtcgacggtcgtagtagtacgtagctacgacgtacgacgtaccgtaaacggtgacggaacgaactaccgtacgtaccttaagtttacgttacttggtacggtaggtaacggtagtttaccgttttacccgtttaccgtttacggtactttaacccgggtttactttcccgttaccggtttacccgtttaccggtaaccgtttaccgggttacccggggtaacccggttacccggggtttaaccccggg

SEQ ID NO: 991 - DNA, 720 bp, Homo sapiens
  misc_feature: GYAE6OF01B172U.13.36.D03.1.454.CMB.1.raw
  modified_base (174)..(174): a, c, t, g, unknown or other
  misc_feature (174)..(174): n is a, c, g, or t
  modified_base (471)..(471): a, c, t, g, unknown or other
  misc_feature (471)..(471): n is a, c, g, or t
tcagtcacgtactacacgaccggtgctcgatttagctgcgtcacgatctctcgttgggggggtcagagctcgtgggggaggaactgctcagttaggacccagacggaaccatggaagccccagcgcagcttctcttcctcctgctactcgtggcctccagatactacgtggaanaaatgtgctgacgcagtcctccagtccacctgtctgtcgtctaccggaagggaaactcgacctaaccctctaccgtcgacgacggccagtcgagtagtgtagcagcagtctacgcctcggacagcagtacgccgtggccacggcctaccgacggtcccttccgttagtagtttgcggtcacctacgtcccgtaaccggcggtacctacgtacgtacccaccggtacggtacgttcgaggtggaccgtggggtcggtacgtacgggtactacgtctacctacgtccgtacaccgttancgacgtactacgttcgacgtacgttacggttccgttaaggttaactttacgtttacgtaaccgtttttaaggtttaacctttacggttacgtaacgtacgttaaccggttaaagttacttaaaaccgtttccggtaccggtacccttaacgtacgttaagtttaccggttaactttaccggggtttaccggaaccccgggttaacggtaccccgttaacggtacgggtaaaaccgtcgttaaacccggg

SEQ ID NO: 992 - DNA, 759 bp, Homo sapiens
  misc_feature: GYAE6OF01DG8N9.13.36.D03.1.454.CMB.1.raw
  modified_base (353)..(353): a, c, t, g, unknown or other
  misc_feature (353)..(353): n is a, c, g, or t
  modified_base (368)..(368): a, c, t, g, unknown or other
  misc_feature (368)..(368): n is a, c, g, or t
tcagtcacgtactacacgaccggtgctcgatttagctgcgtcacgatctctcttgggggggtcacaagaggcagcgctctcgggacgtctccaccatggcctgggctctgctgctcctcactctcctcactcgaggacacgagggtcctgggcccagtctgccctgactcagcctgcctcatgtctgggtctccgtggacagtcgatccacctatcctctgctacgtaggaaatgcagtgagttgttggtacttagtgtaccttgtcctccgtggtaaccacaacaccgaggacaaaccgccccaactcattacgttacgggtacaaagtacgcgcctacgacggtctttacngtactccgtctttcncgttacggtcctaccgtaacgttccgtacggacctaaaccggaccggtcccttacccgtacgaaccgtaacttccgttaaccgtcggtaacccgtacccgacgggtaacccgtaagggaccggtaacgggtactttacggttaaccgttttttacgtagttttacgttactaacgtttacgtcggaacgtaaggggtaacggttacggttacgtttaaacgttttacgttcggttttaacggtttaacgggttaaagggtccggggttaaaaccgtaaccggggtttacgtaaccccgggtttccggtttacgggtaacccgtaaccggtaccccggaaaaccgggtacccccgtaaaccccgtacgttacccggttaccgttaaccccgg

SEQ ID NO: 993 - DNA, 788 bp, Homo sapiens
  misc_feature: GYAE6OF01EUOOG.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggaagaaatagtgctgacgcagtctccagtccacctgtctgtgtctacgaaggggtaaatcgacctaaccctctcctaggccgacgggcctagtccaggtaggttcgttacgcagcagtaccgttagccgtacggtaccagccgaggtacgcctcgggcctacggccctacccgacggtccttacccgtattagtttagtcggtcgtaccactcccgaacgtaccgggccctaacggttcggttaccgtacccgtaggtacgtacggtttccgacgggtcggcgtacgggtcgggtcggtacgggactacgtacttaccgacttccgtacaaccgtactacgacgaccgtcgtccgtgtaccgtacgttacgtaacgttacggtttacttttaggaccgtttacgttacttacgttttacgttacggtactaggtaaccgttaacggtttaacgtttaaacggtttaccgggttaaacgggttaaacccggtttaaccccggggttacccgggaaacccgggttaaacccggggtaaaccggttaacccgggttaaaccgggttaacggggtaaaagggtttaaaaccgggttttaaaaacccgggtaacgggtttacccgggg

SEQ ID NO: 994 - DNA, 834 bp, Homo sapiens
  misc_feature: GYAE6OF01BF21T.13.36.D03.1.454.CMB.1.raw
tcagtcacgtactacacgaccggtgctcgatttagctgcgtcacgatctctcgttgggggggagaggagcccagcacgtgggattccgaggtatttccattcggtgatcagcactgaacacagaggactcaccagtggtagtttggctgagtcgttgggtttttacctttaattaacttaagttttaaaacggtcgcccgtagttggtgaggtgcagcgtgggtggagtcgtgggaggaggtcgttgacgtccgacggtccgggttcggggggtccctaggacgtaccgttccgttccgtcggtacgtccgacggtcccgttcggttcgggttccgaccgtacgtaacgtacccaactaccctaagtacgtcggacggtccggtcgggtccccgccggacgggtcccgtaccggggaagggggtaacggggtcgtaggggtacggtcgttccgtttcgttttactttttaagttagttaggttaacggttggttaacgtacctaacgttaccgtaccggacgtaacggtaccgtcgggtacggggaccgggtacctaacttacccgtacctacgtacccgtaacggaacgtaaccgaaacttaaaccctaccgaaacggtaccgtacggtttcctttaccggtttactaaacaaagttcccgaactcggtaccgtaaggacgtacggaccgtaagtaccgtaaccgggtcgttaccggtattacgttccgtagaccgggaacggtacggacgggtaccgggtcccggaaaccctaacgggttaacgttacccgtacgtcgttaaaggtccgggtaaccggtggggtaaacccgg

SEQ ID NO: 995 - DNA, 756 bp, Homo sapiens
  misc_feature: GYAE6OF01BFE09.13.36.D03.1.454.CMB.1.raw
  modified_base (365)..(365): a, c, t, g, unknown or other
  misc_feature (365)..(365): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgacaatcgtgggtctgagttagaaacgaaaccgtggggcctcgaggtgtaacggtttcctgacgaagggtcgtcgtggatacacgttcacttacttatgcttagtggtaagttgggtcgccgacgaggtcctccgtagggaacgaaggggtcttggaggtcggtagtgggagtggactcganactacgaactacggtacggaaccctaagtctcgacccgaggtccttcgaacgtaggtacggttttcgtctttaccggttccgtacggaacctcccgttacgtcgttaccgacgggtccgtaacgggtcgttaacgttacgttaacgacgtaacctccggaagtacccgtaaccggtaacccggtaaagggtcccgtaagtacgggtaaccaccggtttaccgtaacctttagtttttaaccgttacgttagggttacgtaacggtagttacgtttacgttttccgtttacccggttagttaacccggttaccgtttcccgttaccgttcggtttacccgttacggtaaccgtttacggggtcccgggaaacccggttcccggggtaacccg

SEQ ID NO: 996 - DNA, 653 bp, Homo sapiens
  misc_feature: GYAE6OF01DT3HY.13.36.D03.1.454.CMB.1.raw
  modified_base (221)..(221): a, c, t, g, unknown or other
  misc_feature (221)..(221): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatcgtgggtctgagttagaagaaccgtggggcctnagtgtaacggtttcctgcaaggcgtctggatacacgttcactacttatcgtactagtagtaagttgggtcgacgacgacggtctcgtggaacgaagggtcttaggaggtaggaggtgggagtggatacgaatactacaaaccgacggtacggaaacctaagtacgtcgaccgaggtcctacgacgtagggttcgtttcgttactttccgttcgttcggacctaccgtcgttacgtccgtacgcgtaacggtcgtaactgtacgagtactcgaacgacgacgtaacgtaaaggctaagacgaactacgtacgtaccttagtttaccttacgtggtacgtagtacgttagttaccttttccgttcgtacgttaccgttacggtactttcgttcgtaccgttaggaccgttcgggcgggtccgtacggtaccccg

SEQ ID NO: 997 - DNA, 699 bp, Homo sapiens
  misc_feature: GYAE6OF01BP8TS.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatcgtgggtctgagttgaacgaaaccgtggggcctcagtgtaaggtttcctgcaaggtcgtctggatacacgttcactacttatgctatgtaagttgggtgcgacgaggctccgtggacaagggtctggagtggagtgggatggatcgactagtaccaacgacgtacgggaaccaacggtactcgcccgtagggtccttacgacgtacgggtacgtttgtccttctccgttacggacctaccgttcgtacggtccaacgtccgtacgggtacgtttagtacggtaacacgtacgttaccgaggtaccgtaaccggaaccttaaacgggcgtacgaacgggaaccctacgtaccggtaacctttaagtttacgtttaaccgttggtacggttagaacgttagttacctttcgttttacccgttaggtaacccgtttacggttaccctttcgttaccggtttccgttacgttaacccgttacgggtcccggggaaccgttaacggggtaccccgg

SEQ ID NO: 998 - DNA, 691 bp, Homo sapiens
  misc_feature: GYAE6OF01AIVPD.13.36.D03.1.454.CMB.1.raw
tcagtcacgtactacacgaccggtgctcgatttagctgcgtcacgatcgtcgtcttggggacccaacaaccacacccctcctaagaagaagcccctagaccacagctccacaccatcggactggacctggaggatcctcttcttggtggcagcagcaacaggtgtccactcccaggtgccaactggtgcaatctgggtctgagttgaacgaaaccgtggggcctcgagtgtaacggtttcctgcgaaggccgtctaggatacgacgttcaacttacttatcgcttagtacgtaagttgggtcgcgacgacggcctccgtggaacgaagggtcttggagtaggagtgggagtggatcggactatacgaacgtacgtccgggaaaccctaaggtctccggacccgaggtccttacgaccgtaggttacggtttcgtcttccttccgttacggaccctaccgttcgtacgtcgacgtccgacggtacgtatacggtacaagtctcgagaccgacgtaccgtaacggtcgtggaacggtaccagtcgacctttatttacgtagttaggtggtagtaacgtagtttaccgtttccgtttaaccggttacggttaaccgttaccggtttacgttcccttacggttacccttaggtacccgttacgggtcccgggtaccggtaccgggttaaccccgg

SEQ ID NO: 999 - DNA, 867 bp, Homo sapiens
  misc_feature: GYAE6OF01B18G0.13.36.D03.1.454.CMB.1.raw
  modified_base (226)..(226): a, c, t, g, unknown or other
  misc_feature (226)..(226): n is a, c, g, or t
tcagtcacgtactacacgaccggtgctcgatttagctgcgtcacgatctctcgttgggggggtcagagctctggggaggaactgctcagttaggacccagacggaaccatggaagccccagcgcagcttctcttcctcctgctactctggctccagatactagtggaagaaatagtgatgacgcagtctccagccctacctgtctgtcgtcgtacgaaggggaaanacgccctacctcgtcctagcgacgggccagtcagactagttacgacctaaacgtaacgtacgtcccgtagggtaaccacggaacgaaacggtaaaccggtcggacccgtaacgggcccgttaccccggaaggtaccccttaccgtacgtaacgtttacccgtaagttcggggttaccacctaaaccgttacccccgaaccgggaaccggggtaccccctaaacggtttaccggtaaacccgtaccccggtaaacggggttaaccccgggttttacgaaacgggttccggggaaccgttagggggtttaccggggttaccggtacggggtaaccttaacgggttacccgtttacccgtaacccgtttacccgtaacctaacccgtaacgtacccgaacgggtacccgtacggtttaccgtcggtaaccgtacgttacgtaacggtaacgtttagttttcggtactttaagttttaacgttacgttacggtacgttaacgtattaacgttaacttaacgtaaccggttccggtaccgttaccgtaacgttacgtaccgtttacgttaccgggtttaccggaacccgggtaaaccgggtaaccctaaccggttacggaacgttaacgtaccgaaacggtaacgg

SEQ ID NO: 1000 - DNA, 616 bp, Homo sapiens
  misc_feature: GYAE6OF01BA0WH.13.36.D03.1.454.CMB.1.raw
  modified_base (579)..(579): a, c, t, g, unknown or other
  misc_feature (579)..(579): n is a, c, g, or t
  modified_base (586)..(586): a, c, t, g, unknown or other
  misc_feature (586)..(586): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatcgtgggtctgagttgaagaaaccgtggggcctcagtgtaaggtttcctgcgaaggcgtcgtggatacgtacgttcactacttatgctatagaagttgggtcgcgacgaggcctccgtggaacgtaagggtcgttggaggtggagtgggagtggatcgactatacaacgacgtacggaacctaagtctcgcccgaggtcctcgacgtaggtacggtttgtcttccgtcgttcggacctaccttcgtgtcgcgacgtacgggtacttagtacgtacgagtactcgaacgctacggtaccgtaaagggctagggaacgactacggtacgtaccttaagttttactagttggtagtgagttattctttcttacgtgtaacttcggttcttcgttntccgttntaccgttaggtccggtccgacggttacccg

SEQ ID NO: 1001 - DNA, 798 bp, Homo sapiens
  misc_feature: GYAE6OF01DE2SD.13.36.D03.1.454.CMB.1.raw
  modified_base (239)..(239): a, c, t, g, unknown or other
  misc_feature (239)..(239): n is a, c, g, or t
  modified_base (420)..(420): a, c, t, g, unknown or other
  misc_feature (420)..(420): n is a, c, g, or t
  modified_base (657)..(657): a, c, t, g, unknown or other
  misc_feature (657)..(657): n is a, c, g, or t
tcagtcacgtactacacgaccggtgctcgatttagctgcgtcacgatctctcttggggacccaacaaccacacccctcctaagaagaagcccctagaccacagctccacaccatggactgacctggaggatcctcttcttggtggcagcagcaacaggtgtccactcccaggtgcaactggtgcaatcgtgggtctgagttagaagaaaccgtggggacctcgagtggaaggttttccngcaaggcgtctggaatacgacgttacgacttacttatcgcttagtagtaacgttgggtgccgagaggctccgtaggacgtaacgggtcttggtagttagggagtggggaagttgggaacttccggaaactatacccggaaactaacgtccgggaaaaccctaacggttagtccgaacccgngggtacctttacgacgtagggttaccgggttttctaccttccgttaccggtttcgaaccttaccgttcctaacgtccgtaacggccgtaaacggtcccgttaagttaacggtaactacggtactacggttaaccgacgaaccggtaccggttaaacggaccgttaacgggaacggttaacccgtaccgttacggtaaccctttaaagttttacgtttaaccgttggttaacgggttnttaccggttaaagttccctttttaccgttttaccgttaccggttaaacccgtttacggtttaacccgtttcctttcggtttaccccgttacggttacccgttaacgggttcccggggaaaccggtacccggggttaacccg

SEQ ID NO: 1002 - DNA, 819 bp, Homo sapiens
  misc_feature: GYAE6OF01EUQ0A.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatcgtgggtctgagttgaaacgaaaccgtggggcctcaggtagtaacggtttcctggcgtaagggtccgtcgtaggatacgtacgttacctacgttacttatagtcttaagtagtaagtttggggtacgacgacgtacggtaccgtccggtagggaaccgtaaggggtacgttgggtaagggtgggtaaggttagggagtgggtaactaccgaacgtactaccgaaaccgtacggtaaccggtaaacccgtaacggtacgtaccggcccgtaaggtccttacgaaccggttacgggttaacgtttcgtccgtttccgttccgttacggtaccttaccgttcgtacgtaccgaacgtccgtacggtacgttaactacgtaacgacgtactccgaacgcgtaaacccgttacggtaaacggccgtaagaacgtaccgtaccgttacggttaacccttaagttttaccgttagttgggtactaacggtaggttaaaccgttttccgtttaacctttttccggttaacggtttaaccggtttaccgtttaacccgttccggtttaacgttaccctttaaccgggtacccgtttaaccggggtacccggggtttaaccgtaacccggggttaccccgg

SEQ ID NO: 1003 - DNA, 898 bp, Homo sapiens
  misc_feature: GYAE6OF01AP8EX.13.36.D03.1.454.CMB.1.raw
tcagtcacgtactacacgaccggtgctcgatttagctgcgtcacgatctctcgttggggggggtcacaagaggcagcgctctcgggacgtctccaccatggcctgggctctgctgctcctcactctcctcactcaggacacgaggggtcctgggcccaggtctcggccctgactcagcctcgcctcatgtcgtcgggtcctccgtggactagtcgatccaccattcctcctgccagtaggaaatcgcagtgtactggttcgggacttagtcgtacctttcgtccgttccgtaggtaaccgaaccaacctaccccgtaagggaccaaaaccgaccccctaaagtcctaagtttacggtttaaccggggtacctaaacgttaacggcccggtacccgtaggtacgggttccttttaccgaggtaacttcccggtacttttccgtccgtacggttacccctaccgtaacgtcgttacggaacctaaaccggtcccggtccccttaccggtaccgtaacccttagttaccccggttccggttaccggggtacccttacccgggaacggggtaccgttttaccggggaaaaggggttcctttacggggttaaccgtttcggtttaaacggttttaacgttttaaccgttttaccggtcgggttaaccctttgtacccccgtttaagttacccggttaaaccgtcgggtaaccggttaacggacccgtttaacgggtaacccgtttaacttaccgggttaaccgggttttaaacggtttcccggggttaacgggggaccccggggttaaaacgggacccctaaagggttcccgggtttaaccccgggacccggttttaacccggggacgggttaaccccggtaaacccggtaaacccccggggg

SEQ ID NO: 1004 - DNA, 716 bp, Homo sapiens
  misc_feature: GYAE6OF01BGXN6.13.36.D03.1.454.CMB.1.raw
  modified_base (401)..(401): a, c, t, g, unknown or other
  misc_feature (401)..(401): n is a, c, g, or t
tcagtcacgtactacacgaccggtgctcgatttagctgcgtcacgatctctcgttgggggggagaggagcccagcactgggattccgaggtatttccattcggtgatcagcactgaacacagaggactcaccatggagttttggctgagcttgggtttttccttattacttaattttaaaaggtgtccagtgtgaggtgcgagttggtggagtcgtgggagggaggtcgttgggtccgacgggtcccgggggggtccctggacgtactctcatggtgccggcctcgtcgggctccaccgtacaaccaccaacgtacatgacgcgtcgggtcccgccgacggctaccgagggaacgagggccgggagtcgggtctctagtttatttacgtgtcgtacggtcncacgtacttcgacgcacgaccgtccggtacggacggggtccgttccacctacgtcctccgaacgacaacctaacttacccgaaagtaaccgtacggttagttaacgttccttaacgaaactacgaaccgtacgttaggagtacggtacggacggacgtacccggtccgttacgttacttacgtacggtagaaccgaaagtacgtacgacgaggaacgggtcccgggtaccccggttaaggtccgggggtacccggttggggttacggggttaccggtttacgtttacggtttaccggttcggttcggtaccgggg

SEQ ID NO: 1005 - DNA, 612 bp, Homo sapiens
  misc_feature: GYAE6OF01AVPAU.13.36.D03.1.454.CMB.1.raw
  modified_base (130)..(130): a, c, t, g, unknown or other
  misc_feature (130)..(130): n is a, c, g, or t
  modified_base (229)..(229): a, c, t, g, unknown or other
  misc_feature (229)..(229): n is a, c, g, or t
tcagtcacgtactacacgaccggtgctcgatttagctgcgtcacgatctctcttggggggggtcacaagaggcagcgctctcggggacgtctccaccatggcctgggctctgctgctcctcactctcctnactcaggacacagggtcctgggcccagtctgccctgactcagcctgcctccgtgtctgggtctcctggacagtcgatcaccatctcctgcactggaacngcagtgatgtgggacttatgaccttgtctcctggtaccgacaacacctagcaaacgccccaaactcattattacggggtacaataacgccggccctcacgggtctttcgtcgtactcggcttctctggcctacaacgtctggccaacgaccggcctccctgacaatctctcggactccgaggccgaggacgagctaggtacttttacgtcgtttcgttcgtaattagtcgacgtaacgggaaaggtcgtagtagtttacgttagttccggtttagggaagttcggggtaaaccgaacgggttccgtacccggttccgttacggttcaccggtacccgaacgggacccctaaacccgaccgttacgtccgtaaccgttccccgg

SEQ ID NO: 1006 - DNA, 785 bp, Homo sapiens
  misc_feature: GYAE6OF01AG4II.13.36.D03.1.454.CMB.1.raw
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacgagggtcctgggcccagtctgccctgactcacgccctgcctccatgtcgtgggtcctcgtggacacgtcgatccaccatcctcctgccacgtaggaaatacgcgtagtagagttggttagggaactttagtcgttaccctttgttcctaccggttacggtaaccccaaacccaacccgaccccgtaacggaacccgtaaaacccccggacccccctaaataccttaacgttttacgggtttaaccggggtacctaaagttaaccggccccggtaccctcggtacggttctttcgtagtacttccgttcttctcgtcgtccgtaacctggtctaccggtaccaaccgtcccgtaccccttccgacgtacctaactccgttcgaccggtacctaccggtaccgggacgtacgggaacggtacgtacgtttagtttacttttacgttagtttacgtactacgtggtacgacgggtaaggtaagggttattaggtttattaaggttcgtttaacgggtacggtacggggtaacccggtaacggttaccggtaccccggttacgtttccggtccggttacccggtaaccccgacccgggtaaaccccgcccccggttaaaaccctcgttaccccgttaccgttacccccg

SEQ ID NO: 1007 - DNA, 762 bp, Homo sapiens
  misc_feature: GYAE6OF01C3QSG.13.36.D03.1.454.CMB.1.raw
  modified_base (157)..(157): a, c, t, g, unknown or other
  misc_feature (157)..(157): n is a, c, g, or t
tcagtcacgtactacacgaccggtgctcgatttagctgcgtcacgatctctcttggggacccaacaacccacacccctcctaagaagaagcccctagaccacagctccacaccatggactggacctggaggatcctcttcgttggtggcagcacganaaccgaggtcgtcccacctcccgagggtgcaacgtggtgacaatcgtgggttctgtaggttagaaacgaaccggtcgggtcctcgtaaggtcggttaacggtttccgtagtacgaacgggtctacgtaggtactaacgtaccgttactacttaacgttagtacgtacttagtaggttaacgttagggtacgacgtacggtacggtctaccgtacgggagtaacgggtcgttggaggtaggaggtacgggtagtacggactacggtacaacgtaaccgaaacgtaccggtaacggaaacccctaggtaccgtacgacccggtacggtcgttaaccgagggtaacggttcggtttacgtctttaccgttacgtaccgtacctaccgtcggtactacgacgtacgtacgtagtacgtagtacgagacgtcacgacgactacgtagcgtacgacgtctacgtataccttagttacgtacgttgtacgttacgagttacgttccgtttattacccggttattaacggtttaccggtttcgttacccgttagtttacccgttacggtaaccgtttccggggaaaccgggtttccggtaacccgggttaacg

SEQ ID NO: 1008 - DNA, 829 bp, Homo sapiens
  misc_feature: GYAE6OF01CFDPB.13.36.D03.1.454.CMB.1.raw
  modified_base (254)..(254): a, c, t, g, unknown or other
  misc_feature (254)..(254): n is a, c, g, or t
  modified_base (328)..(328): a, c, t, g, unknown or other
  misc_feature (328)..(328): n is a, c, g, or t
tcagtcacgtactacacgaccggtgctcgatttagctgcgtcacgatctctcttggggacccaacaaccacacccctcctaagaagaacgcccctagaccacagcctccacacccatggactcggacctgggagactccctcttacgttggtggcagcagcaacaggtctacccaactccccgaggtcactacgtggtcactaagtcgtggtctagagttacgaacgaaccggtgggcctgagtagtacgttcncgacgacggtctcggtagtactacgtacgttactacttacttagtcgtacttaaggtagttaggttcgggaacncggtaacgtcggtccgttacggacggtacggtaggtcgttagagtggaacggtggtatggtactaccgatacgtaacaccggtacggtaacccggaaaccgtacgtaggaccgtacccgggaaggtccctacgggaaaccgttggtttaacccgggttttcttaccttccccggttcgtttacggaaccccttccgttacgtaccgtacgtacggtaccgtacgtacgtacgtacgtacgtacgtcgactacgtacgacgttaccgaacggacgtaacgtacggtaccgtaaccgtacgtttacccgttaatttaccggtttacgttaggtacgttacggtaacgttccggtttaaccgttttaacccggttacccgtttaacggtttacccggttttaaaccgttttacccgtttaccggtttacccgtttacggttaacccggttacgggtacccggggtttaacccgggtacccggttaacccggggtttaaccccgg

SEQ ID NO: 1009 - DNA, 764 bp, Homo sapiens
  misc_feature: GYAE6OF01BUPYX.13.36.D03.1.454.CMB.1.raw
  modified_base (239)..(239): a, c, t, g, unknown or other
  misc_feature (239)..(239): n is a, c, g, or t
  modified_base (727)..(727): a, c, t, g, unknown or other
  misc_feature (727)..(727): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccgaggtgcaacgtggtgcaatcgtgggtctgagttgaagaaccgtgggacctcaggtgtaacggtttccngacgaaggtcgtcgtggactacgtacgttcacttacttatggtactagtaggtaagttggggtacgacgacgacgggtcccgttcgtacggaacgtaagggtccgtttaggaagggttgggaggttgggtaacgtgggaacctacgtaacctacgtaccaaaccgtaccggtaccgggtaaaacccctaaggtcacgtaccccggaggtccttacggaaacggtcgggttaacggtttcgtccgttttaccgtccgtttaccggacccttactcggttacgtcgaagtcccggtaacggtccgtaaagtccgaacgttacgacgttcgacgggtaaacctaccgggtaaccggtaacggttacgaccggggtaacaacccggttacttccggtaaacctttaggttttacctacgggttgtacggtaagtacgttagttccccttttacgtttacgtcggtaaccgtttacgtctttcgctttacgtnttacccggtaaggtccgggaaaccggtcggtacccgg

SEQ ID NO: 1010 - DNA, 664 bp, Homo sapiens
  misc_feature: GYAE6OF01AP79M.13.36.D03.1.454.CMB.1.raw
  modified_base (365)..(365): a, c, t, g, unknown or other
  misc_feature (365)..(365): n is a, c, g, or t
tcagtcacgtactacacgaccggtgctcgatttagctgcgtcacgatctctcttgggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacgacgttcactacttatgctatgaattgggtgcgacaggctccgtggacaagggtcttgagtggagtgggatggactcgacatccaaagtacgtacgggaaacccctaaggttancggcccgagggtctttacgacgtaggtacggttttcgtctttcgtcgttcggacctaccgtctacgtccgacgtccgacgggtcgttaactcgtaacagtactacgacgccgacgacctaaagggctacgggaagaccgtacgttgacctttaatttacgttacgttagtcggtagagtacgtttacgttttcctttacccgttggtaacccgtttaacgggtttccttttccggttacgtttcccgttaggttaccctttaggggtcccggggtaccgttaacccggggttaaccccg

SEQ ID NO: 1011 - DNA, 705 bp, Homo sapiens
  misc_feature: GYAE6OF01B98Q5.13.36.D03.1.454.CMB.1.raw
  modified_base (425)..(425): a, c, t, g, unknown or other
  misc_feature (425)..(425): n is a, c, g, or t
tcagtcacgtactacacgaccggtgctcgatttagctgcgtcacgatctctcttgggggggagaggagcccagcactgggattccgaggtgtttccattcggtgatcagcactgaacacagaggactcaccatggagttttggctgagcttgggttttccttgttgcttattttaaaaggtgcccagtgtgaggtgcagctggtggagtctgggaggaggcttgatccagccgtcgggggtccctgagactctcctgtgcagcctcgtgggttccaccgtcagtcaccacctacatgagtcgtcggggtccgccgaggcctccggagggggaacgggctgggagtcgtcgtcttcttttattagtagtagtggtagtactatctccgcagtaccgtcggtaggacggggtacctacttacacctntccctacgaacgacgtaactaaacttaccaaagtaacctaccggtctttacgtttaccttaacgaaagttacgaaccgacgtccgttagggaacggtaccggtaccgtaaggtacggaacccggtaacccgggtccggtttaagttaacgttaccggttacgggtacgaccgggaaggtaccggtaacgggttacccgggggaacccctaaaccgggttaaacccgtttaaccggaaccgttaccggttaacgggtccggggtacccggttacccggggg

SEQ ID NO: 1012 - DNA, 803 bp, Homo sapiens
  misc_feature: GYAE6OF01CILE4.13.36.D03.1.454.CMB.1.raw
  modified_base (670)..(670): a, c, t, g, unknown or other
  misc_feature (670)..(670): n is a, c, g, or t
tcagtcacgtactacacgaccggtgctcgatttagctgcgtcacgatctctcttgggacccaacaaccaccacccctcctaagaagaacgcccctagaccacagcctccacaccatggactggacctggaggatcctcttcgttggtggcagcagaccaacaggtcgtacccacctcccgaggtcgactaacgtgggtgacaagttcgtcgggtctgtagttaggaaacgaaccgtgggcctagaggtaggtaacggtttcctgacgtaggtccgtgtaggtactacgtaccgttactaacttacttagtcgtactagtagttaaggttgggtacgaccgtaacgtacggtccgttccggtaacggaacggtagggttacttagggtagggtaggtaggtacggggtagttacgggtacgtaacccgagtaaccgtaacccgaaaccggtacccgggtaacccggaaacccgttaacggtacgcccggtacccggtaggttcccgtacggtaacggtacgggtttacggtttccgtaaccgtttcgttacccgtaccgtacttacccgttcgtccgtaccgaccggtaccgttcgggtacgttaggtaccgtaacgtacgtaccgtacgaccgtaacgaccgtaacggtacggcgtaaggtaccgtaacncgtacgtaccttaatttacgttagtacgtgtaggtattacgttacgtttccttacggttacgttacgttacgttcgttacgttccgttacgttaccggttcgtaccggttacggggaccgtacccgggtaccg

SEQ ID NO: 1013 - DNA, 858 bp, Homo sapiens
  misc_feature: GYAE6OF01C9VGY.13.36.D03.1.454.CMB.1.raw
tcagtcacgtactacacgaccggtgctcgatttagctgcgtcacgatctctcgttgggggggtcagagctcgtgggggaggaactgctcagttaggaccagacggaaccagtggaacgccccagcgcagcttctcttcctcctgctactctcggctccagatactactggaagaaatgtgctgacgcagtctcagtccacctgtctgtcgtccgtacgaaggggtaactacgacctacccttctccgtgcgacgggaccagtcgaggtagttagttcgacgtagcgtacgtacctttacggccgttacgggtaacccaggaccgaaggaccggtccccggtacgggacccgtacggtcccttaccccggacgggtccctttccgttacgtttaacgtttttacggtcgggttaccgaccgttaaccgtcccggtaacggttaccgggtacccttacgggttccgggttccgttacccgaaggtttccggttaacgggttccgaaacggggttccgtacgggttacgggttaccgggggtttacgacgggggtacctaacggttaccccgtttacctaacccgtttacccgtaacccgtaaccgttaccgttaccggaacccgttacccgaaccggttcccgtacggaacccgtttagtttaacgggtacgtttaaaacggttttcgtttacggaccgtttaaccgtttaccgtttaagttaccggtttacggtactacgggtaacttaaacggtttaccgtaggttcccggtagtaaacccgggttacccgtacggggaacggtaaacgggtacgaccggtaggtaaacggtaagtaaacgggtagttacggtacggg

SEQ ID NO: 1014 - DNA, 807 bp, Homo sapiens
  misc_feature: GYAE6OF01EVZI4.13.36.D03.1.454.CMB.1.raw
  modified_base (236)..(236): a, c, t, g, unknown or other
  misc_feature (236)..(236): n is a, c, g, or t
tcagtcacgtactacacgaccggtgctcgatttagctgcgtcacgatctctcgttgggggggtcagagctctggggaggaactgctcagttaggacccagacggaaccagtggaacgcccagcgcagcttctccttcctcctgcctactcgtggcctccagtatacgtagtggaataaatgtgatgacgcagtcctcacgcccacccgttgtctgtcgtctaccggaaggggaacnccgtacccacccgttctaccgtcggaccgacgggtcctaaggtccgtaggtacgttcggttaacgcgacgtacgtacgtaccttaacgtcgtaccgttacggtaaccaggtaacgaaccgtaaccgtcggaccgtacggtaccctccggagtacctcctacgtacttcgtaacgtggtcacctacgaccgacggtacgaccgggtacctacggcgacctaaccgtaccggaagttaccgggtagttacgacggtacgggtacgtagggttcggtaccggtaacggtaccgtacgttacctacgtaccgtccacgtcctacgtacgacgtacgtacgtacgtacggacgtacgttacggtaagtttacgtaacggtaccgggttaattacgttaacccgttacggtacttaacggtcggttaacgtagggttaaccgttaccggttacgtaaccccgttcccgggtaacccggttaccggggtaacccgggtttaacccggggaaccgggttaaacccgggaaaagggtttaaacccgggttaaaaccggaaaaccggttaaaacccggggg

SEQ ID NO: 1015 - DNA, 825 bp, Homo sapiens
  misc_feature: GYAE6OF01AWP0H.13.36.D03.1.454.CMB.1.raw
  modified_base (674)..(674): a, c, t, g, unknown or other
  misc_feature (674)..(674): n is a, c, g, or t
tcagtcacgtactacacgaccggtgctcgatttagctgcgtcacgatctctcgttgggggggtcagagctctggggaggaactgctcagttacggacccagacggaaccatgggaacgccccagcgcagcttctccttcctcctgctactctggcctccagatactactggagaaatagtgctgacgcagtctctacgtccacccgttgtctgtcgttacctaccggaaggggtaaactacgaccctaaccctcctccgtacggccggaacgggtcctaggtaccgtaaggtacggttagttaacgccgaacgtacgtaacggtccgttaaccggtcccgtaacggttaacccgaacggaccgaaaggtaaccggtcccgtaccgggaccgtaccgggtcccctaccccggtacgggtccctttaccgttacgtttaagtttacgtcgggtaccgtaccttaacccgtacccgaaccggttaccggtacccgtacgttcgggtcccgttaacccgtacggttaccggtacggttaccgacgggtccgggtacggttacggggttcgggtacggtaccggggacttaccggtacctttaccgcccttaccgtaccctaccgacgtaccgacgtaccgtaccgcgtcgtaccggtagttacgtaacgtacggtttnttaccgactttacgttactttacgttacgtctacgtacgtattaaggttaccgttagttaaccgggttcgaaccgttaccggacggtaacccggaaggtaccgtaacggtacggtaaggttaaaccgtaaagggttaacgtggttaaccgg

SEQ ID NO: 1016 - DNA, 704 bp, Homo sapiens
  misc_feature: GYAE6OF01CX8M1.13.36.D03.1.454.CMB.1.raw
  modified_base (191)..(191): a, c, t, g, unknown or other
  misc_feature (191)..(191): n is a, c, g, or t
  modified_base (260)..(260): a, c, t, g, unknown or other
  misc_feature (260)..(260): n is a, c, g, or t
  modified_base (263)..(263): a, c, t, g, unknown or other
  misc_feature (263)..(263): n is a, c, g, or t
  modified_base (540)..(540): a, c, t, g, unknown or other
  misc_feature (540)..(540): n is a, c, g, or t
tcagtcacgtactacacgaccggtgctcgatttagctgcgtcacgatcgtctcttgggggggtcagagctctggggaggaactgctcagttaggacccagacggaaccatggaagccccagcgcagcttctcttcctcctgctactctggctccagatactactggaagaaatcgtgctgacgcagtctcncgtccacccgtgtctgtacgtctaccgaggggtaaatcgacctaaccctctctcgcgacggcagtcagngtntagcagctacgtcttacgcgtagtaccgagcgaagacgtccgtcggaccgacggtcctccgagtccctaccttatacgtttagtcggtcacgtaccgtaccgtaacgtacggtcctaggttcggtccgtacccgtgtaccgtacggtacgacggtcggtcgtagggttcgggtacgtacggacgtaccgtacctttaccgaccgttaccgtaccctaacgtacgtccgtacgacggtaccgtccgtagtaccgttacgtacgtaggttaaccgtttntttacggaccttacgttacgttacgttacgtacgtacgtacggtaacgttaagttacgttacggtagttaaccggtacgtaacccggtttaccggaaccggaaacgggttaccgaaccggttaggtaacgggtaacgttaaaacggttacgggaaggttacggg

SEQ ID NO: 1017 - DNA, 875 bp, Homo sapiens
  misc_feature: GYAE6OF01CQP9J.13.36.D03.1.454.CMB.1.raw
  modified_base (178)..(178): a, c, t, g, unknown or other
  misc_feature (178)..(178): n is a, c, g, or t
  modified_base (186)..(186): a, c, t, g, unknown or other
  misc_feature (186)..(186): n is a, c, g, or t
  modified_base (590)..(590): a, c, t, g, unknown or other
  misc_feature (590)..(590): n is a, c, g, or t
tcagtcacgtactacacgaccggtgctcgatttagctgcgtcacgatctctcttggggacccaacaacccacacccctcctaagaagaacgcccctagaccacacgctccacaccatggactgacctggaggctcctcttctggtggcagtcagcaacaggtgtccactcccgaggtnacatggtnactatcgttggtctgtacgttagaaacggaaccgtcgggtcctacgtaggttacggtaacggtttccagacggaacggtcgttcgtaggtaacttaccgtacgttacctacgtattacgtagtaccttaggtataggttgggttcgacggtacgtacggtaccgttccggtacggaaccgggtaaggggttccgtttggagggtttaccgggtaggtcgggtaacgttgggtaccaacggttaccaacgttaacccgaacgtaaccggaccgtaaacccggtacgtaggccggtacccgacggttactaacgaacggtacggtacgtacgttttcggttacttcccgttacgtacggttccctacccgttagtacccgttcgaccggtccgtaacccggtttanagttacggtaacgtattaccgaagtccacggtaacccgaagttaccgggaacttacggacgtaaccggttaccctcgttaaacgttcgttttaacgtacggttggttaaaccgtaacggggtaattttaacccgggttttcgtttaaacccccgttttcccggttaggttttaaaacccgtttcccccggtttttacttacccggtttttacccggttaccccgtttaaacggggtcccgtttaaacggggttccccgggggtaaacccccggtttaaccggggg

SEQ ID NO: 1018 - DNA, 579 bp, Homo sapiens
  misc_feature: GYAE6OF02JAAAL.13.36.D03.1.454.CMB.1.raw
  modified_base (249)..(249): a, c, t, g, unknown or other
  misc_feature (249)..(249): n is a, c, g, or t
  modified_base (349)..(349): a, c, t, g, unknown or other
  misc_feature (349)..(349): n is a, c, g, or t
  modified_base (456)..(456): a, c, t, g, unknown or other
  misc_feature (456)..(456): n is a, c, g, or t
tcagtcacgtactacacgaccggtgctcgatttagctgcgtcacgatcgtctcttgggggggtcagagcttctggggaggaactgctcgagttaggacccagacggaaccattggaagccccagcgctaggtcggttctcgttacctcctggccttaccctcgtggtcctcccgagatacgtagtggaagaaatacgtggatgaccgtcagtactccagtcccacctgtctgtgtctccgagggggaangcccacctctcctgcagggccagtcagacagttagcaacaacgtagcctggtaccagcaagaaacgtggccaggctcccgaggcctcctcatctatggtncatccacagggcccactggtactccccagtaccggtttcaggtcggcaggtggtcctggggacagtccttcactctcaccatcagcagtctgctagtctagtaagtnttttgcttagtttattactgtcagctagtataaataactgtacctcgtaacagttacgttaacctacgttttcggaccgtacggggaaccctaaccgttaggaagtacgttacgagtaaccgg

SEQ ID NO: 1019 - DNA, 507 bp, Homo sapiens
  misc_feature: GYAE6OF02HI79I.13.36.D03.1.454.CMB.1.raw
  modified_base (419)..(419): a, c, t, g, unknown or other
  misc_feature (419)..(419): n is a, c, g, or t
tcagtcacgtactacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaagcccccaaactcattattacgggtcaataagcggccctcagggctttctgatcgcttctctggctccaagtctggcaacacggcctccctgacaatctctggactccaggccgaggacgaggcttgatttttacngttgttcatatgcaggaagagtgattatgtcttggaagtgggacaaggtcaccgtcttggcagcccaaggcccaacccactgtctacg

SEQ ID NO: 1020 - DNA, 592 bp, Homo sapiens
  misc_feature: GYAE6OF02GA9UP.13.36.D03.1.454.CMB.1.raw
  modified_base (257)..(257): a, c, t, g, unknown or other
  misc_feature (257)..(257): n is a, c, g, or t
  modified_base (357)..(357): a, c, t, g, unknown or other
  misc_feature (357)..(357): n is a, c, g, or t
  modified_base (366)..(366): a, c, t, g, unknown or other
  misc_feature (366)..(366): n is a, c, g, or t
tcagtcacgtactacacgaccggtgctcgatttagctgcgtcacgatcgtctcttggggggtcagagcttctggggaggaactgctcgagttaggacccagacggaaccattggaagccccagcgctaggtcggttactcgttacctccctggccgttaccctcgtgggtcctcccgagattacgtagtggagaaagtacgtggatggaccgcgagtacgtccagtcccaccctgtctgtgtctccgagggggaaanggcccaacccgtctcctgcagggccagtcagacagttagcaacaacgtagcctggtaccagcagaaacgtgccaggctcccaggctcctcatctatggtncatccacgngggccacgtggtactcccagaccggttcaggtcggcaggtcgggtctgggacagacttcactctcaccatcagcagtctgcagtctagaagtattttgacttagttttatttacgttgtcagtactaagttaataattaacgtcggtccttaccgtactacgttcgttaccttacgtttcggaccgtaacgggtacctaaccggtaggaagtactacgaacgaacg

SEQ ID NO: 1021 - DNA, 516 bp, Homo sapiens
  misc_feature: GYAE6OF02IO04B.13.36.D03.1.454.CMB.1.raw
  modified_base (397)..(397): a, c, t, g, unknown or other
  misc_feature (397)..(397): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatgggatcgacatcaacactgggaacccaacgtatgcccagggcttcacaggacgtttgtcttctccttggacactctgtcngcacggcgtatgtacagatcagcagctaaagctgagacatgccatttatactgtgtgagagattctttccttgacctacggtacttcgtgtccttgacctacgtgggccagggtacccg

SEQ ID NO: 1022 - DNA, 509 bp, Homo sapiens
  misc_feature: GYAE6OF02H9IQK.13.36.D03.1.454.CMB.1.raw
  modified_base (313)..(313): a, c, t, g, unknown or other
  misc_feature (313)..(313): n is a, c, g, or t
  modified_base (411)..(411): a, c, t, g, unknown or other
  misc_feature (411)..(411): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctctcatttanggtgcatccactaggcccatggtgtcccagtcaggttcagcggcagtgggtctgggacagacttcactctcaccatcagcagcctgcagtctgaagtntttgctagtctattactgtacagctagtatagttactaggagtaacccgttggaccgaagggaccacggacgtaggagtaagttaaagggattacggg

SEQ ID NO: 1023 - DNA, 508 bp, Homo sapiens
  misc_feature: GYAE6OF02G3CVA.13.36.D03.1.454.CMB.1.raw
tcagtcacgtactacacgaccggtgctcgatttagctgcgtcacgatctctcttggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggctcccaggctcctcatttatggtgcatccactagggccactggtgtcccagtcaggttcagcgcagtgggtctgggacagacttcactctcaccatcagcagcctgcagtctgaagtatttgctagtctattactgtcagctagtatagttactaggtacgtaaccgttcggaccgtaagggacacggacgtaggaagtaagttaaggactaggg

SEQ ID NO: 1024 - DNA, 523 bp, Homo sapiens
  misc_feature: GYAE6OF02I5KIT.13.36.D03.1.454.CMB.1.raw
tcagtcacgtactacacgaccggtgctcgatttagctgcgtcacgatctctcttggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagacagttagcaacaacgtagcctggtaccagcagaaacgtggccaggctcccaggctcctcatctacgatgtattcaggaggaccactgacatcccagacaggttcagtggcagtgggtctgggacagacttcactctcaccatcagcacgactggaacctgaacgtactttgctactttattctgtcacctagtatggttaggtctaccgtactactttgaccgtacggggaccaaggctaggagagtacaaggaccgaacgtggtacggctacgg

SEQ ID NO: 1025 - DNA, 686 bp, Homo sapiens
  misc_feature: GYAE6OF02JMY65.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctccgtggacaagggcttgagtggatgggatggatcgacagtcaacgactacgggaacccaacgtatacggcccgaagggtctttcgaacgtagggtacgggtttgtccgtttccgtccgttagggacctaccgttcgtgtaccacgtccgacgggtcgtagtgtacagattcgacgtcaacgtaccgtaaaggcgtacggacggtaacctaccgtcggtacccttaagttttaacgtttaccgttacggttaggtacgggtaagtacggttacttttacccgtttttcccgtttacgggtaaccttttaccgggttaaccttttaccggttcgtttacccgttttacggtaacccgtttaccgggtaccggggtcccggtaaccgggtttaaccccgg

SEQ ID NO: 1026 - DNA, 519 bp, Homo sapiens
  misc_feature: GYAE6OF02G0FI0.13.36.D03.1.454.CMB.1.raw
  modified_base (283)..(283): a, c, t, g, unknown or other
  misc_feature (283)..(283): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatgcaaccctctcctgcagggccagtcagagtgttagcagcagcttagcctggtaccagcagaancctggccaggctccaggctcctcatttatggtgcatccacgtaggccacgtggtctcccagtcaggttcagcggcaggtgggtcgtgggacagacttcactctcacctactcagcagcctgcagtctgaatagttttgactagtctattactgtcagtcagtatagttactggtaacgtaaccgttcggaccgtaacggacgtacggacgtaggaacgtaagttaaacgggatagg

SEQ ID NO: 1027 - DNA, 543 bp, Homo sapiens
  misc_feature: GYAE6OF02G5I2N.13.36.D03.1.454.CMB.1.raw
  modified_base (432)..(432): a, c, t, g, unknown or other
  misc_feature (432)..(432): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctcccaggcctcctcattttacgtggtcgctatcccaacgttacgggccctacgtgggtctcccagtcaggttcaggcgcaggtgggtctgggacagacttcactctcaccatcagcacgcctgcagtctagaagtntttggactagtcttaattctgtcagtcagttatagttacgtaggtaacgtaaccgttcggaccgtaacgggacctacggtacgtaggaagtaagttaaacggacgttaggg

SEQ ID NO: 1028 - DNA, 527 bp, Homo sapiens
  misc_feature: GYAE6OF02HVJGV.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatgcccagggcttcacaggacggtttgtcttctccttggacacctctgtcagcacggcgtatgtacagatcagcagcctaaaggctgagacactgccatttattactgtgtgagagtatttctttccgtgtactacggtacttcgtgtccttgaccttacgtcggggtccagggtacccg

SEQ ID NO: 1029 - DNA, 551 bp, Homo sapiens
  misc_feature: GYAE6OF02ITNIZ.13.36.D03.1.454.CMB.1.raw
  modified_base (315)..(315): a, c, t, g, unknown or other
  misc_feature (315)..(315): n is a, c, g, or t
  modified_base (476)..(476): a, c, t, g, unknown or other
  misc_feature (476)..(476): n is a, c, g, or t
tcagtcacgtactacacgaccggtgctcgatttagctgcgtcacgatctctcttggggggagaggagcccagcactgggattccgaggtatttccattcggtgatcagcactgaacacagaggactcaccatggagttttggctgagctgggttttccttattactattttaaaaggtgtccattgtgaggtgcagttggtggagtctggaggaggcttggtccagccggggggtccctgagactctcatgtgcggcctctgggctcaccgtcaacaccaactacatgagctgggtccgccaggctccagggaanaggccggagtgggtctcagttatttatgtcgacggtgccacattctagcagactccgtgacggggccgttcaccatctccagagacaagttccaagaacacggtagtatacttacaaatagaacgacctgagagtcgaggacacggccgtctattactgtncgaaagatgacgagagcgggaccccgtaagtcgggccgtggtgggtacgggttcgttcgtttagtactaggtcgg

SEQ ID NO: 1030 - DNA, 527 bp, Homo sapiens
  misc_feature: GYAE6OF02GE9N7.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagaagcctggccaggcctccaggctcctcatttatggtgcatccactaggccacgtggtcgtcccagtcaggttcagcggcaggtgggtcgtggacgagacttcactctcaccatcagcacgcctgcagtctagagtagtttgctagtcttattactgtcagctagttattagttacgtaggtaacgtaaccgttaccggaccgtaacgggacacggtacgtagggaagtaagttaaaggacttaggg

SEQ ID NO: 1031 - DNA, 544 bp, Homo sapiens
  misc_feature: GYAE6OF02GVVQH.13.36.D03.1.454.CMB.1.raw
  modified_base (330)..(330): a, c, t, g, unknown or other
  misc_feature (330)..(330): n is a, c, g, or t
tcagtcacgtactacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttggacttatgaccttgtctcctggtacccgacaacacccaggcaaacgcccccaaactcattattacgggtcaataagcgcctcaggtcttcngatcgcttctctggctcagtctggcaacacggcctccctgacaactctctcggactccaggccgaggacgaggctgtattttactgttgtcattagtgacgaggaagtagtgtaattagtgttacgtttaggaagtcgggacctaaggtctacccggttcgttcggtacacggtacccgaacggtccctaaccccgtacgttacgtacctaccg

SEQ ID NO: 1032 - DNA, 543 bp, Homo sapiens
  misc_feature: GYAE6OF02G2ERX.13.36.D03.1.454.CMB.1.raw
  modified_base (391)..(391): a, c, t, g, unknown or other
  misc_feature (391)..(391): n is a, c, g, or t
tcagtcacgtactacacgaccggtgctcgatttagctgcgtcacgatctctcttggggggagaggagcccagcactgggattccgaggtatttccattcggtgatcagcactgaacacagaggactcaccatggagtttggctgagctgggttttccttattactattttaaaaggtgtccagtgtgaggtgcagttggtggagtctggaggaggcttggtccagccgggggggtccctgagactctcatgtgcggcctctgggctcaccgtcaacaccaactacatgagctgggtccgccaggctccaggggaagagggccggagtggggtctcagtttatttatggtcgacggtgccacattctacgcagactccgtgaggggccgttnaccatctccagagacaattccaagaacacggtgtatctcaaatagaacgacctgagagtcgaggacacggccgtctattactgtgcgaaagatgcagagacgggccccgtaagtcgggcctggcggtagggttcttcgtttgtacgtgtcgg

SEQ ID NO: 1033 - DNA, 519 bp, Homo sapiens
  misc_feature: GYAE6OF02F8C8L.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagcaaccctctcctgcagggccagtcagagtgttagcagcagcttagcctggtaccagcagagctggccaggctcccaggcctcctcatttatggtgcatccacgtaggccactggtcgtcccagtcaggttcagcggcaggtgggtctgggacagacttcactctcaccatcagcagcctgcagtctagaagtatttgctagtctattactgtcagtctagtattagttactgggaacgtaaccgttcggaccgtaacgggaccaacggtacgtaggaagaacgttaaaggacttagg

SEQ ID NO: 1034 - DNA, 576 bp, Homo sapiens
  misc_feature: GYAE6OF02GV8OI.13.36.D03.1.454.CMB.1.raw
  modified_base (448)..(448): a, c, t, g, unknown or other
  misc_feature (448)..(448): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatgcagtgatgttggacttatgaccttgtctcctggtaccaacaccacccaggcaacggcccccagacgtcatctatttagtggggacaagtacggcggccgtcgagggtactttccactcgcttctcgtcggctccaagttctggacaaccgaccggccctcccgtgaactaatcctctggtcctccgaggctaggacggtacgaggcttcgcctattacngtctgctcattatgtcgtagtttcttcgtggttcggttcgttccggggtcggtaacgggttacctaaagggtccgtacccgttaccgtacgggttcccgaacggtacccgtacgggtccctaccccgg

SEQ ID NO: 1035 - DNA, 740 bp, Homo sapiens
  misc_feature: GYAE6OF02JIOJH.13.36.D03.1.454.CMB.1.raw
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
tcagtcacgtactacacgaccggtgctcgatttagctgcgtcacgatctctcttggggggagaggagcccagcactgggattccgaggtatttccattcggtgatcagcactgaacacagaggactcaccatggagttttggctgagctgggttttcctttggctattttaaaggtgtccagtgtgaagtgcagctggtggagtctgggggaggcttggtacagcctggcaggtccctgagactctcctgtgcagcctntggattcactttgatgattatgccatgcacgtgggtccgnaagctccgagggaggcctggagtgggtctcgaggttattaggttgggaattaggtggtaagcgagtagggcttagtgggaccggtacttcgtagggttaggaaacggggtcccgtaatttaccgaaccctaagttcccgttacccgaaggtaacggaaacccgaaaccggacccgtaaaaacgggtaaccccttacccccgttagggttaaacttacccgttacgggaacctaaaaagttaccggaaaccgaaacggtccccgttaagggaacgggtacggtaccgtagggtaacggggaaccgtacccggggtaccgtttttaggtaaacgtttttaacgtttcggggtaacgtaaccgtaaaaaacggttaccgttaaccccctaaaacccccggttttacggtttaacggtttttttacggggaacgttttaacgggg

SEQ ID NO: 1036 - DNA, 698 bp, Homo sapiens
  misc_feature: GYAE6OF02HAWPI.13.36.D03.1.454.CMB.1.raw
  modified_base (222)..(222): a, c, t, g, unknown or other
  misc_feature (222)..(222): n is a, c, g, or t
  modified_base (329)..(329): a, c, t, g, unknown or other
  misc_feature (329)..(329): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactagtggagaaatagtgatgacgcagtctccagcccaccctgtctgtgtctccgaggggaaancgcccaccctctcctgcgagggccagtcagacagttagcaacaacgtagcctggtaccagcagaacgtggaccaggcctcccgaggcctcctcacttctagtggtcncactcccgaccgacgggcccacgttcggtacctcccgacggtacccggttcaggtcggacgtagggttcggggtaccgtagggggacctaacggtaccgtttacccgaaccttcctaccctaacccgtactaccgacggtcctaacggttccgtcggaccgtacgttccgttaggtaacgtttacgtttttacggtaccgtttaaggttttaacttacgttcgttacgtacgtacgttaagttaattaaacgttaacgttaccgtacccgttaccgttaactacgttacgttaaccgtttacggtttaccggacccggtaaccgggtaaccctaaccggtaggtaacggtacgtacgaacggtaaccgg

SEQ ID NO: 1037 - DNA, 521 bp, Homo sapiens
  misc_feature: GYAE6OF02FIA88.13.36.D03.1.454.CMB.1.raw
  modified_base (371)..(371): a, c, t, g, unknown or other
  misc_feature (371)..(371): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaatagcaacccctctcctgcagggccagtcagagtgtagcagcagcttagcctggtaccagcagaagcctggccaggctcccaggctcctcatttatggtgcatccacgtacgggccacgtggtcgtcccagtcaggttcagcggcaggtggtcngggacagacttcactctcaccatcagcagcctgcagtctagaagtattttgctagtcttaattactgtacagcagttatagttactggaacgtaaccgttacggaccgaagggacacggacgtagggtagtaagttaacggtagttacgg

SEQ ID NO: 1038 - DNA, 525 bp, Homo sapiens
  misc_feature: GYAE6OF02F2F3Z.13.36.D03.1.454.CMB.1.raw
  modified_base (422)..(422): a, c, t, g, unknown or other
  misc_feature (422)..(422): n is a, c, g, or t
  modified_base (514)..(514): a, c, t, g, unknown or other
  misc_feature (514)..(514): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcaccatctcctgcactggaaatagcagtgatgttgggacttatgaccttgtctcctggtaccgacaacacccaggcaaacgcccccaaactcattattacggggtcaataagcggccctcagggctttctgatcgcttctctggctccaagtctggcaacacggcctccctgacaatctctggactccgaggccgaggacgaggctgatttttacngtttgttcattatgacaggaaggtagtgtattagtgttcgtttaggagtgggacctaggtcaccgttcttggtcacgcccaggcccaacccnctcgtctaccg

SEQ ID NO: 1039 - DNA, 615 bp, Homo sapiens
  misc_feature: GYAE6OF02JW2MD.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctcgagggaaatacgcaaccctctcctgcagggccagtcagagtgtagcagcagcttacgccgtggtaccagacagaacgcctggccaggcctcccgaggtcctcctcactctagactgtatcgaggacggaccactagactacgtcccgaagcgtaggtacgaggtacggacgtagggtcgggtcgtagggactagtacttcgactcctacacctagtccgaacgcgaacggtaccgtacgggaacctagggtaacttaccgtttagaccttacctttttagttccgttacgtaccgttaaccgtagtttacgtagggttaacgtcctaaccggttacttaccggtttcggacccggagggtaacccaggttccgtaggacggtatacgaacggtccggtaatcggg

SEQ ID NO: 1040 - DNA, 645 bp, Homo sapiens
  misc_feature: GYAE6OF02IPY3G.13.36.D03.1.454.CMB.1.raw
  modified_base (244)..(244): a, c, t, g, unknown or other
  misc_feature (244)..(244): n is a, c, g, or t
  modified_base (271)..(271): a, c, t, g, unknown or other
  misc_feature (271)..(271): n is a, c, g, or t
  modified_base (456)..(456): a, c, t, g, unknown or other
  misc_feature (456)..(456): n is a, c, g, or t
tcagtcacgtactacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatcacatctctgcactggaaatgcagtgatgttggacttangtaccttgtcctctggtaccgacaacncccaggccaaaacgcccccaaaatcaatttacgtttacggggtacaaataacgcggccctcgagggtcctttgtgactcgctttctctggctccgaagtctaggtccaacgaccggccctccctgactaactctcgtcggacctccgacggtccgacggacgaggtcgttagttattttttaacngttttgtaccaagttacgtcgacggtaagggtaacggtgttacgttaatttagtcggttacgtttagggaacggttcggggtaaaccctaagggttcccgtaaccgggtttcccgttagggttaccctaaccgggtaccccgtaacggtacccccaaaccccgtacgttacggtaccccgttaacccgg

SEQ ID NO: 1041 - DNA, 578 bp, Homo sapiens
  misc_feature: GYAE6OF02GLMBK.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacgaggctcctggacaagggcttgagtggatgggatggatcgacatacaacacgtcgggaacccaacgtatcgcccgagggtcttcacgaggtacgtttgtcttctccttcggactacctctgtcagcacggtctatcgtacagatcagcagacctaaggctagagtacactcgacctattttagtactgttagagtacgagttattttccgtttctggtaaccgttacggtttaccttcgttacgttccgttaggttacccgttacggtccggggaccgtaacgggttaaccccg

SEQ ID NO: 1042 - DNA, 568 bp, Homo sapiens
  misc_feature: GYAE6OF02FZ2RH.13.36.D03.1.454.CMB.1.raw
  modified_base (398)..(398): a, c, t, g, unknown or other
  misc_feature (398)..(398): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtcgcctgcgagggcctcgtggttacattttcgactaacttttggcatctactgggtgcgacgaggccccctggccacggccttgagtcgcgtggggtggatcgagttgttacaacgggttgacgacagactttgcacagtaagtttggagggcagagtcacctgaacccanacgacacgactcccgacgaaccacgagaccctaacactcggaaactggaaggaatcgtagaccatctagacgacgaccggaccaatatattactgtgacgagagggttagggtttgggcgtcggtactccgtcgttgagtcgttcggtcggggcacggggacagttacgg

SEQ ID NO: 1043 - DNA, 577 bp, Homo sapiens
  misc_feature: GYAE6OF02GGK5M.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttggagtggatgggatgggatcgacatcaacgacgtagggaaccctaacgtatcgacccgagggcttcacgaggacgtttgtcttcgtcttggactcctctgtcagctacggcgtatcgtacagtatcgagcacgacctaaaggctagacggacacgtcgcctaatttacttacgtgtagtagtagacgttatttcctttcgttcgtacttacggttcctttacgttcgttccttacggtaccgttacggtcggggtacccgtagggtaccccgg

SEQ ID NO: 1044 - DNA, 527 bp, Homo sapiens
  misc_feature: GYAE6OF02FKIKN.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccagggggaaatagcaaccctctcctgcagggccagtcagagtgttagcagcagcttagcctggtaccagcagaagcctggccaggctcccaggctcctcatttatggtgcatcccactagggccactggtgtcccagtccaggttcagcggcagtgggtctgggacagacttcactctcaccatcagcagcctgcagtctgaacgtattttgactagtcttaattacttgtcagtctagtaatagttactggtaagtaaccgttccgggaccgtaacgggacacggacgtaggaaggaacgttaaagggactacggg

SEQ ID NO: 1045 - DNA, 536 bp, Homo sapiens
  misc_feature: GYAE6OF02IZOEA.13.36.D03.1.454.CMB.1.raw
  modified_base (388)..(388): a, c, t, g, unknown or other
  misc_feature (388)..(388): n is a, c, g, or t
  modified_base (408)..(408): a, c, t, g, unknown or other
  misc_feature (408)..(408): n is a, c, g, or t
tcagtcacgtactacacgaccggtgctcgatttagctgcgtcacgatctctcttgggggggtcagagctctggggaggaactgctcagttaggacccagacggaaccatggaagcccccagcgcagcttctcttcctcctgctactctggctcccagatactactggagaaatagtgctgacgcagtctccagtcaccctgtctgtgtctccaggggaaatgcaaccctctcctgcagggccaagtcagagtgttagcagcagctagcctggtacagcagaagctggccaggctcccaggctcctctaatttatggtgcactccactacgggcccatggtcgtcccagtctaggttcaggcggcgagtgggtcagggacagtacttcnctctcaccatcagcagtccngcagtctagaagtatttgactagtactattactgttcagtcgtagttacttagttactaggacgtaaccgttccgggaaccgaaggtacctacggacgtagggaacgtaagttaaagggacttacggg

SEQ ID NO: 1046 - DNA, 726 bp, Homo sapiens
  misc_feature: GYAE6OF02IT5ZL.13.36.D03.1.454.CMB.1.raw
  modified_base (219)..(219): a, c, t, g, unknown or other
  misc_feature (219)..(219): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctcgccctgactcagcctgcctccatgtctgggtctccgtggacagtcgatcaccatctccngcactggaatagcagtgatgttgggacttatcggtaccttgtctctcggtaccgacaaccacccgaacggacaaccgacccccaaactctaactttacgtttaaccggggtcaaacgtaacgccggccctcgtacggggtctttacgtgactcgtctttcgtcgtcgtctaccgtaagttcgtcggaccaacgtacccggtcccttacccgtgaacctaacgttcctaccgtcggaaccctacccggagggtacccgaacgggaacgtaccgggtcttaggtttacttttttaccgtaggttttcgtttaccgagtttacgtcggacggtaacgggtaaggggtagttaggttaacttaggtttacggtttaccgttttaaggggaacggttacggggaaaccgttacgggtaacccgttacccggttccggtttacggtccgtaacccggtacccgttaaaccggggaccccctaaccccgtacgtttaccgtacccgttaacccg

SEQ ID NO: 1047 - DNA, 677 bp, Homo sapiens
  misc_feature: GYAE6OF02JUSMA.13.36.D03.1.454.CMB.1.raw
  modified_base (203)..(203): a, c, t, g, unknown or other
  misc_feature (203)..(203): n is a, c, g, or t
  modified_base (214)..(214): a, c, t, g, unknown or other
  misc_feature (214)..(214): n is a, c, g, or t
  modified_base (217)..(217): a, c, t, g, unknown or other
  misc_feature (217)..(217): n is a, c, g, or t
tcagtcacgtactacacgaccggtgctcgatttagctgcgtcacgatcgtctcttgggggggtcacaagaggcagcgctctcgggacgtctccaccatggcctggctctgctgctcctcactctcctcactcaggcacagggtcctgggccctagtctgcccttgactcgagcctgccctccgatgtctgggtctcgtggacngtcgatcaccntcncctgcactggaaatgcagtgatgttggacttatcgtaccttgtcttccgtggtaccgacaacacccgtagaccgaaccgcccccaaactcaagtttacgttaccggggtacaagtaacggccggtccctcgtaaggtctttctggactcgtcttctcgtacggtcctaccgtaagtccgaggaccaacgtccggcccttaccgtgaacctaacttccgtccgtacggtacccttacgacgggaccgtacgggaacgacgggtccttaggttacttttttaccgaggttttactacttaagttcgtaggaccgtagggtaaacggtagttcgggtaatttcgttacggtaacttttaggggaaaccgttgggtaaaccgttacgggtccttaaccgggttcgtttaggaccctacggtacccgaacggtaccccgtaaccgacgttccgttcctaacccgg

SEQ ID NO: 1048 - DNA, 634 bp, Homo sapiens
  misc_feature: GYAE6OF02IGBIO.13.36.D03.1.454.CMB.1.raw
  modified_base (311)..(311): a, c, t, g, unknown or other
  misc_feature (311)..(311): n is a, c, g, or t
  modified_base (372)..(372): a, c, t, g, unknown or other
  misc_feature (372)..(372): n is a, c, g, or t
tcagtcacgtactacacgaccggtgctcgatttagctgcgtcacgatctctcttgggggggtcagagctcgtggggaggaactgctcagttaggacccagacggaaccatggaagcccagcgcagcttctcttcctcctgctactctggcctcccagatactactggagaaatagtgctgacgcagtctccagtcaccctgtctgtgtctccgaagggaaatacgaccaacccttctccgtgcgagggccagtcagagtcgttagcagcagcttagcctggtaccagcagaagcctggccaggcctcccgnggacctccgtacctatttagtggtcgacctatcccaacgtagggccctaacgtcgggttcncccgtagtcgtaggttcaaggcggctaggtgggtcgtagggacgaggtacgttcacttctacacctattaccacggacaacgcccgtgacgtacgttacgtaggtaacgttagtttttcgacgtacggttaccttaagtttaccgttgtacgtaagtctaagttattagttacgtaggtaacgtaaccgtttcggaaccgtaacgggaaccgtaaccggtacggttaaggtaacggttaaaagttaacggaaagttaccggg

SEQ ID NO: 1049 - DNA, 745 bp, Homo sapiens
  misc_feature: GYAE6OF02I1LUZ.13.36.D03.1.454.CMB.1.raw
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcatgtctgggtctcctggacagtcgatccaccatcctcctgcactaggaaatgcagtgatgttggacttatgaccttgtctcctcggtaccacacaccagacaacgaccccaactctagttacgtttacggggtacaacgtaacgccggccctcgacggggtctttcgtcgtactcgtctttctcgtggtactccgaacgttcgtacggaccgtaaccgacccgggtccccttaccccgtacggtaacctaacttccgtaccgttacgggtacccttaccggaacggggtacccgggaacggggtaaccgggaacgggtaccgtttacggtttaaacgttttttttaccggttcggtttttaacggtttaaccgttaagttaacgttcgggtaccgggtaaaggggttaaacgggtaaggtttaacggtaagttttaacgttcggtttacgtttagggtaacgggtacgggtaacccgttaacgggtccgtacccggttacggtttcggtaccgtaccggaccccgtaacggaccccgtaacccgtacgttaccggtaccttacccg

SEQ ID NO: 1050 - DNA, 539 bp, Homo sapiens
  misc_feature: GYAE6OF02GKS4P.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaagtatgcccagggcttcacgaggtacggtttgtcttctccgttggactacctctgtcagtcacgggctatgtacagatcagcagcctaaaggctagaggacactgcctatttacttactgtgtgagtatatttcttacgtgtaccttacggttacttcttcgttcttcgacttacgtcggggtaccagggtacccg

SEQ ID NO: 1051 - DNA, 543 bp, Homo sapiens
  misc_feature: GYAE6OF02FRB9Y.13.36.D03.1.454.CMB.1.raw
  modified_base (413)..(413): a, c, t, g, unknown or other
  misc_feature (413)..(413): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatggggatggatcgacagtcaacactgggaacccaacgtatggcccaggggccttcacgaggacggtttgtcgttctccttggacctactctgtcagcacggngtatgtacagatcagcagcctaaaggcctgaggacacgtgacctatttattactgtgtgagatattctttccttgacttacggtctttcgtgttccttgtaccttacggtcgggacctagggtaaccccg

SEQ ID NO: 1052 - DNA, 646 bp, Homo sapiens
  misc_feature: GYAE6OF02JAJRX.13.36.D03.1.454.CMB.1.raw
  modified_base (219)..(219): a, c, t, g, unknown or other
  misc_feature (219)..(219): n is a, c, g, or t
  modified_base (255)..(255): a, c, t, g, unknown or other
  misc_feature (255)..(255): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatgtgctgacgcagtctcagtcacctgtctgtcgtctccgaaggggaancgccaccctctcctgcagggccagtcagacagttancaacacgtagcctggaccagcagaacgtggccaggcctacccgaggcctcccgtacacttcctagttcgggtcgactaacgtccccgaacggacgggccctaacgttcgggtaacctccccgaaggtacccgggtttgacggtcggctagggtcgggttcgtaggggaactacgtaccgttctacctcctaccacccatcgacgactacgtcgtacgcgtagtctacgtaacgttatttcgacttagttttacgttacgttcgtacgacgtacgttaagttaattaacgtaacgtcgtacctaccgtactacgttacgttacgttacggtttaccggaccggtacggggtaaccctaacgggtcggtaacgtacttaccggaggttaaccg

SEQ ID NO: 1053 - DNA, 569 bp, Homo sapiens
  misc_feature: GYAE6OF02H1UCN.13.36.D03.1.454.CMB.1.raw
  modified_base (416)..(416): a, c, t, g, unknown or other
  misc_feature (416)..(416): n is a, c, g, or t
  modified_base (424)..(424): a, c, t, g, unknown or other
  misc_feature (424)..(424): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaagttgggtgcgacgaggcctccgtaggacaaggggtcttaggaggtggagtgggatggatcgacatcaacacgtaggaaccacgtatcgccgaggtcttacgacgtaggtacggtttgtcttctccgttggactacctctgtcngcgacggngtagtgtacagatcgagcacgaccgtaaagctaggagacacgtcgacctatttacttactggtagtgagtagtatttctttcgttacgtacgttacggttcttcgtcgttccttagtaccttacggtcgggaccgtaggtacccg

SEQ ID NO: 1054 - DNA, 579 bp, Homo sapiens
  misc_feature: GYAE6OF02HSJPU.13.36.D03.1.454.CMB.1.raw
  modified_base (264)..(264): a, c, t, g, unknown or other
  misc_feature (264)..(264): n is a, c, g, or t
  modified_base (485)..(485): a, c, t, g, unknown or other
  misc_feature (485)..(485): n is a, c, g, or t
tcagtcacgtactacacgaccggtgctcgatttagctgcgtcacgatctctcttgggggggagaggagcccagcactgggattccgaggtatttccattcggtgatcagcactgaacacagaggactcaccatggagttttggctgagcgtggttttcctattaacgtattttaaaaggtgtccagtgtgaggtgcagttggtggagtctggaggaggcttggtccaggccggggggtcccgtgagactctcatgtgcggcctntgggctcaccgtcaacaccaactacatgagctggtccgccaggctccagggagaggccggagtgggtctcagttatttatgtcgacggtgccacgattctacgcagactccgtggacggggccggttcaccatctccagagacaaattccaaacgaacacggtagtatacgttacaaattgaacgacctagagagtcgaggacacggccgtactatacgtntggacgaaagatagcgagaggacgggacccccgtaaggtcggggccgtgggtacgggtacgggtttccgtttcggtttacgtcgtaggtccggg

SEQ ID NO: 1055 - DNA, 606 bp, Homo sapiens
  misc_feature: GYAE6OF02H3TRS.13.36.D03.1.454.CMB.1.raw
  modified_base (195)..(195): a, c, t, g, unknown or other
  misc_feature (195)..(195): n is a, c, g, or t
  modified_base (211)..(211): a, c, t, g, unknown or other
  misc_feature (211)..(211): n is a, c, g, or t
  modified_base (271)..(271): a, c, t, g, unknown or other
  misc_feature (271)..(271): n is a, c, g, or t
  modified_base (339)..(339): a, c, t, g, unknown or other
  misc_feature (339)..(339): n is a, c, g, or t
  modified_base (366)..(366): a, c, t, g, unknown or other
  misc_feature (366)..(366): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
  modified_base (425)..(425): a, c, t, g, unknown or other
  misc_feature (425)..(425): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctccnggacagtcgatcaccntcctctgcactggaaatgcagtgattgttgggacttatgacctttgtctcctggtaccanaaccacccaggacaaacgcccccaaatcattagtttacgggtcaaataagccggcctcagggctttcngatcgcttctctgctcaagtctgcacncggcctccnacaatcnctgactcgaggccgaggacgaggtctgtactttttatggtttnttacattagtgacgtaaggaagggtattacggtattttaaggtgtttccgttttagggaacggttacggggtaaccaaagggtttcccgtacccggtttcccgtttagggtacccgtaacggtacccccgtaaaaccgggccccctaaaacccccgtcgttaccggtacccttaaccccgg

SEQ ID NO: 1056 - DNA, 538 bp, Homo sapiens
  misc_feature: GYAE6OF02FNVKY.13.36.D03.1.454.CMB.1.raw
  modified_base (423)..(423): a, c, t, g, unknown or other
  misc_feature (423)..(423): n is a, c, g, or t
  modified_base (447)..(447): a, c, t, g, unknown or other
  misc_feature (447)..(447): n is a, c, g, or t
  modified_base (466)..(466): a, c, t, g, unknown or other
  misc_feature (466)..(466): n is a, c, g, or t
  modified_base (469)..(469): a, c, t, g, unknown or other
  misc_feature (469)..(469): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgacaggctcctggacaagggcttgagtggatgggatggatcgacatcaacactgggaacccaacgtatcgcccagggcttcacaggacggtttgtcttctccgtttggacaccttctcgtcagccgacgggtctatcgtacngatcagcagcctaaggctgagacntgcctatttatactgtgtnagngtattcctttactgacttacggtactttcgttgtccctttgaccgttcgtggggtacccagggtacccc

SEQ ID NO: 1057 - DNA, 683 bp, Homo sapiens
  misc_feature: GYAE6OF02HK9TV.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagccaaccctctcctgcagggccagtcaggagtgttagcagcagcttagcctggtaccagcagagcctggccaggcctcccgaggtcctccctactacttttagcggtgccacgtccacgtacgggccctacgttcggtcgtacccgagtcgtagggttcacggcggacgtaggttgggtcgtaggggacacgtacttacgacctctaccaccactcgacgccacgtccgtagcctagtccgtagtaacgttagttttcgacgttacgttacttaacgtttaccgttacgttacgtacggtacgtaagtttaacgttacggtttaaccggttacggggtaaacccgttaaccccgggtttaccggggaacccccggttaaacgggggtacccgtaaacccggggttaacggttaacggggtaaacgttaaaacgggttttaaaccgggtaaccggttacgggg

SEQ ID NO: 1058 - DNA, 657 bp, Homo sapiens
  misc_feature: GYAE6OF02H60SD.13.36.D03.1.454.CMB.1.raw
  modified_base (264)..(264): a, c, t, g, unknown or other
  misc_feature (264)..(264): n is a, c, g, or t
  modified_base (333)..(333): a, c, t, g, unknown or other
  misc_feature (333)..(333): n is a, c, g, or t
  modified_base (386)..(386): a, c, t, g, unknown or other
  misc_feature (386)..(386): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttntgtctatgaattggggtgcgtacgaggctccgtaggacgagggtcttggagtggagtggatggatcganatacgaacacgtacggaaccaagtactcgccaggtctacacgtaggtcgtttntcttcttccgttgacctccgttctgtccaggtccacgggtcttagtacgtaacgagtactaccgagacacggtaccgtaaaggcgtacggaagtaccacgtcgtaccttattttaacgttacgtggttaggagtagtacgtttacttttaccgtttttaccggtaagttacccggtttaacggttccttttttccggtacggttttcccgtttaaggtaccccggtttacgggttccgggggtaacccccgtaacggggttaaccccccgg

SEQ ID NO: 1059 - DNA, 588 bp, Homo sapiens
  misc_feature: GYAE6OF02JKZ1U.13.36.D03.1.454.CMB.1.raw
  modified_base (276)..(276): a, c, t, g, unknown or other
  misc_feature (276)..(276): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatgcaaccctctcctgcagggccagtcagagtgttagcagcagtctagcctggtaccngcagaacgcctggccaggcctcccgaggcctcctcattttacgtggtcgcactccgacgttacgggccctacgtcgggttcgtcccctaaggtccgaagggtttccaggtccgggctagggtcggggtttcgacggggacgacggtaccttcgacgttcctccgacctactacgacgcacggtccgtcgctacgttctacgaagttcgtttgactacgttctacttactgtctagactagtattagttacgcggtaacgtaccgtacggacgaacggactacggacgtaggagtaacgttaaggtagtacgg

SEQ ID NO: 1060 - DNA, 609 bp, Homo sapiens
  misc_feature: GYAE6OF02GN3ES.13.36.D03.1.454.CMB.1.raw
tcagtcacgtactacacgaccggtgctcgatttagctgcgtcacgatctctcttgggggggtcacaagaggcagcgctctcgggacgtctccaccatggcctgggctctgctgctcctcactctcctcactcaggacacagggtcctgggcccagtctgccctgactcagcctgccctccatgtctgggtcctccgtggacagtcgatcaccatcctcctgcactaggaaatgcagtgatgttggacttatgtacttgtcctcgtcggtaccgacaaccaccgaggacaaaccgccccaaatcaattagttacgggtacaataagccgacctcgacggtctttcgtgtactcgtcttctcgtcgtcctactacgtctacgacaacgaccggtccctccgtacgactaactcgtcctacggtacctccgacggaccgaggaccgtaggcgttagtttatttttcgtgttacgttctatagtcgacgaagggtacgtagttgtaatttagtgtttacggttagtaggtacgggtacctaacgggtccgtaaccgttcgtacggtaccgtaccgacccgacggaacccctaacccgtcgtacgtacctaccg

SEQ ID NO: 1061 - DNA, 595 bp, Homo sapiens
  misc_feature: GYAE6OF02HQDPR.13.36.D03.1.454.CMB.1.raw
  modified_base (327)..(327): a, c, t, g, unknown or other
  misc_feature (327)..(327): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatagccaaccctctcctgcagggccagtcagagtgttagcagcagcttagcctggtaccagcagaacgcctggccaggcctcccgaggcctcctctatttagtgggtcncatccacgtacgggccctacgtggtcgtcccaagttccgaggttcaggcggacgtaggtgggtcgtagggactacggtacttcactctaccacctatacacgcgagccctgccgtagttcgtagtaagttatttcgacgttacgttacttaagtttacttcgtacgagtacctaagttacgttagttacgtacgggtaacgtaaccggttcgggaaccgaacgggactaacggacgtacggaagtaaggttaaacggtacgttacggg

SEQ ID NO: 1062 - DNA, 789 bp, Homo sapiens
  misc_feature: GYAE6OF02F8S9O.13.36.D03.1.454.CMB.1.raw
tcagtcacgtactacacgaccggtgctcgatttagctgcgtcacgatcgtctctggggggtcagagtctcgtgggagggaactcgctcacgttagggacccagacggaaccataggaagccccagcgcagcttctctctcctgctatctggctccaggactactactggagaatacgtgctggacgcagtctccaggtcacctggtcctaggtcgtcgtccacgggggtaaactacggccaaccctctcctacgacgaccgggacctacggttacctaccggtaggttcgttaccgcgacgtccaaggtccgttacgcccgttacgggtaacccgaggccaacgaacggtcccggtcggaccggacggtccgtccccgtagggtccttaccgtacttacgtttacgtcggtcgactacgtccgtacggtacgggcccgtacgttcgggtaccgtacccggacggtaccgtagggtttaccgacggtccggtcgtagggttcggggtcgttacggggaacctacggtaccgtttacgaccgttccgtaccgtaacctacgttaccgacggtccaggttacccttaggtacgttaccgtaaggtaaagtttacgtttttcgacgttaacggtttaccttaacgtttacgtacgttacgtaacggttacgtaacgtttacgttaggttacgtacgggtaacgttaacccggtttacggaacccgtaaacgggtaccgtaacggtaacggttcgggaaacggttaacgttaaaccgggtacgtagggttacgg

SEQ ID NO: 1063 - DNA, 723 bp, Homo sapiens
  misc_feature: GYAE6OF02IJHPG.13.36.D03.1.454.CMB.1.raw
  modified_base (345)..(345): a, c, t, g, unknown or other
  misc_feature (345)..(345): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcacttacttatgctatgtaagttgggtgcgtacgaggtccttccgtagggaccgaaggggtcttaggaggttggagtgggatggatcganagtacaacacgtacggaaccctacgtagtcgacccgtagggtcctttacgacgtacgggtacggtttcgtcctttccgttccgttaggaccctaccgttcgtgtaccgtagaccgacgggtcttaagtcgtacgagtactcgaacgctacgtaacccgttaaggcgtagggaacggtacctacgttacggtaccctttaagttttaaccgtttacgttagttaggtacgtaagtaggttacccttttttaccgttttacccgtaaggttttaacccgttaccgggtttttaacctttaccggtttccgttttacccggttagggttaaccctttacccggggttccgggggtaacccgtaccgggggtttaaccccgg

SEQ ID NO: 1064 - DNA, 663 bp, Homo sapiens
  misc_feature: GYAE6OF02JDT6R.13.36.D03.1.454.CMB.1.raw
  modified_base (545)..(545): a, c, t, g, unknown or other
  misc_feature (545)..(545): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctccgtggacagtcgatcaccattctcctgcacgtggaaatagacagtgattgttggacttatgtacttgtctccgtgtaccgacaacacccaggacaaacgaccccctaaactctaattacgtttaccgggtacaataaacggccggcctacgcgggtactttacgcgacgttcgacgtttctcctggtaccctactaagttctacgggtaaccaaccgtaccgggtccccttacccgttacgaaaccgtaactttcccgtacgttaccggtaacccgttcccggacgggtaccggacggtacgtcgtacgttacgtacggttaatttaccgtaacttcggcttacgtacctanacgttagttcgaaccgacgtacgacgtacctactacgttcgtacgttacgtacggggacgtacggttaaccgaacggttaccgaccgttaccgtagtaccgacgtcccgaagtcccgg

SEQ ID NO: 1065 - DNA, 615 bp, Homo sapiens
  misc_feature: GYAE6OF02G1LX6.13.36.D03.1.454.CMB.1.raw
  modified_base (374)..(374): a, c, t, g, unknown or other
  misc_feature (374)..(374): n is a, c, g, or t
  modified_base (462)..(462): a, c, t, g, unknown or other
  misc_feature (462)..(462): n is a, c, g, or t
tcagtcacgtactacacgaccggtgctcgatttagctgcgtcacgatctctcttggggacccaacaaccacacccctcctaagaagaacgcccctagaccacagctccacaccatggactggacctggaggatcctcttcttggtggcagcagcaacaggtgtcccactcccaggtgcaactggtgcaatcgtgggtctgagttgaagaaaccgtggggcctcagtgtaaggtttcctgcgaaggcgtctggatacgacgttcacttacttatgctatgtaagttgggtgcgtacgaggtcctccgtggacgaagggtcttggaggtggagtgggatggatcgacatacgaacacgtacggaaacccaacgtanacggaccgagggtcctacgacgaggttacggtttcgttccttctccgttcggacctaccttcgtcgtcgacgcgacggtcgtatcganagatacgacgaccacgtacgtaacgctaggacgactacgtcgtacttatttacttacgttgtacgtagagtagttactttctttacgtacgtagtttaccgttctttcgttcgttcttacgtaccgttacggtacgggtaccgtaggtacccg

SEQ ID NO: 1066 - DNA, 665 bp, Homo sapiens
  misc_feature: GYAE6OF02IU55T.13.36.D03.1.454.CMB.1.raw
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcatgtctggtctcctggacagtcgatcaccatcctcctgcactggaaatgcagtgatgttggacttatgtaccttgtctcctggtaccgacaacaccaggacaaacgccccaaactctattactttacggggtacaagtaacgccggccctcgacgggtctttcgtgtacttcgtcttcctcgtcggtctaccgaagtcgtcggaccaaccgtaccggccccttaccccgtacgtaacctaacgttcccttaccgtacggtaacccgtcccgaacgggacccggtaacgggaacggtacgggtccgttagtttaactttttacgttgtttacgttactaagttagtaggacgtaagggtaaggtagttagtatttacgtggtttacgttagggtaaggtacgggtaaccgtacgggttacctaccggttacgttggtaccgacgtacccgaacggtacccctaacccgtacgtaccgtccgtacccg

SEQ ID NO: 1067 - DNA, 748 bp, Homo sapiens
  misc_feature: GYAE6OF02I2XGJ.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgcccactcccaggtgcaactggtgcaatctgggtctgagttgaagaaacctggggcctcagtgaaggtttcctgcaaggcgtctggatacacgttcactacttatgctatgaattgggtgcgacaggctccgtggacaagggtcttgaggtggagtgggatggatcgacatacaacgacgtcgggaaacccctaacggtatcggaccccgagggtcctttacgaacgtagggttaccgggttttgttacctttccgttcccgtttacgggaaccctaccgttccgttacgtccgacggtccgaccgggtacgttacgtcgttaaccgacggtacttccgaacggtaccgaacgggtacccgtaaaacgggtccgtacgggaacgggaacctaccgtagtacccttaatttttaacgtttacgttaggttacggttacggaaggttacgttacgtttttccgttttacccgtttaacggttaacccgtttaaacggggtttaacccttttaccggtttcgttttacccgtttcggttaacccggttaccgggttaccgggggtacccggttaaccgggggtaaccccgg

SEQ ID NO: 1068 - DNA, 671 bp, Homo sapiens
  misc_feature: GYAE6OF02GPKKD.13.36.D03.1.454.CMB.1.raw
  modified_base (411)..(411): a, c, t, g, unknown or other
  misc_feature (411)..(411): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtgcgtacaggctccgtggacaagggcttgagtggatgggatggatcgacatcaacgacgtgggaaacccaacgtatcgacccgagggtcttacgacgaggtacggtttgtcctttcgtccttggactaccgtnttagtcagcgtacggcgttagtagtaccagactcgagtcgacggtacctaaagggtccgtaggaacggactaccgtcggaaccctttaagttttacgttaacgtttcgggtatagggtacggtacgttactttttcccgtttttaccgttacggttaacccgttttaacggggttaccttttaccgttacggttttacccctttgggttaaccccttttacggggtaccgggggtaccccgtaacgggggttaacccccg

SEQ ID NO: 1069 - DNA, 519 bp, Homo sapiens
  misc_feature: GYAE6OF02II998.13.36.D03.1.454.CMB.1.raw
  modified_base (226)..(226): a, c, t, g, unknown or other
  misc_feature (226)..(226): n is a, c, g, or t
  modified_base (304)..(304): a, c, t, g, unknown or other
  misc_feature (304)..(304): n is a, c, g, or t
  modified_base (416)..(416): a, c, t, g, unknown or other
  misc_feature (416)..(416): n is a, c, g, or t
tcagtcacgtactacacgaccggtgctcgatttagctgcgtcacgatctctcttggggggtcagagctctggggaggaactgctcagttaggacccagacggaaccatggaagcccagcgcagcttctcttcctcctgctactctggctcccagatactactggagaaatagtgctgacgcagtctccagtcaccctgtctgtgtctcaaggggaaatgcaacctnctgcaggccagtcagagtgtagcagcagcttagcctggtaccagcagaagcctgccaggctccagcctcgtcatttanggtgcactaccacgtaggccctatgggtactcccgagtccgaggtttcacgcggtgaggttcgggtcgtagggacagtacttcaactctacaccatcagcagctagcagtcngaacgtatttgacagtctaattactgcagcagtatagttaagtggaacgtaccttcgaccggaaggtacgaacggacttagggaataagttaaaggacttagg

SEQ ID NO: 1070 - DNA, 601 bp, Homo sapiens
  misc_feature: GYAE6OF02H0CR8.13.36.D03.1.454.CMB.1.raw
  modified_base (305)..(305): a, c, t, g, unknown or other
  misc_feature (305)..(305): n is a, c, g, or t
  modified_base (352)..(352): a, c, t, g, unknown or other
  misc_feature (352)..(352): n is a, c, g, or t
  modified_base (367)..(367): a, c, t, g, unknown or other
  misc_feature (367)..(367): n is a, c, g, or t
  modified_base (451)..(451): a, c, t, g, unknown or other
  misc_feature (451)..(451): n is a, c, g, or t
  modified_base (471)..(471): a, c, t, g, unknown or other
  misc_feature (471)..(471): n is a, c, g, or t
tcagtcacgtactacacgaccggtgctcgatttagctgcgtcacgatctctcttgggggggagaggagcccagcactgggattccgaggtatttccattcggtgatcagcactgaacacagaggactcaccatggagttttggctgagctgggttttccttattactattttaaaaggtgtccagtgtgaggtgcagttggtggagtctggaggaggcttggtccaggccgggggggtccctgagactctcatgtgcggcctcgtgggctcaccgtcaacaccaaactacaatgagctgggtccnccaggctccgaggggaagagggccggagtgggtctcagtttatttangtcgacggtgcccanatttctacgcagaactccgtggacggggtcccgttcacccatctaccagagaacaattaccaaagaacacgctacgtttcttanaaactgaaccagcctagganacggcgatacggacaaccgggtcgagttagttactggacgtcgaagagagtccggggacccaaccggtaacgttaacgtacgacctagttccgggaacttcgggtacggggtaccgaacgggtaacccgg

SEQ ID NO: 1071 - DNA, 725 bp, Homo sapiens
  misc_feature: GYAE6OF02IATZA.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagcccagcgcagcttctcttctcctgctactctggcctcccagatactactggagaaatagtgctgacgcagtctcagtcaccctgtctgtgtctcgaaggggaaatgaccaaccctctctgcgagggccagtcaggagtgttagcagcagtcttagccgttaggtaccagaccgaagaacgcccgtcggaccgaggtccctacccgaggcctccgttactagttttacgtcggttacgcctacgttcccgaacggttacgggaccctacggttcgggttccgtaccccgtagttaccgacgggtttacgacggccgggtcgtaagggttcggggtaccggttaacggggactaacggtttaccttaccgaccgtttacctaccgaacctacgtaccgacggcgtaccgtaccgtgaccgtaggttctaggtaaacttagtttcgacgttagtttactaacgtttccgttagtaccgtagtaacgttagttacgttaacggtttacggtacgggttaaccttaacccggttacggggtaacccgtaaacggggaccgtaaccgggtaaccggttaggtaaacgggtttaaacgttaaaccgggacgttacggg

SEQ ID NO: 1072 - DNA, 709 bp, Homo sapiens
  misc_feature: GYAE6OF02IHROT.13.36.D03.1.454.CMB.1.raw
  modified_base (370)..(370): a, c, t, g, unknown or other
  misc_feature (370)..(370): n is a, c, g, or t
tcagtcacgtactacacgaccggtgctcgatttagctgcgtcacgatctctcttggggacccaacaaccacacccctcctaagaagaagtccctagaccacagctccacaccatggactggacctggaggatcctcttcttggtggcagcagcaacaggtgtccactcccaggtgcaactggtgcaatcgtgggtctgagttgaagaaccgtggggcctcagtgtaaggtttcctgcaaggcgtcgtggatacacgttcacttacttatgctatagtaagtttggggtgcgacgaggtctccgtggaacgaaggggtcttggagtggagtgggatggatcgacatacaacgcgtacggaacctacgtacncgaccgaggtcttacgacgtacggttacggtttcgttcctttccgtccgttacgggaccctccgttcgtcgtaccgaacggtccgtaccggtcgttagtacggtaaccgagtacgtaccgaacgtaccgaacggtaccgtaaagggtcctaagggacggaccgtacgttcgtaaccttaagttttacgtaccgttggtacggttagtaacgttacgttacttttccgttttaccgttacgggttaaccgtttaccgggtttacctttaccgtttacggtttcccgttacggttaacccggttccgggtaccggggtaccccggttaacgggtaacccgg

SEQ ID NO: 1073 - DNA, 671 bp, Homo sapiens
  misc_feature: GYAE6OF02INDDE.13.36.D03.1.454.CMB.1.raw
  modified_base (279)..(279): a, c, t, g, unknown or other
  misc_feature (279)..(279): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaacctggggcctcagtgaaggttttcctgcaaggcgtctggatacacgttcactacttatgctatgaattgggngcgacaggctccgtgggacaagggtcttggagtgggagtggggatggatcggacatacaacacgtacgggaacccaagtatcgacccgagggtcctttacgacgacgggtacgtttgtctttcgtccgttcgggacctaccgttcgtcgtacagccgacgggtcttagtacgtacagtactacaggtcaacgacctaaacgggctagggaaggtacccacgttcgaccttaattttacgtacgttaggttcgtaagtaggttaacggttacgttttccttttccggtttaaggtaaccccgttacgggttttaccttacgttaccggttttacccttaggttaaccccgttagggtttacccggggtacccggtaaccggggttaaccccgg

SEQ ID NO: 1074 - DNA, 692 bp, Homo sapiens
  misc_feature: GYAE6OF02FSV47.13.36.D03.1.454.CMB.1.raw
  modified_base (330)..(330): a, c, t, g, unknown or other
  misc_feature (330)..(330): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaggggaaatacgcaaccctctcctgcagggccagtcagagtgtagcagcagcttagcctggtaccagtcagaagcctggaccagggtcctcccgaggtctcctactattttatgggtntcgtatcccgaacgtacggaccctacgtcgggtaccgtacccgaggttccgtaagggtttaccaacgggtccggtcggtaagggttcggggttacggtacgggggtacctaacgggtacctttacccgtaaccgttcccgtaaccgtaacccgtaagtcccgtaaacggtcccgaacggttcccgtacggtacctacgtaccgttaggacgttacgttttcgacgtcgttacgttaattaccgtagttaccagtactaagtacgttaggttaactcgggtaaacgttaccgttaccgggaaccggtaaagggtaacccgacggtaacgtagggaacgttaaagttaaaccgggattaacggg

SEQ ID NO: 1075 - DNA, 808 bp, Homo sapiens
  misc_feature: GYAE6OF02GLNJ1.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaaacaggtgtccactcccaggtgcaactggtgcaatctgggtctgagttgaagaaacctggggcctcagtgaaggtttcctgacaaggcgtctggatacacgttcactacttatgctatgaattgggtgcgacaggctccgtggaacaagggcttgagtggatgggatggatcgacatacaacgacgtacgggaacccctaaacggtagtccgacccgtaacggggtcctttacgaaccggtagggtaaccggggtttttgtaccgttttcccgttacccgtttacgggtaaccctaacccgttccgttcggttacccgtaacggtccgtaaccggggtccggttaaagttaccggttaaaccgaacggtaacgttaccgaaacgtcccgtaaacggtaccccgttaaaaacgggcttaacggggaaccggtaacctaccgttaccgggtaaccctttaaagtttttaacgtttaacccggttaggtttcgaagggttaaccggtaggtttaccgtttttccgtttttacccggtttaacggtaacccggttttaaacccgggtttacccttttacggtttaccggttacccgtttacgggtaaccgtttacccggggtaccggggtaccccggtaacccggggttaacccccgg

SEQ ID NO: 1076 - DNA, 830 bp, Homo sapiens
  misc_feature: GYAE6OF02FI1NA.13.36.D03.1.454.CMB.1.raw
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccatgtctgggtctcctggacagtcgatccacatctcctgcacgtaggaaatagcagtgattggttggggacttatcgtacctttgtcctccgtggtacccgacaaccacccgaggacaaaccgcccccaaactctaatttacgtttaccggggtacaaagttaacggccggtccccgtacgacggggttccttttcgtaggtacttccgtaccttttccgttaccgtacgggtacccttacccgtaaaggttccgtacggggaccctaaaacccggacccggggtcccccttaccccgtacggaacctaaacttccgtaccgttacgggtaacccttcccggaaccgggtacccggaaggggaacccgggtaaggtccggtttaagtttaaccgttttttttaccgtcggttttcgtttaacctatttaacgtcggtaacggtaaaggggtaaacgggttcggttaagtttaacgtttaagtttacgggtttacggtttaagggggtaaacgggttacggggtaaaccgtaacggggttaccccgtaaccccggtttccggtttacgggtaacccgtaaccgggtaacccccgtaaacccggggaaccccccttaacccccgtacggttacccggtacccgttaaccccgg

SEQ ID NO: 1077 - DNA, 592 bp, Homo sapiens
  misc_feature: GYAE6OF02HFGZ4.13.36.D03.1.454.CMB.1.raw
  modified_base (229)..(229): a, c, t, g, unknown or other
  misc_feature (229)..(229): n is a, c, g, or t
  modified_base (308)..(308): a, c, t, g, unknown or other
  misc_feature (308)..(308): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctccgtgtctgggtctctggacagtcgatcaccatctcctgcactcggaaacngcagtgatcgttgggacttatgacttgtctcctgtaccaacaccacccagtcaacggccccagacgtcatctatttagnggggcaagtacggcggccgtgagggtacttccactcgtctcttcgtgccttcgaagttcgtagacgaaccaccggcccttacccgtgaacctaacttcctcggttacgtaccgtccaggtcctaggacggtacgacggctcgtacctacgttctgtcgtgtacctctatcgtgacgttcgttcttgttcggttcgttccgtgggtaccgggtacgggtaacctaaggtccgtaacccgttcgtaccgggtctaccggacccgtacggtccgtcccgtaccccgg

SEQ ID NO: 1078 - DNA, 704 bp, Homo sapiens
  misc_feature: GYAE6OF02IEB6Y.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgtaacggtttcctgcgaaggcgtctggatacacgttcacttacttatgctatgtaagttgggtgcgacgtaggcctccgtaggacgaagggtcttggaggttgggaagtggggtagtggtatacgacgagtaccaaacgtacggttacgggaaaccctaaacggtactcggcccgagggtcttaccgacgacgggttacggttttgttcctttccgttccgttacgggaccctaccgtttcgtcgtccacggaccgacgggtcgttagtacggtaacgacgttacgtacgtacgaccaacggtacctaaacggggtctagggacggtaacacgtcgtaccttaagttttacttacgttggtaggtagagtagttactttccgttttacgtcggttaaccgtttacccggttactttccgtcggttttaccgtttacggtaaccgttaccgggttacggggtaccccgtacgggtacccccgg

SEQ ID NO: 1079 - DNA, 543 bp, Homo sapiens
  misc_feature: GYAE6OF02G4IW1.13.36.D03.1.454.CMB.1.raw
  modified_base (283)..(283): a, c, t, g, unknown or other
  misc_feature (283)..(283): n is a, c, g, or t
  modified_base (319)..(319): a, c, t, g, unknown or other
  misc_feature (319)..(319): n is a, c, g, or t
  modified_base (358)..(358): a, c, t, g, unknown or other
  misc_feature (358)..(358): n is a, c, g, or t
  modified_base (374)..(374): a, c, t, g, unknown or other
  misc_feature (374)..(374): n is a, c, g, or t
  modified_base (411)..(411): a, c, t, g, unknown or other
  misc_feature (411)..(411): n is a, c, g, or t
  modified_base (450)..(450): a, c, t, g, unknown or other
  misc_feature (450)..(450): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtcgtctccgaggggaaatggcaaccctctccgtgcgacgggccagtcagtagtgttagcagcagcttagcctggtaccngcagaacgccgtggccaggcctcccgaggcctcctntaactttgcggtgactactccacgtacggccagtggtcnccagtcaggtcagcgntaggtggtcgtggacagtctcactcacacatcacgcncgtctgctgtacagtagtgttgctagtcttacttacgtntacgacgtgagttagtagttacgtaggtaacctaccggttacgacggtaacggtacacggtacgaggtaacgtaacgttaacggacttacggg

SEQ ID NO: 1080 - DNA, 602 bp, Homo sapiens
  misc_feature: GYAE6OF02HYMGG.13.36.D03.1.454.CMB.1.raw
  modified_base (320)..(320): a, c, t, g, unknown or other
  misc_feature (320)..(320): n is a, c, g, or t
tcagtcacgtactacacgaccggtgctcgatttagctgcgtcacgatctctcttggggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccgaaggggaaatacgaccaaccctctcctgcagggccagtcagagtgttagcagcagctagcctggtaccagcaggaacgcctggccgaggcctcccgaggcctccctnatttagtggtgcactccgacgtacggccagtggtcgccagtcgaggttcaggcggacaggtcgggtctagggacacgtaccttacgaccttctaccacctactcgacgcaacgtccgtgcctacgtctagtaagttatttcgacgtagtttacttatttactgttaccagtacgttacgttagttacggttacgtagggtaaccgtaacccggttaccgggaaccgaaagggtcctaacggtaacggtagggtaaagtaacggtttaaacggagttaacggg

SEQ ID NO: 1081 - DNA, 743 bp, Homo sapiens
  misc_feature: GYAE6OF02I1WOM.13.36.D03.1.454.CMB.1.raw
  modified_base (439)..(439): a, c, t, g, unknown or other
  misc_feature (439)..(439): n is a, c, g, or t
tcagtcacgtactacacgaccggtgctcgatttagctgcgtcacgatctctcgttgggggggtcagagctcgtggggaggaactgctcagttaggacccagacggaaccatggaacgccccagcgcagcttctcttcctcctgctactctggctcccagatactactggaagaaatagtgctgacgcagtctcagtccacctgtctgtcgtctcgagggaaatcgccaacctcgtcctgcgagggtccagtcagtacgtgttagcgagcgagtctacgcctggtaccagacagaacgcgtcggccgacggtcctaccgacggtcctccgttaccgtaagtttacgtcgggtacgtacctacgtacccgacggtacggtacctacggtttcgggtccgttaacccggtgtacgtacggttaccgacgccggggttaacgngggttacgggtcggtacgggaacgttaccggtactttaaccgacgttccgtaccgtaactaaacggttccgaacgaccgttaacggacccgttctaccggtcggttacttacggtaacgtttacgttttacggaccttaacggttctttaaacgttcgttaacgttacgcgttaacgaggtttaacttacgggttaacgttacggtaaacccggttaccgttacgggaaacccgttaagggtaacccttaacgggtaccgttaagggtaaccggtttaaaacgttaacgggtacccgttagggg

SEQ ID NO: 1082 - DNA, 587 bp, Homo sapiens
  misc_feature: GYAE6OF02F0J5J.13.36.D03.1.454.CMB.1.raw
  modified_base (336)..(336): a, c, t, g, unknown or other
  misc_feature (336)..(336): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgcctcatgtctgggtctctggacagtcatcaccatctcctgcatggaaatgcagtgatgttggacttatgtaccttgtctcctggtaccgacaacacccagacaaacgccccaaactcattagttacgggtacaagtaacgcggccctcgacggtctttcgngtactcgcttctctggctacagtcgtgacaccgacgtccctcctgactaatctcgtaggtcctaccgacggccgaggacgacggtcttagttactttttcgtgtttcgtactattagtcgacgtagggaagtagtgtattagtcggttacgtttagggaaggttcgggaacgtaccgggttcctaccggtttcgttacggtcgtaaccggtaccgaacggtacccctaacccgtcgttacgtacctacccg

SEQ ID NO: 1083 - DNA, 762 bp, Homo sapiens
  misc_feature: GYAE6OF02H3T9T.13.36.D03.1.454.CMB.1.raw
  modified_base (306)..(306): a, c, t, g, unknown or other
  misc_feature (306)..(306): n is a, c, g, or t
  modified_base (677)..(677): a, c, t, g, unknown or other
  misc_feature (677)..(677): n is a, c, g, or t
tcagtcacgtactacacgaccggtgctcgatttagctgcgtcacgatctctcttggggacccaacaaccacacccctcctaagaagaagcccctagaccacagctcccacaccatggactggacctggaggatcctcttcttggtggcagcagcaacaggtgtccactcccaggtgcaactggtgcaatcgtgggtctgagttgaacggaaaccgtggggcctacgagtagtaaggtttccgtgacgaaggtcgtcgtaggacttacacgttacctacgtacttatcgtctatagtaagttgggtnacggtacacggtccgttcgtaggacgtagggtcttagtaggtaggacggttgggagtacggtcgttacgaactaataccaaaccgtaccgggtaaccgggaaacctaaacgttcgtaccggacccgtagggttaccctacgaacggtaacgggtttccggtttacgttcccgtttacgttacccggttacgtaacccgttacctcgttcggtacccgtaaggtaccgaccgggttagtacgttagtacgtaacgagttaaccgaggtaccgtaaacggtacccgttaaaggcgtaagggaacgttacccgagttaccgtaccgttaattttaaccgtacgttcggttaggtaacgtagggttaaccctttnttttccgtttaacgtcgttaacggtacgtttccgttactcgttcgttacgtcgtttaacgggccgggtacgtaacccggtaccgg

SEQ ID NO: 1084 - DNA, 752 bp, Homo sapiens
  misc_feature: GYAE6OF02H6OU1.13.36.D03.1.454.CMB.1.raw
  modified_base (109)..(109): a, c, t, g, unknown or other
  misc_feature (109)..(109): n is a, c, g, or t
  modified_base (627)..(627): a, c, t, g, unknown or other
  misc_feature (627)..(627): n is a, c, g, or t
  modified_base (635)..(635): a, c, t, g, unknown or other
  misc_feature (635)..(635): n is a, c, g, or t
tcagtcacgtactacacgaccggtgctcgatttagctgcgtcacgatctctcttgggggggtcagagctcgtggggaggaactgctcagttaggacccagacggaaccntaggaacgccccagcgcagcttctcttctctgctactctgctcccagatactactggaagaaatgtgctgacgcagtctccagtccacctgtctgtcgtctaccggaaggggaaatcgaccaaccctcgtcctacgcgacgggcctagtcaaggtagtgttacgcacggcacggttcttaacgccggtttacgaccgacgacgaacgaaccggtcccgtcggaccgaccgggtcctaccccggaggtccctaccgttacctaaggtttttacgcggtcgactaccgtaccgacggtaccggtacccgtacggttcggttaacccgcccgtaggtttaccgtaacggttcgaacggttcggacggtagggtccgggttaacggtcgggagtaacgtcccgtttaccaccttacccgacctacactcgaacgccgtacgttccgacgtacggttacccgtacgttaagggtcttttaacgttcgtaccctagttttaccttaacggttcgttaccgttanacggtttntaacggttaacgtttacgtacggttaccgggaaacggtttcccccgttaggaaaccggtaaccgggacgtaacccggcgttaaagggtaatttaaaccggttaaagggccgttaggg

SEQ ID NO: 1085 - DNA, 820 bp, Homo sapiens
  misc_feature: GYAE6OF02IEYUS.13.36.D03.1.454.CMB.1.raw
  modified_base (369)..(369): a, c, t, g, unknown or other
  misc_feature (369)..(369): n is a, c, g, or t
tcagtcacgtactacacgaccggtgctcgatttagctgcgtcacgatctctcgttgggggggagaggagcccagcactgggattccgaggtatttccattcggtgaatcagcactgaacacagaggactcaccatgggagttttggctggagcgttcgggttttccttattactattttaaaagggtgtccagtggtgaggtgctaggttggtggagtctgggacggaggtctttggtcccgaggcccggggggggttccctggagtacctcgtcagtgtcgcggccgtcgtgggctccaccgtcaacaccgaactacatgacgcgtcgggccgcaggcctcggaagggaagacggccggagtcgggtntcgtaggtttattagtgtcggtacggcgaccctacgtactttccgacgctacgtacgtcccggtagggaccgggggttcccggtttaccaaccgtacgttacccgtacccgaaacggtaccgaaaccgttaaaccctttacccgaaaacggtaacccggttaccgggtttacggttaaccgtttaacccggtttaactaaaaccgttaccgggtaaaaccgttacccggtagggtaaacggtaccgggttaccggaaaccggggttacccgacccggggttacccgtttaccgttaagtttaccgtaacggggttaccgtaaacggaaagttcttaacgggacgtaaccggtacgggtacccgggtaacccccggttagggttaccgggtccggttaggggtcgggtttaacgggtttcctttacgggtacggtaccggtggtacccgggg

SEQ ID NO: 1086 - DNA, 594 bp, Homo sapiens
  misc_feature: GYAE6OF02FONOM.13.36.D03.1.454.CMB.1.raw
  modified_base (211)..(211): a, c, t, g, unknown or other
  misc_feature (211)..(211): n is a, c, g, or t
  modified_base (392)..(392): a, c, t, g, unknown or other
  misc_feature (392)..(392): n is a, c, g, or t
  modified_base (395)..(395): a, c, t, g, unknown or other
  misc_feature (395)..(395): n is a, c, g, or t
  modified_base (400)..(400): a, c, t, g, unknown or other
  misc_feature (400)..(400): n is a, c, g, or t
  modified_base (414)..(414): a, c, t, g, unknown or other
  misc_feature (414)..(414): n is a, c, g, or t
  modified_base (429)..(429): a, c, t, g, unknown or other
  misc_feature (429)..(429): n is a, c, g, or t
  modified_base (441)..(441): a, c, t, g, unknown or other
  misc_feature (441)..(441): n is a, c, g, or t
  modified_base (475)..(475): a, c, t, g, unknown or other
  misc_feature (475)..(475): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctggcccagtctgcccctgactcagcctgccctcatgtctgggtctctggacagtcgatccaccntcctcctgcactggaaatgcaagtgacgtgttgggacttatggtactgttcctcctaggtaccgacaccgacccaggcaaacgcccccaaactactattagttacggggttacaataacggccgtccctcgtacgggtctttcgtcgatcgcttctcttggctcagctgcaacgaccgccnccngacanctcaggactaccgngccgaggcgacggtntgattttttcgngttgttactatagtgagtacggaaagtgacgttntaaagttgttcggtttaggtaacggttacgggaaccgaacggttcaacccggttctttccggttagaacccggtaccgtaccggaaccccgtaacccctaaccggtgttaccccttacg

SEQ ID NO: 1087 - DNA, 642 bp, Homo sapiens
  misc_feature: GYAE6OF02FT4XB.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcgagtgaaggtttcctgcaaggcgtctggatacacgttcactacttatgctatgtaagttgggtgcgacgaggctccgtggacgaagggtcttggaggtggagtgggatggatcgacatcaactacgtacgggaacccagtatcgccgacggcttcgacgaggtacgtttgtacttcctccgttcggacctaccttcgtcgtacaggtccacgggtacgtattcgtaacagtactcgagaccaacggtaccgtaaaggtctaggaaccggtaactacggtcgtaccttaagttttacgtagttggtacgtaggacgttagtttcttttccgttacgttcggtaaccgtttccggttactttcgttcggttacccttttacggaacccggttacgggtacggggtaccccgaaggggttaccccg

SEQ ID NO: 1088 - DNA, 759 bp, Homo sapiens
  misc_feature: GYAE6OF02H2EO9.13.36.D03.1.454.CMB.1.raw
  modified_base (231)..(231): a, c, t, g, unknown or other
  misc_feature (231)..(231): n is a, c, g, or t
  modified_base (352)..(352): a, c, t, g, unknown or other
  misc_feature (352)..(352): n is a, c, g, or t
tcagtcacgtactacacgaccggtgctcgattttagctgcgtcacgatctctcttgggggggtcagagctctggggaggaactgctcagttaggacccagacggaaccatggaagccccagcgcagcttctcttctcctgctactctggctcccagatactactggaagtaaattgtgttagacgcagtctccaggctacccctgtcttttgtcctaccgaagggggaaanacgcccaccccgtcctcctgcgacgggccagtcagtagtgttagcgagcagtactacgtttacgccgtagtaccgagacgtaagaaacccggtcgacctacggcctacccgagtactcctntacttcgttagtcggtcactactccgagacgacggtcccacgtacgtcaacctcctaacgtacgtacggttacgaggtcgacgtacgggttcgggttaccggtggacgtacgtacttacctaccgttaccaccgtaaccatacccgaagtaccgacgtacgttacgaaccgtaccgtaaggtacgtttagtttaccggtagtacggtttagtttaacggttaccgtttacgttaacggtacgttaacgttaacgttagttaccgggttaccgtaccgttaaccggttaccccgggtttaccgggttaacccggttacccggtaaccccgggttaaaccggggtaaaccgggttaaccgggttaaacgggttaaaaacccgtaccgggttaaaaccggttaacccggg

SEQ ID NO: 1089 - DNA, 639 bp, Homo sapiens
  misc_feature: GYAE6OF02IY319.13.36.D03.1.454.CMB.1.raw
  modified_base (218)..(218): a, c, t, g, unknown or other
  misc_feature (218)..(218): n is a, c, g, or t
  modified_base (489)..(489): a, c, t, g, unknown or other
  misc_feature (489)..(489): n is a, c, g, or t
  modified_base (551)..(551): a, c, t, g, unknown or other
  misc_feature (551)..(551): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaccgtgggcctnagtgaaggtttcctgcgaaggcgtactggactacacgttcacttacttatgtctatgtaagttgggtgcgacgaggtcctccgagggtacgtaagggcttgaggtcggagtggggagtgggattaccgactagtaccgaacacggtacgggaacccaacgtagtcggacccgagggtccttacgaacgacggttacgtttgtcctttccgtcgttacggccacctcgtcgtacgacgtcgacggttcgtagtgttaaccagtactacgtanccgacgtaaccgtaagcgaggaacgataccgtagtaccttaagtttacttagtgtagagtanagttcttttacgtcgttacgtaccgtttacgttccgtttacgttcgttccgttagtacccgttaggtccgggaccctaacggtacccg

SEQ ID NO: 1090 - DNA, 765 bp, Homo sapiens
  misc_feature: GYAE6OF02HS5C5.13.36.D03.1.454.CMB.1.raw
tcagtcacgtactacacgaccggtgctcgatttagctgcgtcacgatctctcttggggacccaacaaccacacccctcctaagaagaacgccctagaccacagctccacaccatggactggacctggaggatcctcttcttggtggcagcagcaacaggtgtccactcccaggtgcaactggtgcaatcgtgggtctgaggttagaaggaaaccgtggggcctacgagtaggtaaggttttcctgccaaggcgtcgtggactacgtacgtttcacgttacttatcgtacttatggtaagtttggggtgccggaacgagggtcccgttaccgtacgggtaaccggaacgggggtaccgtttgggtacgggtagggtaaggttggggagttgggacttacgggaactagtaaccaaccgtaacgttaccgggaaacccctaacggtacgtacggtaccccgaggggttccctttaacggacgtaaggggttaccgttttacgttaccgtttaccgtttacccgttacgggtaccctacccgtttgtcccggtaactacggtccgtaacgggtaccgttagtaccgtacacggtactacgagtacgctaacgtaacggctaggacgtacagtacctattatttacgtgttggacgtgtagtactttctttacgttccgttacggttaaccgtttacggttcgtttacccgtcggtttccgttcggttaaccgttccgggtcgggtaacccggttacggtaaccccggg

SEQ ID NO: 1091 - DNA, 596 bp, Homo sapiens
  misc_feature: GYAE6OF02FXNQN.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatgcaaccctctcctgcaggccagtcagagtgttagcagcagcttagctggtaccagcagagcctggccaggcctcccgaggcctcctctatttatggtgctatcccacgtacggccctacgtggtactcccgtaggaccggtttcaaggttcggcgtaggttcggggtctagggaccgtagacttcgacgtcctcaccgtatccgagacctagtctgcgtagtcgtagtacgttagttttcgtacttaagttttacgtttaacttgttctaacgtctaagttaattaacgttacgtcgtaccgtaccgtaacgtacttacggttaacttacgttttcggaccgtacgggtacctaccgtacggtacgtagtaaccgg

SEQ ID NO: 1092 - DNA, 696 bp, Homo sapiens
  misc_feature: GYAE6OF02F91O8.13.36.D03.1.454.CMB.1.raw
  modified_base (301)..(301): a, c, t, g, unknown or other
  misc_feature (301)..(301): n is a, c, g, or t
  modified_base (472)..(472): a, c, t, g, unknown or other
  misc_feature (472)..(472): n is a, c, g, or t
  modified_base (550)..(550): a, c, t, g, unknown or other
  misc_feature (550)..(550): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtgggcagcagcaacaggtgtccactcccaggtgcaactggtgcaatctgggtctgagttagaagaaaccgtggggcctcaggtggtaaggtttccgtgacgaaggcgtcgtggactactacgttacactacttatgtactagtagtaagttggggtancgtagaggcctccgtaggaccgaagggtcgttgaggtagggtagtaggggagtgggaacgtcgaacgtataccgaacgacgtaacgggaaacccgtaacgtactcggccgagggtccttactacggtacggtacggtttagtccgtttcttccgtacggtacctaccgttntccgtcgacgcctacgggtctactacgtacgagtactcggtacaccgtacgaccgaaagtcgtaagggacgaaccgtntcggtaacctttagttacgttacgttagttcggtaagtaggactttacgtttactttaccggtacgttaccggttaaccggttcctttacgttgttaccgttacgttaacccggttacgggtccggggtacctacggggtacccgg

SEQ ID NO: 1093 - DNA, 732 bp, Homo sapiens
  misc_feature: GYAE6OF02GEQ1E.13.36.D03.1.454.CMB.1.raw
  modified_base (280)..(280): a, c, t, g, unknown or other
  misc_feature (280)..(280): n is a, c, g, or t
  modified_base (397)..(397): a, c, t, g, unknown or other
  misc_feature (397)..(397): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaacctggggcctcagtgaaggtttcctgcaaggcgtctggatacacgttcactacttatgctatgaattgggtncgacaggctccgtggacaagggtcttgagtggatgggatggatcgacatcaacactacgggaaccctaacggtactcggacccgtagggtccttacgaacgtacgggtacggttttntaccgtttccgtaccgtttcggaactaccgttccgtaggttaccaggaccctaaccgggtcgttaacgttcggttaacgacggtaacttcgaacgggacctaacggtaccccgttaaaagggtctaacgggaaccggtaccgtaccttcgaacccttttagtttaactttacggttgttacgggttacggaagttacgttacttttccgtttttaccccggttaagggttaacccgttttaaccgggtttaccttttccggtttacgtttcccgtttaacggttaacccggtttacccgggtccgggggtaccccgtaaaggggttaacccccgg

SEQ ID NO: 1094 - DNA, 1146 bp, Homo sapiens
  misc_feature: GYAE6OF02I2AKP.13.36.D03.1.454.CMB.1.raw
tcagtcacgtactacacgaccggtgctcgatttagctgcgtcacgatctctcttgggacccaacaaccacacccctcctaagaagaagcccctagaccacagctccacaccatggactggacctggaggatcctcttcgttggtaggccaggcagaccaacgtaggtgtacccaccgtccccgtagggtagacctaaacgtggtagaccaagttcgtggggttctaggtaaggttacgaaaacggaaacccggtttcggggacccttacgacggtttaggtaaaccgggtttttccctggaaccgtaaggggtccggttacttacgggaacttaaccgtaccggtttaccaaccgttaacgtttatacggtacgttaaactggtaaaggtttgggggccgaaccggtaacgacgggttccttaccccgggttaggaaaccgtaagggggttcctttagggtaccgggttaaggggtacggttagggtacggtaagggtacgttaccgaacggttaaaccttaaccggtaaaacccgttacccggggttaaaacccgggggtaaaaacccccctttaacgggttaaacgttacccccggggggtaaaccccgtaaccccggggtttaccctttaaacccgggttaaaaaacccgggggttacggggttttaacccggggtttttttacccgttttaacccccggtttttacccggttaaaaccccggggtttttaaccgggggtaaccccttttaaccccgtttacccgggttttaaacccgggtaacccggtttaaaccccggggaaacccgggggttaacccgggttaacccgttttaaaccgggtttaacccgggtttaaaactaaccggtttaaaccggtttaaacccgaacggttaaccccggggaaacccgggtttaaacccgggtaaacgggttaccggtaacgggtaaacccggtaaaccggtaacccggttacccgtaacccgtttttaaaagtttaccgtttaacgttccggtaagtttacgaaacgtttcgttacgtttttacccttttacggtaacgtttaaccgtttacccgtaagttttcgtttcccgttacgttaccgttacggtacgggtaccgtacgttaacgggtaccc

SEQ ID NO: 1095 - DNA, 698 bp, Homo sapiens
  misc_feature: GYAE6OF02I8NZI.13.36.D03.1.454.CMB.1.raw
  modified_base (264)..(264): a, c, t, g, unknown or other
  misc_feature (264)..(264): n is a, c, g, or t
  modified_base (322)..(322): a, c, t, g, unknown or other
  misc_feature (322)..(322): n is a, c, g, or t
  modified_base (340)..(340): a, c, t, g, unknown or other
  misc_feature (340)..(340): n is a, c, g, or t
  modified_base (388)..(388): a, c, t, g, unknown or other
  misc_feature (388)..(388): n is a, c, g, or t
tcagtcacgtactacacgaccggtgctcgatttagctgcgtcacgatctctcgttgggggggagaggagcccagcactggggattccggaggtatttccattcggtgatcagcactgaacacagaggactcaccatggagtttggctgagcgtgggttttccttattactatttaaaggtgtccagtgtgaggtgctaggttggtggtagtcgtgggaggaggtcttggtccgagggcccgggggggtcctggacgctcgtacngtgtcgcggcctcgtgggctccgaccgtcaaccaccactacatgagcgtcggccgcgnggcctaccgagggaacgngggccgaggtcggtctacgtatttgttagtacggtcggacggttcacncgtaattcgtacgcagtccgtacgggtaggaccggggtcctaccaccgtattccgaacgtacgaacgtactaacgttaccgaaacggtaactacgggttatacgttatacgaaagttaacggaacctacggttacacgggtaacgtcgggaacgaccggacggtacccgtagttaaccggttaccgtacgacggtaactaaggtagacgtagggaacgacgggtaccggtacccggtagggtaaccggggtcgttaacgggggtcgggttagggtttaccctttggtaccggtacggttgggtaaccggg

SEQ ID NO: 1096 - DNA, 657 bp, Homo sapiens
  misc_feature: GYAE6OF02HK6VR.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaaccgtggggcctcagtgaaggtttcctgcaaggcgtcgtggactacacgttccacgttacttagtgctatgaagttgggtgcgacacggctccgtggacagggtcttggaggtggagtgggagtggatcgacatacaacgtacgtacgggaacccaagtatcgacccgaggtcctacgacggaggttacggttcgtaccgttcttccgtgggtacctccgttcgtacgtcgacggtacgaccgggtacgttaactcgtaacgacgtactcgacgacacgtaccgaaagcgtaggacggtaacctagtactacttacgtttattacgttcggtgtagtaggatttacggttttcctttaccggttacgttaccggttaacggtttcctttacggttcgtttaccgttacgtaaccgttccgggttacggggtacccgtacgggtaacccgg

SEQ ID NO: 1097 - DNA, 664 bp, Homo sapiens
  misc_feature: GYAE6OF02F2K3M.13.36.D03.1.454.CMB.1.raw
  modified_base (279)..(279): a, c, t, g, unknown or other
  misc_feature (279)..(279): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaacctggggcctcagtgaaggtttcctgcaaggcgtctggatacacgttcactacttatgctatgaattgggtncgacaggctctggacgaagggcttggagtggagtgggatgggatcgacatacgaacacgtacgggaaccctaacggttatcggacccgacgggtccttacgacgacgggtacggtttctctttctccgtttggactacctgtcgtacagccgtacggtcctagtacgtaccacggtattacgaacgaccgtaaggtacccgttaaaagggcctagggaacgtacctacgtcgaccttaagtttttacttaaccgtggttcggtaaggtaacgtacgttcttttacccgttttccgttaggtaaccgtttacggttaacctttcgttaccggtttcccgttacggtacccggttacggtccggggtaccgtaggggttaaccccgg

SEQ ID NO: 1098 - DNA, 702 bp, Homo sapiens
  misc_feature: GYAE6OF02GM33O.13.36.D03.1.454.CMB.1.raw
  modified_base (282)..(282): a, c, t, g, unknown or other
  misc_feature (282)..(282): n is a, c, g, or t
  modified_base (331)..(331): a, c, t, g, unknown or other
  misc_feature (331)..(331): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatcgtgggtctgagttgaagaaccgtggggcctgagtgaaggtttcctgacaaggcgtctggatacacgttcacttactatgctatgaagttgggngcgacaggctcgtggacagggtcttgagtggagtgggatgggagtcganagtaccaacgtacgtacgggaaaccctaacgtacgtcgacccgtaggggtacctacgacggtacggtacggttttccttcgttacctttcccgttacgggtaaccctacccgttacgtccgttacgacggtaccgtacggtaccgttaagttacgtaacgtacgtacgtacgtacgaccgtaaacggtaccgtaaaggacgtaggaaccggaacgtaacgaccggtaaccttaacgttttaacgttcgttaaggtggttagaattacggttactttcgtttaccgttaggtaccgtttacggtcctttacgttccgtttaacgttccgttaaccgttcggggtacccgggtacccgtacgggttaacccgg

SEQ ID NO: 1099 - DNA, 926 bp, Homo sapiens
  misc_feature: GYAE6OF02HZSFG.13.36.D03.1.454.CMB.1.raw
tcagtcacgtactacacgaccggtgctcgatttagctgcgtcacgatctctcgttggggggggtcacaagaggcagcgctctcgggacgtctccaccatggcctgggctctgctgctcctcactcctctcactcgaggacacgtagggtccgtcgggccctaggtctcgccctgacctcacgcctcgccctccgtagttcggttcgtgggttccttcccggtagggtactacggttaccgtacctaccgaacccgtaacctttcccttaccgtcggacctaacggtaaacgggtaaaacttacgggaccgtagggttagttaacggtttcggtttacggggttaactttaccgtacggttacccgttttcgttacccgttacccgggttaaccggtaaaacccgtaccgtaaaacccgtaaccccggaaggtaaaccccgtaaaaccccggaacccccgttaaaacgttaaccgttaacgggtttttaaccgggtttaaccgggggtaaaacctaaacgggttaacccgggacccggttaccccgttacgggttaccggggtttaccttttaccggtacggttaaccgttcccgttcggttttaccgtaccggttaccggtacccttaaccggtaacggtttaccggtacgaaacccggtacccggtacccgttaccccgtaccgttacggaaccttaacgttcccgtacggttaccgtaccgaccgggtacggacgaacgggtcggtaacgttctttacgtttaagttttccgtcgtttacgtactagttcgtacggaagtaaggtcgtagttgttaacgttggtacggttaagtagggtacggtacgtaccggtaccgttccgttacgtcgttaacggaccgtacgacccgtaaccgaccctacgtaccgtccgtacttcccgg

SEQ ID NO: 1100 - DNA, 626 bp, Homo sapiens
  misc_feature: GYAE6OF02FMPTA.13.36.D03.1.454.CMB.1.raw
tcagtcacgtactacacgaccggtgctcgatttagctgcgtcacgatctctcttggggggggtcagagctctgggggaggaactgctcagttaggacccagacggaaccatggaagccccagcgcagcttctcttcctcctgctactctggctcccagatactactggagaaatagtgctgacgcagtctccagtcacccctgtctgtgtctccgaggggaaatagccaacccctctcctgcgagggccagtcagagttgttagcagcagcttagcctcggtaccagcagaagcccgtggccacggctcccgaggcctcctctatttagtggtcgcactccacgtacggccacgtcggtcgtcccgagtcgtacggttcgaggcggcgtaggtcgggtcgtagggacgtacgaccttcgtacgtcctaccacctatacacgcacgctcgctagtctagtaacgttagtttcgtactagttacttaattacgtcgtactacggtacgtaagttaacgttaacgttacggtacggtaaccggtacccggttaaccgggaacccggtaacgggaaccgtaacggtaaccggtaagggtaacggtaacggttaaacggtacgttaacggg

SEQ ID NO: 1101 - DNA, 704 bp, Homo sapiens
  misc_feature: GYAE6OF02HW10S.13.36.D03.1.454.CMB.1.raw
  modified_base (417)..(417): a, c, t, g, unknown or other
  misc_feature (417)..(417): n is a, c, g, or t
tcagtcacgtactacacgaccggtgctcgatttagctgcgtcacgatctctcttggggggggtcacaagaggcagcgctctcgggacgtctccaccatggcctgggctctgctgctcctcactctcctcactcaggacacagggtcctgggcccagtctgccctgactcagcctgccctcatgtcgtcgtctcgtgacagtctactccacgtactccgtctcgacacgtaagaatacgactaggtgtagttgggttacggtaactttactaccgttaccgtttcgtccttccggtaacggtacccaaccgacccgaaccgacggaaccaaaccccgtaccccttaaacgtacttaacgtttaccggtttaacgggtactaaaacgtccgggacccgtcccgtaggtacgttcgttcngttactccgttcttactcgactcccgtaagtacgtcgacgacaccggtactccctcgtactacacttgtaccgtacgcgtcggacggaccggacggacgtcgtaatttagttacgttttacggttcgttacgtatacgtagtcggaacggtaggtaagtcgtaagtttagttagttcgttaaggtggtaacggtacggtaaccgttacggcccttaccgggttcgtacgttaccgacccggtaacccgtaccggaacccccttaaccgttggtacctacccttaccg

SEQ ID NO: 1102 - DNA, 698 bp, Homo sapiens
  misc_feature: GYAE6OF02GBKYG.13.36.D03.1.454.CMB.1.raw
tcagtcacgtactacacgaccggtgctcgatttagctgcgtcacgatctctcttggggggtcagagctctggggaggaactgctcagttaggacccagacggaaccatggaagccccagtgcagcttctcttcctcctgctactctggctccagatactactggagaaatagtgctgacgcagtctccagtcacctgtctgtgtctccaggggaaatcgcaaccctctcctagcagggccagtcagagtgtagcagcagcttagctggtacagcagaagcctggccaggcctacccgaggcctccgtcacgttttagtcggtagcgtaactccgtacgttacgggacctacgttgggtaccgtcccgtaagtccgtaacggttccgacgggtccggtcgtaagggtttccgggttacgtacgggggtaactaacgggtacccgttttaccgaacctttcccggttacgaacccctaagttacccgaacgcccgtaacgtcccggttacgaccgtacggttccgtaagtaacggtttacgttttcgtacgtttaactttttagtaacccgtgttacgtaacgacgttaagtaacttaaagttaccgtcggtacccttacggtaaccttacgtacggttaacctttacggtttaccggtaccgggtaacggttaccccgtaaccggttggaacgtaaccg

SEQ ID NO: 1103 - DNA, 754 bp, Homo sapiens
  misc_feature: GYAE6OF02JEW3D.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaacgtggtgcaatcgtgggtctggagttagaagaaaccgtggggcctcaggtaggtaaggttttccctaggaccaaggggtccgttcgtagggaactaccgtaaccgttccaacttaaccgttatggacttataggtaagttggggtgccgacgaggtcctccgtggaacgagggtcttgacggtaggagtgggactgggattcgacgataccgtaacgtacgtacgggaaaccctaacggtagaccgtacccgtacgggtctttacgacggtacggttacggtttctccgttaccgttccggttacgtacccgttactttcgtagtcctaagggtccgtaccggttacggtaatcgtaacgacgtattccggacgtaccgtaccgtaacggttaaccgtcggtacgggaccggtaactcgtacgtacccttaaagttttacgtcgttggtacgttacgagtacgttttacgttttcgtttacccgttaacgggttaagtttacggttaaccctttctttcggttacccggttagttacccggttaacggttccggggaacccggttaccggtaccgg

SEQ ID NO: 1104 - DNA, 739 bp, Homo sapiens
  misc_feature: GYAE6OF02ITTZX.13.36.D03.1.454.CMB.1.raw
  modified_base (238)..(238): a, c, t, g, unknown or other
  misc_feature (238)..(238): n is a, c, g, or t
tcagtcacgtactacacgaccggtgctcgatttagctgcgtcacgatctctcttgggggggtcagagctctggggaggaactgctcagttaggacccagacggaaccatggaacgccccagcgcagcttctcttcctcctgctactctggctcccagatactacgtggagaaatagtgctgacgcacgtctccagtccacctgtctgtctctccgaagggaatagccaaccttctccngcgacggcctagtcagagttgttacgacgacgactacgtacgttacgccgttaggtaacccgaggactacggtacgtcggtaccgtacgggcctaacgggtccctacccggtacggtccctttcccgtacgttaagtttacgtacgggtcgaacctacgtacccgaccggtacggtaccctcggtagttcccggtacctacggtcgttagtccgacggccggtacgtagggttcgggtacggtacggtacgtacggtacctttcgaccgtctaccgacctagtaccgacgtacgacccgtctcggaccgttacgttacgtaggtttaaaccgttggtttaaccgcggtttaacgttacgtttacgacgtttacgaccgtagtacgtaaggttacgtttaccggttagtaacccgggttaacggttcccggtaacggtaaccgggaacgtaaccggtagggttaaaccgtcgggttaaacggtacggttaaccggttaacgg

SEQ ID NO: 1105 - DNA, 800 bp, Homo sapiens
  misc_feature: GYAE6OF02JHDJG.13.36.D03.1.454.CMB.1.raw
  modified_base (233)..(233): a, c, t, g, unknown or other
  misc_feature (233)..(233): n is a, c, g, or t
  modified_base (409)..(409): a, c, t, g, unknown or other
  misc_feature (409)..(409): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcgttggtggcagcagcaacaggtgtccactcccaggtgcaactggtgcaatctgggtctgagttgaagaacctggggcctcagtgaaggtttccngacaaggcgtctggatacagttcaatacttatgactatagtaattcgggtagcgacgtaggtcctccgtagggaacgtaaaggggtctttagggaggttacgggtagtagggggtaactcggtacgtacggaactaacgttacaaaccgtacgtaacgggaacccaaacggttacnccggtccggaacggtctttaccgaacgtagggttaacgtttcgtactttaccgtcgttaacgggtacctaccgttcgttacggtcacgtaccgtaccggtagttagtacgtacgaagtcctactacggacgacgttaaccgaaacggtccgttacgggaaccggaacgttacccgttaggtacccgtttaaagttttaccgtttacggtaacgtttggtaaccgggtaagttaagtttaaccccgttttttcgggtaaccctttaacgggtttaaacccgtttaacccggttttaccggttacccgttttaccgtttaccggtttaacgttaaccccgggttacccgggttttaaccgggggaacccgtaaccgggggttttaacccccgg

SEQ ID NO: 1106 - DNA, 783 bp, Homo sapiens
  misc_feature: GYAE6OF02HPH5Q.13.36.D03.1.454.CMB.1.raw
tcagtcacgtactacacgaccggtgctcgatttagctgcgtcacgatctctcttgggggggggtcacaagaggcagcgctcgtcgggacgtctccaccatcggccgtgggctctgctcgcctcctcacctctcctcactcgaggacacgtacgggtccgtcgggccagtcctcgccctgacctcgacgtcctcgccctacagttcggtcgttcgggtccttccgtacggacgtacggtcgtactccaaccttcttcccgtctcgacgtaacgtaagggtaaatcggtacgtagttaggtacgttaggggtttacggtaactttagtcgttaccgtttcgtcccgttccggtaacggtaacccgaactaaacccgacccgtaaacggacccaaaccccgtaacccctaaacttcgttaaacgttttaacgggttaccgggtaactaaaggtaaccggtcccggtacctacggtacggtttccttacgtacgtacttccgtcttacgtcggtctacccttacggtaagtcgacgacctaaccggcccgtacctacctacgactaacgtcgtacgacgtaccgtacggacgggtaccgacgggacggtcgtcgtttacgttttacgttttcgtttacgttacgtactagtacgtggacggtaagggacgttattagtacgtttagttggtacgttaggaccggttacggaacgtacggtccgtaccggttcgtggacccgtaccggaaccgtaaccggaccctaccgtacgtaccgtcgtacccgg

SEQ ID NO: 1107 - DNA, 697 bp, Homo sapiens
  misc_feature: GYAE6OF02JBHKH.13.36.D03.1.454.CMB.1.raw
  modified_base (173)..(173): a, c, t, g, unknown or other
  misc_feature (173)..(173): n is a, c, g, or t
  modified_base (243)..(243): a, c, t, g, unknown or other
  misc_feature (243)..(243): n is a, c, g, or t
  modified_base (432)..(432): a, c, t, g, unknown or other
  misc_feature (432)..(432): n is a, c, g, or t
  modified_base (480)..(480): a, c, t, g, unknown or other
  misc_feature (480)..(480): n is a, c, g, or t
  modified_base (564)..(564): a, c, t, g, unknown or other
  misc_feature (564)..(564): n is a, c, g, or t
tcagtcacgtactacacgaccggtgctcgatttagctgcgtcacgatctctcgttggggggggtcagagctcgtggggaggaactgctcagttagacccagacggaaccatggaacgccccagcgcagccgttctccttcctcctgcctactctggcctcccagatactaggnggaagaaattagtgactggacgccagtctccacgcccacccgtgtcctgtcgtctccggaaggggaaacncgaccctacctctccgtagccgacggccagtcgtagactagttacgaccaacgacggtacgccgttaggacctagacgaggtaaacggtcggaccctaggcctacccggcggtccttccactcgttcttagtaggtacactacctaccgaccggcggtccacggttacgtccacccgtaggtcccgtancgggacgtacgtggtcggtcggaggtactaggtcctacgtacttaccnctaaccgtactacggtacgactacgtcgtcaggtacttaccggtagttaagttaccgtttggtaacctttagtttacttcgtanccgtaagtctaagttaacgttaaacgttcgtacgtacccgtagttactaccgttgttaacccgttaggttccccggtaacggttacccggtaacccggttattaccgggaatccgtaggaacccgttaacggg

SEQ ID NO: 1108 - DNA, 738 bp, Homo sapiens
  misc_feature: GYAE6OF02FIP7B.13.36.D03.1.454.CMB.1.raw
tcagtcacgtactacacgaccggtgctcgatttagctgcgtcacgatctctcttgggggggggtcacaagaggcagcgctctcgggacgtctccaccatggcctgggctctgctgctcctcactctcctcactcaggacacagggtcctgggacccagtctgccctgactcacgcctgccctccatgtcgtgggtctcctggacagtcgatccacctactctcctgcactggaaatcgcagtgagtggttgggactttagtcggtaccttgttccttccgtcgggttaacccacgaaccgtaccccaaggacctaaaccggaccccccaaaacgttccaattttaagttacggggttacaaataacggtaccgacccctcggtacggggttccttttcgtacgtaacgttccgtctttcgtccgtcggtcctaccgtagtccgtgtaccaaacctccggccctacccgtgtaaccactccttccgtaggaccctaccgggaccggtaccggacgggtaaccggacggtccggttcgttatttttaccgttgtttagttacctacgtttatacggtacgtaaggggacgttaagttgttaagtttaagttcggtttaacggtttacgggtaacgggtttacggggaaccgttaggtaccttaaccccgggtcggtttaacgccgttaaccgacccggtaacccggaccccgtaacctaccggtaccgtccttaacccgg

SEQ ID NO: 1109 - DNA, 654 bp, Homo sapiens
  misc_feature: GYAE6OF02FIDXI.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagccccagcgcagcttctcttcctcctgctactctggctcccagatactactggagaaatagtgctgacgcagtctccagtcaccctgtctgtgtctccaggggaaatacgcaacccctctcctgcagggccagtcagagtgttagcagcagcttagcctggtaccagcagaagccgtggccaggtcctcccgaggcctcctactatttagtggtcgctactccgacgtacgggccctacgtcggtcgtcccgagtctaggttccagggccggacgtagggttggggtaccgtacggggactacggtacctttcaccttccgtacccaaccctactacacgactacggtccctacgcgtacgttactaggtaagtttacgtttttaggacgtaacggttctttaagtttaccttggtacctaacgtccgtaagttaagttacgttacgtacgggtaaaccggtaacccgttaccgggaaccgtaaacgggaccgtaaccggtaacggtagggtaacgtaacggttaaacggtacgttacggg

SEQ ID NO: 1110 - DNA, 611 bp, Homo sapiens
  misc_feature: GYAE6OF02F10BG.13.36.D03.1.454.CMB.1.raw
  modified_base (270)..(270): a, c, t, g, unknown or other
  misc_feature (270)..(270): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
  modified_base (436)..(436): a, c, t, g, unknown or other
  misc_feature (436)..(436): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaccgtggggcctcgagtggtaagtttcctgacgaaggcgtctggatacgtacgttcactacttntgactatagtaagttgggtgcgagacggctaccgtggacaagggtcttaggaggtggagtcgggtataggagtcgaactataccgaactacgtacgggaacccagtancgccgaggtctcgacgaggtacgttntcgttctcgtcgacctctctagcagcgacgtntatgacagctacgagacgacgtacgtaagcgtacggacgtacactcgtaacttatttacgtagtcggtagtacgagtattaccgtttacttaccggttagtaaccgtttacggtttcctttcgttacgttccgttacgtaaccgttcgggtacgggtacccgtacgggttacccg

SEQ ID NO: 1111 - DNA, 657 bp, Homo sapiens
  misc_feature: GYAE6OF02JUI2V.13.36.D03.1.454.CMB.1.raw
  modified_base (191)..(191): a, c, t, g, unknown or other
  misc_feature (191)..(191): n is a, c, g, or t
  modified_base (289)..(289): a, c, t, g, unknown or other
  misc_feature (289)..(289): n is a, c, g, or t
  modified_base (320)..(320): a, c, t, g, unknown or other
  misc_feature (320)..(320): n is a, c, g, or t
  modified_base (334)..(334): a, c, t, g, unknown or other
  misc_feature (334)..(334): n is a, c, g, or t
  modified_base (339)..(339): a, c, t, g, unknown or other
  misc_feature (339)..(339): n is a, c, g, or t
tcagtcacgtactacacgaccggtgctcgatttagctgcgtcacgatctctcgttgggggggtcagagctcgtggggaggaactgctcagttaggacccagacggaaccatggaacgccccagcgcagcttctcttcctctgctactctggctcccgagatactactggagaaatgtgctgacgctagtcncacgtcacctgtctggtctctccgagggtaaatacggccaacctctccagcgacgggccagtcagagtcgtagcagcagtcgttacgccgtggtaccngacgaagaacgtcgacggccgagcctaccgnggctctactattgnggtancacgaccacggacggacacgttacgaccttccgacggtaccgtggtaacgtcggtacgtacggttcggacggttacggcgaacgtcgttactacgtctcacgtaactcgacgtcaacgtcgacgtaccgtagtacgtaacggtacttaacggtttcgtaccgtttaagtttaccgttacggttacgttccggtaacgtaacggttaaactaacgtttaacgacgtttaccggacctttacgtacgttaacgttcggttacccgttttagtacggttacccgtaacgggtaccctaagtttacggacgtacgtaaccgg

SEQ ID NO: 1112 - DNA, 765 bp, Homo sapiens
  misc_feature: GYAE6OF02HSZY8.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtcccactcccgaggtgcaacgtggtgcaatcgtgggtctgtagttgaaacgaaaccgtggggcctcgaggtaggtaacggtttcctgacgaagggcgtcgtaggactaccgtacgttactacttacttagtcgtcttagtgtaagttggggtcgcgtacgaggtcgtccgtaggaacgtaagggtcgttaggaggtggtagtgggagtgggatacggactagtaccaaacgacggtaaccgggaaaccctaacggtacgtacgacccgggtaggtccgttacgaacggttacgggtaccggttttcgtaccctttcgttacccgttacggtaccctaccgtcgtccgtacgacgccgtaacgggtcgttaacgtcggtaacgtagacgttacgacgtacgaacggtaacccgtaaagggcctaagggaacggaccctaaggttccgtaaccttttaattttacgttaggtttcgggtataagggttaagtcgtttacctttttcgtttaaccggtaggttacccgtttacgttacctttcggtttacgttacccgtttacggaacggtttacccgggtcgggaacccgtaaccggggttccccg

SEQ ID NO: 1113 - DNA, 906 bp, Homo sapiens
  misc_feature: GYAE6OF02HRWHD.13.36.D03.1.454.CMB.1.raw
tcagtcacgtactacacgaccggtgctcgatttagctgcgtcacgatctctcgttggggacccaacaaccacaccctcctaagaagaagcccctagaccacagctccacaccatggactggacctggaggatcctcttcgttggtggcagcagcaacaggtgtcccacctcccgaggtgcaaccgtggtgcaatcgtgggtctaggtagttaggaaacgaaacccgtgggggtccctacgtaggttacggtaacggttttacccgtggaccgtaaaggggtccggttccgtaggtaacgttaacccgttacggttccgtaaacctttacgtttaacgtcggtaccgttagttacggttaaaggtttcggggtacaccgggtaacgacggttccgtccggttacgggaaaccggtaacggggttcgtttaccggaagggttagggtaacgggttagggttaaactcgggtaaccggttaccgtaaccgtaacgttaacccggtaaccggtaacccgggtaaacccggggtaaacccgttaaaccggttacggtaacccgggccccggttaacggggtcccgttaacccgtaacggggtaacgggttttaaccccgggttttcgttaccccgtttaccggtttcccggttaacgggaacccccttacgttccgtaccgtcgtaccggaccgtacggtacgttacgtacgtaacgtacgtacgtcgacgtacgacgtacgtaagtacgacggagtaccacgtacgtacgttaacgttacgttacgtcggtacggtagtaacgttacgttcttaccgtttaccgtacgttaccggttagtttacccgttagtttccgttacgttaccggtaccggttaccgggtacgggtccggtaaaccgttccccggg

SEQ ID NO: 1114 - DNA, 745 bp, Homo sapiens
  misc_feature: GYAE6OF02G56ZC.13.36.D03.1.454.CMB.1.raw
tcagtcacgtactacacgaccggtgctcgatttagctgcgtcacgatctctcttgggggggtcagagctctggggaggaactgctcagttaggacccagacggaaccatggaagcccccagcgcagcttctccttcctcctagcctactcgtggcctcccagatacctactggaagaaatagtgactgacgcagtctccagtcacccgtgtctgtcgtcctccgaaggggtaaatcgaccgtaaccctctcctgacgacggccaggtcaggtcgttgtacgcagcgtagtccttaggcctggtaccagtacgaacgaacgtcccgcgggacctcggacccttacccggacggtccttacccgtacttaagtttacgtaggtcgacctactcccgagtaccggcctacgtggtccgtacctacggtacgacggttccgaaggtccggacgtacgggttcgggtacccgggtaggggaaccgtacgtaaccctttaccgaccttacgtcccgtaaaccacgttcaacgtccgaaaccgtcctagaccgtacgttcgttaggaagttttaacgttccggtaacttacggttacctttacgtttactaccggtttaacacgttacgttaagtttaagttacgggtttaacgaaccggtttaaccggttaacccggtaaccggtaaccggtaacggaacctacgggtaaccgttaaggtaacggttaaacggttaaggtacgttacgggg

SEQ ID NO: 1115 - DNA, 806 bp, Homo sapiens
  misc_feature: GYAE6OF02IYA8X.13.36.D03.1.454.CMB.1.raw
  modified_base (220)..(220): a, c, t, g, unknown or other
  misc_feature (220)..(220): n is a, c, g, or t
  modified_base (227)..(227): a, c, t, g, unknown or other
  misc_feature (227)..(227): n is a, c, g, or t
  modified_base (630)..(630): a, c, t, g, unknown or other
  misc_feature (630)..(630): n is a, c, g, or t
tcagtcacgtactacacgaccggtgctcgatttagctgcgtcacgatctctcgttggggggggtcacaagaggcagcgctctcgggacgtctccaccatggcctgggctctgctgctcctcactctctcactcaggacacagggtcctgggcccagtctcggaccctgactcacgcctgacctccatgtcgtcggtctccgtggacagtcgatcaacctntcctccngctacgtaggaactgcaggtgtagttggttacggtacttacgtcgtaccgttcgtccgttccgtacggtaaccgtaaccaacccgaaccgacggtaaaccgaaacccgtaccccctaaactacttaacgttttaacggttaacgggaactaaacgtaaccggtcccggtacccgtacgtacgggttctttacgtacgtaaccgtccgttacctttccgtaccggtaccgggtaccccttaaggtcggtaccgaaccctaaaccggtccccggtcccttaccgagtaacctaccgtttacggaccgttcgggaaacctccggacgggacgacggtaacgacggttctaacggtttaactttccggttgtacgttaactacgtgtacgaacggtaggttaaacgntttcggtaagtttacggtagtttcggttaaacggggtaacgggttaaccgggtacccgtaaccgggtttccggaacccggttttacggtaacggccccggttaaaccgcccgggtaaaaccccgttcccggtaaccccgttaaaccggtcgttaccccgttacccgtttacccccg

SEQ ID NO: 1116 - DNA, 902 bp, Homo sapiens
  misc_feature: GYAE6OF02I4J0L.13.36.D03.1.454.CMB.1.raw
tcagtcacgtactacacgaccggtgctcgatttagctgcgtcacgatctctcttggggggggtcagagctctgggggaggaactgctcagttaggacccagacggaaccatggaacgccccagcgcagcttctcttcctcctgctactctggctcccagtatactacgtggaagtaaatagtgtctgacgcgacgtcctcctagtccaccctgtcgttgtcgtcctaccggaaggggtaaatacgaccctaacccgttccttccgtacgaccggacgggacctagtcgtaaggtacgttcggttaacgctaggaccgtacgtacttaccggtaccggttacggtacccgaaggtaccgaacgggtaaccgggtcccggttaccggggaacccgtaaccgggtcccccgttaccccggaaccggggttcccctttaccccgttacggtttaaacgtttttacgggtcggggttaactcccgttaccgtaacccggtaaccgggtaccgggaacccgttacggtttacggggtaccccgttaacccggttacgttacccgggttaggttaccggacggggtaccgggtacggtacggggtttacgggtacggttaccggggactttaacgggtcccttaacgtaccttcctccgtacctacgtacctacgaccgacgttacccgtggtacttacggttacgttaacggtaacgtttaggttacctaccggttaccgtttaccgttaacggtttacgtcgttaacggtattaacgttaagtaccggtttacgttacgggttaacggtaaccggttaaccgggtacccgggtacgggaaacccggttaacgtaacccggggtaggtaacggttaaacgggtaaacgtttaccgggagttaccgggg

SEQ ID NO: 1117 - DNA, 625 bp, Homo sapiens
  misc_feature: GYAE6OF02ICB6Q.13.36.D03.1.454.CMB.1.raw
  modified_base (290)..(290): a, c, t, g, unknown or other
  misc_feature (290)..(290): n is a, c, g, or t
  modified_base (298)..(298): a, c, t, g, unknown or other
  misc_feature (298)..(298): n is a, c, g, or t
  modified_base (349)..(349): a, c, t, g, unknown or other
  misc_feature (349)..(349): n is a, c, g, or t
  modified_base (498)..(498): a, c, t, g, unknown or other
  misc_feature (498)..(498): n is a, c, g, or t
  modified_base (520)..(520): a, c, t, g, unknown or other
  misc_feature (520)..(520): n is a, c, g, or t
tcagtcacgtactacacgaccggtgctcgatttagctgcgtcacgatctctcttgggggggtcagagctctggggaggaactgctcagttaggacccagacggaaccatggaagccccagcgcagcttctcttcctctgctactctggcctccagactactactggaagaaatgtgctgacgcagtcctcagtcaccgtgtctgtctctacgagggaaactcgaccaacccttcgtccgtcgacgacgggccagtcagtagtgtacgcagcagtctagccgtaggtaccngacagaanccgtggacctacggtccaccgaagtccgtactgtaactttgcggtcgtacncgtaccacggtacggtcctacggttcggtccgtaccagtcgtacgttacgcgtacgtacgtagggttcggtcgtacgggactaccgtactcgtacctcgtaccaagtctacgacgtcgagtccgtagcttaagtccgtagtaaccgttnttacgatcgttactggtttacncgttacgattaaccgtgttaacgttacgtagtacggtaaccgtaccggtacgaaacggcgtaaacgccgtaagttaacggaagtttaaacgtacggtagttacgg

SEQ ID NO: 1118 - DNA, 656 bp, Homo sapiens
  misc_feature: GYAE6OF02FWRY3.13.36.D03.1.454.CMB.1.raw
  modified_base (265)..(265): a, c, t, g, unknown or other
  misc_feature (265)..(265): n is a, c, g, or t
  modified_base (282)..(282): a, c, t, g, unknown or other
  misc_feature (282)..(282): n is a, c, g, or t
  modified_base (287)..(287): a, c, t, g, unknown or other
  misc_feature (287)..(287): n is a, c, g, or t
  modified_base (492)..(492): a, c, t, g, unknown or other
  misc_feature (492)..(492): n is a, c, g, or t
tcagtcacgtactacacgaccggtgctcgatttagctgcgtcacgatctctcttggggacccaacaaccacacccctcctaagaagaagcccctagaccacagctccacaccatggactggacctggaggatcctcttcttggtggcagcagcaacaggtgtccactcccaggtgcaactggtgcaatctgggtctgagttgaagaaccgtggggcctcagtgtaagtttcctgcaaggcgtctggatacacgttcactacttangactatgaagttgggtncgacnggctccgtggacaagggcttagagtggagtgggtactgggactcggactagtacaacgtacctacgggtaaaccccaggttactccggaccctaacggggtctttaccacggtacgggttacgtttcgtacctttcgtacccgtttacggacctaccttcgtacgtctacggcgtacggtcgtagttacgacgagtactcggaanccgtaacgtaccgtaacgcgtaggacggtacactacgtacctttatttaccgtagttctaggtacgtacgtagtttacttaccgtttcgtacgtaaccgttacgttactttcgttaccgtctttacggtaaccgttcggaaccgggtccgtaacgggtacccgg

SEQ ID NO: 1119 - DNA, 804 bp, Homo sapiens
  misc_feature: GYAE6OF02FSTVY.13.36.D03.1.454.CMB.1.raw
tcagtcacgtactacacgaccggtgctcgatttagctgcgtcacgatctctcttggggacccaacaaccacacccctcctaagaagaagcccctagaccacagctccacaccatggactggacctggaggatcctcttcttggtgggcagcagcaacaggtgtccactcccaggtgcaactggtgcaatctgggtctgagttgaagaaaccgtggggcctcgagtggtaaggtttcctgacaggtcgtcgtggatacgacgttctactacttatgctatgtaagttgggtagccgaagacggcttacccgtggaaccgtaaggggtccgttaggaggtcgggtagtgggggagttcggggtaagtaccgaacgtactaccgtaaaccgtaacgtaccgggggaaaaccccacgtttaagtccggtcccggaaggggtacctttaccgtacggaagggttaccgggtttttcggtcgtttcccgttccgttacgggtaccctaccgtttcgtacggtttaccgaacggtcccgtaacggggtcgttacgttacggttaacaacggtaacttcccgaaggtaccggttacggaaacccggttaaacgggccggttacgggaacgggaacctaccgtaggtaccctttaaactttttacgttaacgttgggttggtaacgaagggttacgttactttcccgttcgtttaacggtacccgtttaccgggttcctttaaccggttcgttttacccgtccgggttaaccgttaaccgggtccgggtaccgggtaacgggttaaccccggg

SEQ ID NO: 1120 - DNA, 504 bp, Homo sapiens
  misc_feature: GYAE6OF01EOSEE.18.16.B05.1.454.CMB.1.raw
  modified_base (494)..(494): a, c, t, g, unknown or other
  misc_feature (494)..(494): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggaggcgtggtcctgcctgggacgtcgctgagactctcctgtgcagcctctggattcaccttcaatacctatgctttgcactgggtccgccagactccaggcaaggggccagagtggctgtcagttatttcatatgatggaactaatcaatactacgcagactccgtgaagggccgattcacatctccagggacaattccaggaacacgctgtctctacaaatggacagcctgagaactgacgacacggctgtctattatgtgcgagagactctgggttactgtgattnagggagatcg

SEQ ID NO: 1121 - DNA, 536 bp, Homo sapiens
  misc_feature: GYAE6OF01C6SYV.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggaggcgtggtcctgcctggggggtccctgagactctcctgtgcaggccctgcattcatctttaatagttattggatgcactgggtccgccaggctccgggggaagggggccggaggtgggtggccaacataatgcaagatggaactgagaagaactatgtggactctgtgaaggccgattcaccatctccagagacaacactaagaacttactgtaatctgcaaatgaacagcctcagagccgaggacacggctgtgtattactgtgacgaagagcaaggtggctggggacagtgggacgtcgtaggggcccaaaggggcccagggtccc

SEQ ID NO: 1122 - DNA, 508 bp, Homo sapiens
  misc_feature: GYAE6OF01CB8Y2.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgctttgcactggtccgcagactccaggcaaggggccagagtggctgtcagttattcatatgatggaactaatcaatactacgcagactcgtagaacggccgattcacatctccagggacaattccaggaacacgctgtctactacaatggacagctagagaactgacgacacggctgtctattattgtgcgagagactacgtgggttactgtcgattagagggtagagtcg

SEQ ID NO: 1123 - DNA, 534 bp, Homo sapiens
  misc_feature: GYAE6OF01DLTDR.18.16.B05.1.454.CMB.1.raw
  modified_base (298)..(298): a, c, t, g, unknown or other
  misc_feature (298)..(298): n is a, c, g, or t
  modified_base (426)..(426): a, c, t, g, unknown or other
  misc_feature (426)..(426): n is a, c, g, or t
  modified_base (526)..(526): a, c, t, g, unknown or other
  misc_feature (526)..(526): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattccaccttcaatacctatgtctttgcacgtgggtccnccagacctccgaggccgaaggggccaggagtggctgtcagttattcatatgatggaaactaatcaatactacgcagactccgagaacgggccattcaccatctaccaggacaatccaagaacacgctntctactacaactggaacagtcctagacgaactcgacgacgacgtcgtgtacttattattgtgcgagagtactacgtggttactgttagtacttcggaggngtaagtcg

SEQ ID NO: 1124 - DNA, 582 bp, Homo sapiens
  misc_feature: GYAE6OF01DLVLU.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaactggtggaggtccgggggagcggtggtcctgccgtgggacgtcgctgagactctcctgtgcacgcctctggacttcaccttcaatacctatgtctttgcacgtcgggtcccgccagacctccgaggcgaacggggccaggagtggctgtctagtttattcgatatgatggaactaatcaatacacgcagactccggagaacggcctattccactatctaccgaggacactcgaagacacgtctgtctactaacaagtcggaacagaccgtagaacgaacgtacgaccgaaccgacggtctacgtacttagttacgtggtggacgtaaggtagtaaccgttacggttacgggttacttggttagtacgttacggaagggtagtaacgttcg

SEQ ID NO: 1125 - DNA, 604 bp, Homo sapiens
  misc_feature: GYAE6OF01B8EI0.18.16.B05.1.454.CMB.1.raw
  modified_base (256)..(256): a, c, t, g, unknown or other
  misc_feature (256)..(256): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctntggattcaccttcaatacctatgctttgcactggtccgccagactccaggcaaggggccagagtggctgtcagttattcatatgatggaactaatcaatactacgcagtactccgtagaacgggccgattcaccatctccgagggacaattccagaacacgctgtctacgtaacaaatcgggaacacgtaccctaggaacaaaccgttggaaccgaaccacgggtacttacggttaccttaagtttagttacggttacggaccggtaaggtaacggtaaccgttacggttacgggtttaaccttgggttacgtaacgtttaccggaaggggtacgtaaacgttaccgg

SEQ ID NO: 1126 - DNA, 564 bp, Homo sapiens
  misc_feature: GYAE6OF01AI9X9.18.16.B05.1.454.CMB.1.raw
  modified_base (258)..(258): a, c, t, g, unknown or other
  misc_feature (258)..(258): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggaggtccgggggaggcgtggtcctgccgtgggacgtcgctgagactctcctgtgcagcctntggacttcaccttcaatacctatgtctttgcacgtgggtccgccagacctccgaggcgaaggggccaggagtggctgtcagtttattcatatgataggaaactatacaatactacgacacgactcgtgaacggcacttacaccatcctaccgaacgggactacgttaccgaagaaccacgctacgtacctactaacaactgacagcctagaacgacgagacgacgacgctgtacgtattgttgtagcgtaagtagtacgttacgttagggttactgtacgtgttaacgagggtaagtagttaccgg

SEQ ID NO: 1127 - DNA, 590 bp, Homo sapiens
  misc_feature: GYAE6OF01DHETM.18.16.B05.1.454.CMB.1.raw
  modified_base (255)..(255): a, c, t, g, unknown or other
  misc_feature (255)..(255): n is a, c, g, or t
  modified_base (339)..(339): a, c, t, g, unknown or other
  misc_feature (339)..(339): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggactcgctgagactctcctgtgcagcctntggattcaccttcaatacctatgtctttgcacgtcgggtccgccagactccgaggcgaaggggccaggagtggctgtctagttnttcatatgatggaactaatcaatactacgcagacctcgtagaacggtccattcacctactcctaccgaaggaactaacttaccgaaggtaaccacgtacctgtacctactaacgaacgtcggaacacgcgtagaacgaacgtacgacgacgacggtcttcgtacttagttagtgtagacggtacgtaagtacttacggttacggttacgtaggttacgtaacgttacggaaggggtaataacggttaccgg

SEQ ID NO: 1128 - DNA, 772 bp, Homo sapiens
  misc_feature: GYAE6OF01DP9BI.18.16.B05.1.454.CMB.1.raw
  modified_base (274)..(274): a, c, t, g, unknown or other
  misc_feature (274)..(274): n is a, c, g, or t
  modified_base (305)..(305): a, c, t, g, unknown or other
  misc_feature (305)..(305): n is a, c, g, or t
  modified_base (359)..(359): a, c, t, g, unknown or other
  misc_feature (359)..(359): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccgttgggttttcctcgttgtcttcttttaagaggtatccagtgtcaggttcaacgtggtggaggtccgggggaggtcgtggtcctgccgtgggcgtcgctgagctctctgtgcagcctgtggattcaccttnaactacctatcgtcttgctacgtcgggtccnctacgaccgtccgaaggcgaacgggccaaggtggtcgctgtctaagttttactnaagttagtagtaagttacggaaactaagtacctaaataccgaacgcaacgtaccgtaccggaggaacggtccgtaacttccaacctacgttaccgtaaccggtaacggtaaacctaaacgtacccgaaacgggtaacctaccgttacgtacggttacctaacgtaaaccgtaaacggtcggaacgaccgtaaccgtaacggtaaaccggtaacccgtaacggtaacccggaaaccgttaccggggttacctttaacgggttacctttaaaggtttacggttacggtaccgggtaaccggtaaacggttaaaccggttaacgttttaaccgggtttaccgggtttaaacgttacgggttaaacggttaacggtttaacccggggaaaagggggttaactaaacggttccccggg

SEQ ID NO: 1129 - DNA, 520 bp, Homo sapiens
  misc_feature: GYAE6OF01CUYCT.18.16.B05.1.454.CMB.1.raw
  modified_base (294)..(294): a, c, t, g, unknown or other
  misc_feature (294)..(294): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgctttgcactgggtccnccagactccaggcaaggggccaggagtggctgtcagttattcatatgatggaactaatcaatactacgcagactcgtggaggccgattcaccatctccgaggacaattccaaggaacacgctagtctactacaatggacagcctagagaactgacgacacggctgtctattagttgtgcgagtacgacttacgtgggttactggtgaagttgaagggagtaagtcg

SEQ ID NO: 1130 - DNA, 656 bp, Homo sapiens
  misc_feature: GYAE6OF01BHQXG.18.16.B05.1.454.CMB.1.raw
  modified_base (298)..(298): a, c, t, g, unknown or other
  misc_feature (298)..(298): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggagcgtggtcctgcctgggacgtcgctgagactctcctgtgcagcctctggacttcaccttcaactacctatgtctttgcacgtcgggtccnccagtactccgaggcaaggggccagagtgctgtcagttattcatagtgataggaactagtacaatactacgcagtactccgtaggaacggccgtattaccacctatacccgtaccgaacgggtaacctaaacgttacccgaaagggtaaccctacggtacccttacggttacccttaccgtaaacgtaaacgttcggaacctacggtacccgttaaggaaccgtaacgtacggaaaccgaccgtaacgggtccttacggtaccttaagtttagttcggtagtacggtaagtacggtactttacggtagggtttacctagggttacgtacggttacgtaacggggaagtacgtaccggg

SEQ ID NO: 1131 - DNA, 752 bp, Homo sapiens
  misc_feature: GYAE6OF01BVI0A.18.16.B05.1.454.CMB.1.raw
  modified_base (249)..(249): a, c, t, g, unknown or other
  misc_feature (249)..(249): n is a, c, g, or t
tcagtacgagtatgcacgaccggtgctcgatttagagctcacgtaagggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggaggcgtggtcctgccgtggcgtcgctgagtctctcgtgcgacncgtcctcgtgtacttcctaaccttacaacttacctatcgttcttgcctacggttccgggtcccaccgtaacgtacctacgacggaacgggaacgggaccaaggtagggtcgtccgttggtacttaaggttttacttacgtaattaggtagtaaggttaacggaaaactttaactaactaaacgtttaaccgtaaccgagtaaccgtaccgttacccgggtaaagggaacccggggtaccttattaccccggaaaccctacgttaccccgtaaccgggaacggtaaaccttaaaccgtacccggaaacgggtaacccacggtcgttaccggttaccttaacgaaaaccgtaaaggtcggaaccacgtccggaagtaacgaaccgtacgaccgaacggacgtccgttagtaacttaagtttagtcggtacgcgtaaaggacgttaacccgttagggttcggtaagtttcgggaatttaccggagggaacggttaagtaccttcgg

SEQ ID NO: 1132 - DNA, 776 bp, Homo sapiens
  misc_feature: GYAE6OF01C1R1I.18.16.B05.1.454.CMB.1.raw
  modified_base (302)..(302): a, c, t, g, unknown or other
  misc_feature (302)..(302): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagagtatccagtgtcaggttcaactggtggaggtccggggagcgtggtcctgccgtgggactcgctgagactctcctgtcgcagcctcgtggattcaccttcaatacctatcgtactttgcacgtcgggtccncacgacctccaaggcgaaggggccaggagtcggctgtcagtttattacatatgattacgaaacttaatcgtaataactacgactaagtacctaccggtaggaaccgggtccgtactttaccaacccgtactaccgttaccgaacggggaaccttaaacgtttacccgaaacgggtaacccgtaaacggtccgttaaccggttaccttaaccgtaaacgtaaacgttacgggaacctaacggtaacccgtttaacggaaacgggttaaacccgttaaccgggtaacccggaacccggtaaccgggtaccctttaacgggtttaaccctttaagttttaacgtttacggttaacgggtaccggtaaacgggtaaaccggtaaccgtttaaaccgggtttacgggggtttaacccgtttagggtttaacggttaaacgtttacgggaaacggggttaaaggttaacggttaacccgg

SEQ ID NO: 1133 - DNA, 605 bp, Homo sapiens
  misc_feature: GYAE6OF01CNDXX.18.16.B05.1.454.CMB.1.raw
  modified_base (455)..(455): a, c, t, g, unknown or other
  misc_feature (455)..(455): n is a, c, g, or t
  modified_base (474)..(474): a, c, t, g, unknown or other
  misc_feature (474)..(474): n is a, c, g, or t
  modified_base (527)..(527): a, c, t, g, unknown or other
  misc_feature (527)..(527): n is a, c, g, or t
tcagtacgagtatgcacgaccggtgctcgatttagagctcacgtaaggggctgggagaggagcccagcactggaagtcgccggtgttccattcggtgatcagcactgaacacagaggactcaccatggaattggggctgagcgtggtttcctcgttgctatttagaaggtgtccagtgtgacgtgcagctggtggagtcgtgggggaggcttggtccaggcccgtggggggtccctgagactctccgtgtgcaggccctgcattcattctttaatagttattggatgctacgtgggtccgccgaggcgtccgggggaagggccggagtgggtggaccaacgataatgacaagataggaactgaagaagaactagtgtaggactcgtagtagaacgggcctaattccgacctatccaccaagacgaaccaaactactaaagaaacctttgagttancgtagaacaaatcggaacncgtcctagaacggacgacccggaggaccacgggtcttggtagttaacttacgnggtagaaccggtaaagaggcctaaagggtcggccgttaggggaacctagtcggggaccgtcggtacgggggaaccccg

SEQ ID NO: 1134 - DNA, 542 bp, Homo sapiens
  misc_feature: GYAE6OF01ELKWU.18.16.B05.1.454.CMB.1.raw
  modified_base (256)..(256): a, c, t, g, unknown or other
  misc_feature (256)..(256): n is a, c, g, or t
  modified_base (344)..(344): a, c, t, g, unknown or other
  misc_feature (344)..(344): n is a, c, g, or t
tcagtacgagtatgcacgaccggtgctcgatttagagctcacgtaagggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctntggattcaccttcaatacctatgtctttgcacgtcgggtccgccaagacctccgaggcgaaggggccaggagtggctgtctagtttanctatatgaatggaactaatcaaatactacgcagactcgtgaaggccgattcaccatctccaaggacaataccaggacacgctcgtactactacaaatggacagcctagacgaactgaccgacacggactagtacttattattgtgcgtagtaaggactacgttgggttactgtagtagttagagggtagtaagtccgg

SEQ ID NO: 1135 - DNA, 666 bp, Homo sapiens
  misc_feature: GYAE6OF01BQD57.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgtctttgctactgggtccgccagacctccgagggcaaggggccagagtggctgtcagtttattcatatgatggaaactaatcaatacacgacagtactccgtaggaacggtccgtattcgaacctatccaccgagggaactaacgttaccgaaggaaccacgtctagttcctactaactaaatcgggaacacggtacctaggaacggtaaacgtacggaaccggaaacctaacgggtacccgttagttaaccgtttaacgtttaagtttaccgggttaggtacccgggtaaaggtaacggttaaccgttaacggtttacggggggttttaaacccttgggttacggttaacgtttacccggaagggggttaaacgtaaaggttcccgg

SEQ ID NO: 1136 - DNA, 507 bp, Homo sapiens
  misc_feature: GYAE6OF01BJ9ZR.18.16.B05.1.454.CMB.1.raw
  modified_base (392)..(392): a, c, t, g, unknown or other
  misc_feature (392)..(392): n is a, c, g, or t
  modified_base (449)..(449): a, c, t, g, unknown or other
  misc_feature (449)..(449): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccagactccaggcaaggggccaggagtggctgtcagttatttcatatgatggaactaatacaatactacgcagactccgtgaaggccgatcacatcncaggacatcagacacgctgtctctacaatgacagcctagataactgaacgacgacgntgtctattattgtgcgagagacttacgtgggttactgtagtattcgagggtagagtcg

SEQ ID NO: 1137 - DNA, 576 bp, Homo sapiens
  misc_feature: GYAE6OF01DC1VH.18.16.B05.1.454.CMB.1.raw
  modified_base (300)..(300): a, c, t, g, unknown or other
  misc_feature (300)..(300): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaactggtggagtccgggggagcgtggtcctgcctgggacgtcgctgagactctcctgtgcagcctctggattcaccttacaatacctatgtctttgctacgtgggtcccnccacgacctccgaggccgaaggggccaggaggtggctgtcagtttattcatatgatagaactaatcaatacacgcagactcgagaacggtccattccactactcctacgaggactaagtccaagaacacgctgtactactaacaagtcggacacgcgtagaacgaacgtagaccgacgacggtcttagtacttaagtttagttgtaggacggaagtacgtaacgttacgttaggggttactggttacgtaacgttggaaaggggtataagtaccgg

SEQ ID NO: 1138 - DNA, 614 bp, Homo sapiens
  misc_feature: GYAE6OF01ECR2G.18.16.B05.1.454.CMB.1.raw
  modified_base (307)..(307): a, c, t, g, unknown or other
  misc_feature (307)..(307): n is a, c, g, or t
  modified_base (517)..(517): a, c, t, g, unknown or other
  misc_feature (517)..(517): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaactggtggagtccgggggagcgtggtcctgcgtgggacgtcgctgagactctcctgtgcagcctctggtattccacccttacaattacctatcgtctttgcctacgtggggtcccnccagacctccgaggcgaaggggccaggagtggctgtactagttatttcattagtgataggaaactaatctaaatactacgacagactccggtagaacggctattccacctactcgtaccgaggacctaacgttccgaacggtaacaccgtacgttcgttcctactaacgaagtcggaacacgcctaggaacactacgaccgacaccggtnttcgtacttattagttggtcgacggtaacgtaggtaccgttacggttacggggttacttagggtacgttaactccgggaagggtaagtaagtaccgg

SEQ ID NO: 1139 - DNA, 657 bp, Homo sapiens
  misc_feature: GYAE6OF01A6HI5.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagaggtatccagtgtcaggttcaactggtggaggtccgggggaggcgtggtcctgccgtgggacgtcgctgagactctcctgtgcagcctcgtggtacttcaccttcaaattacctatgtctttgctacgtcgggtccgccagactccgaggcaaggggccagagtggctgtcagttattcatatgataggaactaatacaataactacgacacgactccggtaggaacgggccgtacttaccgaacctactcctaccgagggaactaaacttaccgaacgggaaacaccggctacggtactaccttaacaaattcggaacacgaccgttagaacgtaaacgtcgaacccggaacgaccggtacgttacgttacgtttaatttaacgttggttaggacggtaacggtaaggtaacggttaacgttaggggtttaacgtttagggttacgtaagtttacccggaaggggtaacgtaaacgtttacccggg

SEQ ID NO: 1140 - DNA, 683 bp, Homo sapiens
  misc_feature: GYAE6OF01BK552.18.16.B05.1.454.CMB.1.raw
  modified_base (309)..(309): a, c, t, g, unknown or other
  misc_feature (309)..(309): n is a, c, g, or t
  modified_base (341)..(341): a, c, t, g, unknown or other
  misc_feature (341)..(341): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaacgtgggtggaggtccgggggaggcgtggtcctgccgtgggcgtcgctgagactctcctgtgcagcctgtggtacttctaccttcaactacctagtgtctttgctacgtcgggtccnccagacctcgacggacgaacggggtccaaggnggtcgcttgtacttagtttattcgaatagtgtaagtaggaaactaatactaataacctaacgactaacgtaccgtaccggtaggaaccgggtcctacgttaccaacctacgtaccgtacccgaacgggtacctaaacgttaccgaacgggtaaacctaccgtcgtacgttacctaacgtaaacgtaaacgtacggaactacggacctaacggaaccgtaacgtacggaaccgtaaccgacgtccgttacgttaccgttaattacgttcggtagtacggtaacgtacgtacggttacggttgggttacgttagtgtaacggttagaacgggtaagtacgtcgg

SEQ ID NO: 1141 - DNA, 544 bp, Homo sapiens
  misc_feature: GYAE6OF01ACISF.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggaggtccgggggaggcgtggtcctgcctgggacgtcgctgagactctcctgtgcagcctctggacttcaccttcaaataccctatgtcctttgccacgtcgggtcccgccacgacctccgaggccgaaaggggcccaggaggtggctgtcagtttattcatatgataggaactatcaatactacgcagacctccgtagaacggcctattccactatcaccgaggacaacgtcaagaacacgctgtctacacaagtcggacacgccgtagaacgactgacgacgacgtctagtcttattgtgtgcgagagtactagtcgggttatggtactagttagagggagtgtcg

SEQ ID NO: 1142 - DNA, 549 bp, Homo sapiens
  misc_feature: GYAE6OF01CI1M5.18.16.B05.1.454.CMB.1.raw
  modified_base (402)..(402): a, c, t, g, unknown or other
  misc_feature (402)..(402): n is a, c, g, or t
  modified_base (427)..(427): a, c, t, g, unknown or other
  misc_feature (427)..(427): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaactacctatgtctttgctacgtgggtcccgccagacctccaggcgaaggggccaggagtggctgtctagttattcatatgatggaactatcaatactacgcagactcgtggaacggccgtattcaccatccnccgaggacaagttccgaaggaaccncgctcgtcctactaacaagtcggactacgcctagaacgaactacgacgacgacggtctagtactagttagtgtagcgagtagtacttacgtggtacttgtagtacttaggagggtatagtcg

SEQ ID NO: 1143 - DNA, 582 bp, Homo sapiens
  misc_feature: GYAE6OF01CQGE0.18.16.B05.1.454.CMB.1.raw
  modified_base (275)..(275): a, c, t, g, unknown or other
  misc_feature (275)..(275): n is a, c, g, or t
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (452)..(452): a, c, t, g, unknown or other
  misc_feature (452)..(452): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaacgtggtggaggtccgggggagcgtggtcctggccgtgggacgtcgctgagactctcctgtgcagcctgtggattccaccttnaactacctatgtctttgcacgtcgggtccncagacctccgaggcgaaggggccaggagtggctgtctagttattnatatgataggaaattaatacaaatactacgcacgtacctcggtaggaacggcctacttccacctactccgtaccgaggtaacctaagttaccgaagaaaccncgtactcgtactacaacaagtcggacacgctaagacgaactacgaccgacgacggtctagtacttaattacgttgtgacgagtagtacgtaggttcggttactggtacgtagttgaaggtagtacgtcgg

SEQ ID NO: 1144 - DNA, 708 bp, Homo sapiens
  misc_feature: GYAE6OF01BHCOV.18.16.B05.1.454.CMB.1.raw
  modified_base (320)..(320): a, c, t, g, unknown or other
  misc_feature (320)..(320): n is a, c, g, or t
tcagtacgagtatgcacgaccggtgctcgatttagagctcacgtaaggggctggggagaggacgcccagcacttggaagtcgccggtgtttccagttcggtgatccagcactgaacacagagactcaccgatgggagtttggggctgaccttgggttttcctcgttgcttcttttaagaggtatccagtgtcaggttcaactggtggaggtccggggagcgtggtcctgcctgggctcgctgagctctcctgtgcagcctcgtggtactttcaccctttcaaacttaccctatcgtccttttgcctacgtcggggtcccncccaagccctaccgagggaccgaacggggggcccaaggacggttcgggccttggttctaagttttattccaatagttgaattaggtaaaacttaaatcctaaattacctaaccgacaacggtacccgttcccgggtaaggaaccggggtcctaactttaccaaccctacttccgttaccgaacgggtaacctaaacgtttaacccgaaggtaaacccgaccgtccgttacggttacctaaccgttaaacctaaagttccggaacgacgtccgtagtaacgaacgtacgaacccgtaccgacggtacctagttaccttagtttactggtacgacgtagtagtacgtacgttggtaactggttacgtagttacgagggtaagtgtaccgg

SEQ ID NO: 1145 - DNA, 646 bp, Homo sapiens
  misc_feature: GYAE6OF01AOSLD.18.16.B05.1.454.CMB.1.raw
  modified_base (307)..(307): a, c, t, g, unknown or other
  misc_feature (307)..(307): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaactgggtggagtccgggggagcgtggtcctggccgtgggactcgctgacgctctcctgtgcagtcctcgtggacttccaccttcaatacctatcgtctttgctacgtcgggtccnccagacctccgaggcgaacggggccaggagtcggctgtctaagtttacttacattatgaatagaaacttatactaaataccgtacgcaacgtcgtaccggtaggaacgggtcctaattaccactacgtccgtaccgaacggaactaacgtaccgaacggtaaccacgtcgtacgtacttacaacgtaagtcggtaacacgtcgtaagacgtaacgacgtaaccgaacgtaccggtacttacgttacgttagtttagtacggtacggacggtaaggtacgtaacgttcggttacggttaccttggttacggtacgttaacggacgggtagaaccgttcgg

SEQ ID NO: 1146 - DNA, 672 bp, Homo sapiens
  misc_feature: GYAE6OF01EI99A.18.16.B05.1.454.CMB.1.raw
  modified_base (257)..(257): a, c, t, g, unknown or other
  misc_feature (257)..(257): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaacgtgggtggacggtccgggggaggcgtggtccgtggccgtgggacgtcgctgagctctcctgtncagcctcgtgacttcaccttacaatacctatcgtctttgctacgtcgggtcccgaccaagtacctaccgaggggccgaaacggggggcccaaggaggttcggcttgtacgtaagttttatttcaagtttatggaacgttaggaaaacttaataccaaattaacctaccgacgaacgtacccgtaccggtaaggaacgggtccctaagtttcccaacccgtacttacccgtaccggaacggtaactaacgtaccgaaggaaccacgtcttgtacctactaacgaacgtgaaccagaccgtagaacgtaacgtagaaccgacgacgtactagttacttagttacgttcgtagacggaagtagtaaccgttaacgttcgggttatggttcgtaacgtagggtaacggaagtcgtacgg

SEQ ID NO: 1147 - DNA, 666 bp, Homo sapiens
  misc_feature: GYAE6OF01CUMSU.18.16.B05.1.454.CMB.1.raw
  modified_base (322)..(322): a, c, t, g, unknown or other
  misc_feature (322)..(322): n is a, c, g, or t
  modified_base (352)..(352): a, c, t, g, unknown or other
  misc_feature (352)..(352): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaactggtggaggtccgggggagcgtggtcctgcctggggacgtcgctgagactctcctgtgcacgccctcgtggtacttcctacccttacaaacttaccctatcggtccttttgcctacgttcggggtcccncccagacctccgaggccgaaggggccaggnggtggctgtctagttattcatatgatacggaaacttaatacaaatactacgctaacgactaccggaggaacgggcctattaccacctactcctaccgaacgggtaacctaacgttaccgaacggaacctaccggtcttcgtacctactaaccaagtcggaaccacgtaccgtaggaacgtaacgtacggaccgaaccgtacggtacttcggtacttaacgtttagtcggttacgacggtaacggaacgttacggttaacggttcggggtttaactcggttaacgttagttacgggaagggtacgtaagttccgg

SEQ ID NO: 1148 - DNA, 736 bp, Homo sapiens
  misc_feature: GYAE6OF01D6K0H.18.16.B05.1.454.CMB.1.raw
tcagtacgagtatgcacgaccggtgctcgatttagagctcacgtaaggggtcgtggggagaggagcccagcacgtggaagtcgccggtgtttccattcggtgagtccagcactgaacacgagacggactcaccatgggagtttcgggctggtaccgttgggttttcctcggttgacttacgttttaaggaggttactccagtcgtctaggttcacgtgggtggaggtccggggagtcgtggtcctggccgtgggacctcgctgagtccttcgtccgtgtcgcacgtccttggtggtacttcctacctttactaaacttccgtagttcgtactttcgaccgtaacggtccgggtcccgaccgtacgtaccgtcgaagggtaccggtaacggggcctaggtacggttcggtacgttacggtaccgttaagttttacgtttacgaagttagttacggtaaacgtacggtaaaactacgtaacttaacgtaccgtacgacgtaacgtaccgtacggtaggaacggtcctattaccacgtactacctacggaacgtactagtaccgaagaccgtacgtcgtactaccgtaacgtaactaagtacgtactacgtacgtaagaacgaaccgtacgaaccgtacgcgttactacgttacgttagtacgtggtacgtacggtacgtaggttaacgtacggttagggttactaggttaccgtaggttacggagggtaactcgtcgg

SEQ ID NO: 1149 - DNA, 675 bp, Homo sapiens
  misc_feature: GYAE6OF01DL7EB.18.16.B05.1.454.CMB.1.raw
  modified_base (319)..(319): a, c, t, g, unknown or other
  misc_feature (319)..(319): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgtacctgggttttcctcgttgcttctttaagaggtatccagtgtcaggttcaactgggtggaggtccgggggagcggtggtcctgccgtgggacgtcgctgatactctcctgtcgcacgtcctcgtggtacttcctaccttacaacttacctaattcgtctttgcctacgtcgggtaccncctagacctccgagggcgaaacggggcctaggacgtcggcttgtactaagtttattcgatactagtacgtaggtaaactaatactaatactacgacgagtaccgtcggtaggaacgggtacctaattccaccgtattcccgtaaccgtagggtaaaccctaagttacccgaacgggtaaacctccgtcgttacgtctaacgtaactaagtcggaactacgtccgtaagaacgaacgtacggaaccgcgtacggtacgttattaccgttaattagtttcggacgtacggtagtaacgtacggttacgtacgggttacttaggtggttaacgtacgggtaaggtaatacgttaccggg

SEQ ID NO: 1150 - DNA, 555 bp, Homo sapiens
  misc_feature: GYAE6OF01AGZ4S.18.16.B05.1.454.CMB.1.raw
  modified_base (259)..(259): a, c, t, g, unknown or other
  misc_feature (259)..(259): n is a, c, g, or t
  modified_base (399)..(399): a, c, t, g, unknown or other
  misc_feature (399)..(399): n is a, c, g, or t
  modified_base (537)..(537): a, c, t, g, unknown or other
  misc_feature (537)..(537): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactgggtggaggtccgggggaggcgtggtcctgccgtgggacgtcgctgagactctcctgtgcagcctntggattcaccttcagtaactactacatggcctggatccgccaggctccgagggagggctggagtacgtctcatacatcagtaacactaggaaactaccatactactacgcagtactctgtggacggggcctattccaccntcgaccgagggaccaacgacccaaggacgctacactattatctgacagtatcgactcgaccctggacgacggcgaggacctcggtccgtttacacgttgcgcggagacgacgtcccggagtacgtcgcgtcgggaccnccgggtgtacggttaccg

SEQ ID NO: 1151 - DNA, 545 bp, Homo sapiens
  misc_feature: GYAE6OF01B78ZG.18.16.B05.1.454.CMB.1.raw
  modified_base (260)..(260): a, c, t, g, unknown or other
  misc_feature (260)..(260): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaacgtggtggaggtccgggggaggcgtggtcctgccgtgggacgtcgctgagactctcctgtgcagcctntggattcaccttcaatacctatgctttgcactggtcccgccagacctccaggcaaggggccaggagtggctgtctagtttattcatatgatggaaactaagtacaatactacgcagactccgtaggaacggccatcaccatctcagggacaattaccaggaacacgctgtctctacaaagtcggacacgcctagaacgtaactacggacgacgacggctgttactattagttgtagcgagagacttacgtgggttactggtagtattcggagggtaagtagtacg

SEQ ID NO: 1152 - DNA, 767 bp, Homo sapiens
  misc_feature: GYAE6OF01C1RP4.18.16.B05.1.454.CMB.1.raw
tcagtacgagtatgcacgaccggtgctcgatttagagctcacgtaaggggctgggagaggagcccagcactggaagtcgccggttgtttccattcggtgatcagcactgaacacgagaggactcaccagtggtagtttgggctgaccgttgggtttttcctcgtttgtcttacgttttaagaggtatccagtgtcaggttcacgtggtggaggtccggggaggtcgtggtcctggccgtgggacgtcgctgagtctctccgtgtgcacgccctgtaggtacttcctaaccctttacaaacttaccgttattcggttcctttcgccgtaccgttcggggtccccgaccaacggtacccgtccggaacgggtaccggaaacggggcctaagggacggtcggtacgttcgtacgttaagtttacttactaattagtagtaagtaacgtaaactaatactaaactactaacgactaacgtaccgtaccggtaggaaacgggtcctaacttacccaacctacgtacccgtaaccggtaaggtaaacctaacgttaccgaaacggtaaacctacggtaccttacggtaacccttaacgaaacgtaaacgtcgaacgtaccgacgttaaggacgtaaaccgtacggaccgtaacgacgttacgttacgttaattacgtttaagtcggtagacgggtaataacggttaccggttacggttacgggtttacttagggtcgttaaacgtacgggtaagggtaacgtacgttaccggg

SEQ ID NO: 1153 - DNA, 751 bp, Homo sapiens
  misc_feature: GYAE6OF01CRUSZ.18.16.B05.1.454.CMB.1.raw
  modified_base (159)..(159): a, c, t, g, unknown or other
  misc_feature (159)..(159): n is a, c, g, or t
  modified_base (238)..(238): a, c, t, g, unknown or other
  misc_feature (238)..(238): n is a, c, g, or t
  modified_base (267)..(267): a, c, t, g, unknown or other
  misc_feature (267)..(267): n is a, c, g, or t
  modified_base (380)..(380): a, c, t, g, unknown or other
  misc_feature (380)..(380): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagttggctgacctggtttcctcgttgcttntttaagaggtatcagtgtcaggttcaatggtggagtccgggggagcgtggtcctgcctgggactcgctgaagctctccngtgactcgcctgtggaattcaccctttanaacttacctagtgtcctttgctacgttgggcccgccaaggacctaccgagggaccgaaaagggggccctaaagggaggttcgggccttgggtacctaaggtttaccttttaanaagtatagtaagtaacgtaaactaactaataaacttaaccgacgactaacgtaaccgtacggtaacggaacggtcctaacgttaccgaacgtaccgtaccgtaaccgaacggtaaacctaaccgtaaccgaaacgtaaaccgtacgaccttacgtacctaacgtaaacgaacggtacggtaacctaacgtaccgtaaaggtaaaccgtaacggtaaccggtaaaccgaacggttaaccgtacgttacgttaacgtttaagttaacggtacggtacgtaacgggtaaaggtaacgttaaccgttaacggggttagggtttaactagggttaacggtaacgttaacgggaaagggttaacgttaaccgtacgg

SEQ ID NO: 1154 - DNA, 647 bp, Homo sapiens
  misc_feature: GYAE6OF01A41V3.18.16.B05.1.454.CMB.1.raw
  modified_base (312)..(312): a, c, t, g, unknown or other
  misc_feature (312)..(312): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaactggtggaggtccgggggaggcgtggtcctggccgtgggacgtcgctgagactctcctgtcgcagcctcgtggacttccaccttacaattacctatcgtctttgcctacgtcgggtccnccagacctccgaggcgaacgggccagagtggctgtactagtttattcatatgtaataggaaactaatactaatactacgacaacgtaccgtcggtaaggaacggtcgtacttaccgacctacgtcctaccgaacgggtaacctaagttacccgaacggtaaccaccggtcttacgtacttaaccgtaacgtaaacgtcggaaccacgtaccgtacgaacgtaacgacgaaccgacgacggtcgtattacgtattacgttcggtacgacggtacgtacggtacgttacggttacgggttacttggttacgtagttacggaagggtagtacgtccgg

SEQ ID NO: 1155 - DNA, 637 bp, Homo sapiens
  misc_feature: GYAE6OF01CS805.18.16.B05.1.454.CMB.1.raw
  modified_base (320)..(320): a, c, t, g, unknown or other
  misc_feature (320)..(320): n is a, c, g, or t
  modified_base (378)..(378): a, c, t, g, unknown or other
  misc_feature (378)..(378): n is a, c, g, or t
  modified_base (520)..(520): a, c, t, g, unknown or other
  misc_feature (520)..(520): n is a, c, g, or t
  modified_base (555)..(555): a, c, t, g, unknown or other
  misc_feature (555)..(555): n is a, c, g, or t
  modified_base (628)..(628): a, c, t, g, unknown or other
  misc_feature (628)..(628): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatgggagtttgggctgaccttgggtttttcctcgttgcttcttttaagaggtatcctagtgtcaggttcaacgtgggtggacgggtccgggggaggcggttggtcctggccgttggggacgtcggctggacgactctcctgtgcagcctcgtggtattccaccttacaatacctatgtcttgcacgtcgggtccncgacgaccgtccaggcgaacggggccaggacgtggctagtcgtagtttattcgattangtagtaggtaaactaatacaaatacgacgagtaacgactaccggtaggaaagggtcctagttaccaccgtaacttcaccgtaacggtacctaacgttaaccgaacggtaaccctacgcgttcgtactacgtaacaagcgaanacgtacgtagaagaccgtagaacgaccaacgggtntacggttattagttacgtgtacggacgagtagttaccgtaagttggtttaagagttacgagttaggaagggtntacgtacgg

SEQ ID NO: 1156 - DNA, 717 bp, Homo sapiens
  misc_feature: GYAE6OF01BL0HE.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggacttcaccttcaatacctatgtctttgctactgggtcccgccagacctccgaggcgaacggggccaggaggtcggctgtctagtttatttcattactgataggtaaactaatacaaatactacggcacgaccgtaccgtaggaacgggtacctacttaccaaccgtaacttcccgtaccgaacggggtaacctaaacgtttacccgaagggaaacctaaccgtccgttacggttacccttaccgtaaaccgtaaaccgttcgggaaccacggtacccgtaggtaaacggaaacccgttagggaacccgtaaccggacccggtacgttacggttaaccgtttaatttacgtttggtacggtaccggtaaaggtacggtaaccgtttacgggtttacggggtttaacgttacggttagggttacgttaacgggtaaacggggtaagtaacgttaacccggg

SEQ ID NO: 1157 - DNA, 552 bp, Homo sapiens
  misc_feature: GYAE6OF01CZV0Q.18.16.B05.1.454.CMB.1.raw
  modified_base (272)..(272): a, c, t, g, unknown or other
  misc_feature (272)..(272): n is a, c, g, or t
  modified_base (303)..(303): a, c, t, g, unknown or other
  misc_feature (303)..(303): n is a, c, g, or t
  modified_base (327)..(327): a, c, t, g, unknown or other
  misc_feature (327)..(327): n is a, c, g, or t
  modified_base (361)..(361): a, c, t, g, unknown or other
  misc_feature (361)..(361): n is a, c, g, or t
  modified_base (485)..(485): a, c, t, g, unknown or other
  misc_feature (485)..(485): n is a, c, g, or t
  modified_base (488)..(488): a, c, t, g, unknown or other
  misc_feature (488)..(488): n is a, c, g, or t
  modified_base (503)..(503): a, c, t, g, unknown or other
  misc_feature (503)..(503): n is a, c, g, or t
  modified_base (544)..(544): a, c, t, g, unknown or other
  misc_feature (544)..(544): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggaggtccgggggaggcgtggtcctgccgtgggacgtcgctgagactctcctgtgcagcctctggattccaccttnaaactacctatgtctttgctactgggtcccnccagactccaggcaaggggccagngtgctgtcagttattcatatgatggaaacttaancaaattactacgcagtacctcggtaggaacgggccaagttccaacctagtcctaccgagggactaacgttccgaagaaccacgctagtcctactaacaagtggacagcctagagactgacgacncgntgtactattatgtgngacgagtactacgttggttaactgtacgtacttggaagggngtaatcgg

SEQ ID NO: 1158 - DNA, 680 bp, Homo sapiens
  misc_feature: GYAE6OF01EG78C.18.16.B05.1.454.CMB.1.raw
  modified_base (248)..(248): a, c, t, g, unknown or other
  misc_feature (248)..(248): n is a, c, g, or t
  modified_base (616)..(616): a, c, t, g, unknown or other
  misc_feature (616)..(616): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcacatggagtttgggctgacctgggttttcctcgttgctcttttaagaggtatccagtgtcaggttcaactggtggagtccgggggagcgtggtcctgccgtgggacgtcgctgagactctcctgtncagcctctggtactttccaccttactaacttacctatgtctttcgctacgttcgggtcccgaccgacgacctccgacggacggaacgggggcccaaggacggtcgggcttagtctaaggttttactttacgtatataggtagtaggtaaactaaattcgaaaattactaaccggtacaacgtacccgtccgggttaaggaacgggtcccgtaatttcccaacctacttacccgtaccgtaacgggaaccttaacgtaccgaacggaaccgtaccgtcgttacgtacctacgtaacaacgtacggacacgtacgtacgaacgaacgtacgaaccgaccgacgtccgtagttactatttgttacgtacgnggaacgtagtacgtacggtttacggttacgtaggttacgtacttacggaggtaagtgttaccgg

SEQ ID NO: 1159 - DNA, 791 bp, Homo sapiens
  misc_feature: GYAE6OF01CUW82.18.16.B05.1.454.CMB.1.raw
  modified_base (314)..(314): a, c, t, g, unknown or other
  misc_feature (314)..(314): n is a, c, g, or t
  modified_base (342)..(342): a, c, t, g, unknown or other
  misc_feature (342)..(342): n is a, c, g, or t
tcagtacgagtatgcacgaccggtgctcgatttagagctcacgtaaggggctgggagaggagcccagcactggaagtcgccggtgttccattcggtgatcagcactgaacacagaggactcaccatggagtttgggctgaccttgggttttcctcgttgcttcttttaagaggtatccagtgtcaggttcaacgtgggtggaggtccgggggagcgtggtcctggccgtgggacgtcgctgagtactctcctggtgcaggcctcgtggacttccacctttacaactaccttatgtcttgcctacgtcgggtccncgacgactccgaggccgaagggccaggngtgactgtactagtttacttacattagtgtaacgtacggtaaacttaatacgtaaattaaccgtacgctaacggaccgttaccgggtaggaaaccggtcccgtacttacctaccctacgtaccgtaccgtaacgggtaaccctaaagttaccccccggaaggtaaacccgtaccggtacgttaccggttaccgttaaccgtaaaccgtaaacggtaccggtaaacggtaccgtaaccgttaacggaaaccggtaacccggtaaccggtaacccggtaacccggtaaccgggttaccgttacgttaacgtttaacgtttacggttacggttaacgggttaccggaacggttaaccggtaaaccggtttaccgggtttacggggttaaccgttacgggttaacggttaacggttaacgggaacggggtaaacggttaacggttaacccggg

SEQ ID NO: 1160 - DNA, 523 bp, Homo sapiens
  misc_feature: GYAE6OF01CMC53.18.16.B05.1.454.CMB.1.raw
  modified_base (259)..(259): a, c, t, g, unknown or other
  misc_feature (259)..(259): n is a, c, g, or t
  modified_base (299)..(299): a, c, t, g, unknown or other
  misc_feature (299)..(299): n is a, c, g, or t
  modified_base (370)..(370): a, c, t, g, unknown or other
  misc_feature (370)..(370): n is a, c, g, or t
  modified_base (390)..(390): a, c, t, g, unknown or other
  misc_feature (390)..(390): n is a, c, g, or t
  modified_base (410)..(410): a, c, t, g, unknown or other
  misc_feature (410)..(410): n is a, c, g, or t
  modified_base (443)..(443): a, c, t, g, unknown or other
  misc_feature (443)..(443): n is a, c, g, or t
  modified_base (465)..(465): a, c, t, g, unknown or other
  misc_feature (465)..(465): n is a, c, g, or t
tcagtacgagtatgcacgaccggtgctcgatttagagctcacgtaagggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaacgtggtggaggtccgggggaggcgtggtcctgcctgggacgtcgctgagactctcctgtgcagcctntggattcaccttcaatacctatgctttgcacgtgggtccnccagacctccgaggcgaaggggccagagtggctgtcagttattcatatgataggaactatcaatactacgnagactcgtgacggcatcacntcacgagacaatccgagacncgctcgtctacacaagtgacagcctagaagacncgacgacacggctgtactattntgtagcgagagactcggtgggttacttggtacgtacgttacgaagggtgtaagtccgg

SEQ ID NO: 1161 - DNA, 561 bp, Homo sapiens
  misc_feature: GYAE6OF01CSEQ4.18.16.B05.1.454.CMB.1.raw
  modified_base (272)..(272): a, c, t, g, unknown or other
  misc_feature (272)..(272): n is a, c, g, or t
  modified_base (302)..(302): a, c, t, g, unknown or other
  misc_feature (302)..(302): n is a, c, g, or t
  modified_base (346)..(346): a, c, t, g, unknown or other
  misc_feature (346)..(346): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggaggtccgggggaggcgtggtcctggcctgggacgtcgctgagactctcctgtgcagcctctggattcaccttanaatacctatgtctttgctacgtcgggtccnccagacctaccaggcgaaggggccaggagtggctgtctagtttnttcatatgataggaacttaatcaatactacgcacgactcgtagacggccgaattcacatctacgaggacagttccaagaacacgtctcgtctactaacaagtcgacacgaccgtagacgaacgtacgaccgacgacggtactcgttactagttagtcgtgacgtagacgtagttacgttacggttactggtacgtacgttgacggtagtaagtcg

SEQ ID NO: 1162 - DNA, 780 bp, Homo sapiens
  misc_feature: GYAE6OF01CNFJ0.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaacgtggtggaggtccgggggaggcgtggtcctggccgtgggaccgtcgcgtgacgacctctcctgtagcacgcctcgtggacttccaccttacaactacctatcgtctttagcctacgtcgggtcccgccagacctccgaggcgaacggggccaggagtggctgtctagtttattacgatatgagtaggaactaatacgaactactacgactaacgtaccgtaccgtaacggaacgggtaccgtacgttacccaaccgtacttacctaccgtaacggggaacctaaacgttacccgaaacggtaaaccgaccggtacccgttacggttaccctaccgtaaacgtaaacgtacggtaaccgtaacggtacccgttaaggaaccgtaaaccgtaccgggtaacccggtaaacccggaccggttaccggtttacggttaccttttaaacggtttagtttacgggtacgggaccggttaaacgggtaaccggttaaccgtttacccgggtttaaggggtttaaccgtttacgggttaacgggttaacggtttaccgggtaaacggggttaaacgtaaccggtttaacccggg

SEQ ID NO: 1163 - DNA, 596 bp, Homo sapiens
  misc_feature: GYAE6OF01A4PKZ.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaacgtggtggaggtccgggggaggcgtggtcctggccgtggggacgtcgctgagactctcctgtgcagcctctggacttcaccttcaatacctatgctttgcacgtcgggtccgccagacctccgaggcgaacggggccaggacggtggctgtcagtttacttcatatgataggaaactaatactaataccgtacgacacgacctccggtaggaacgggccgtattccacctatcctaccgacgggacaacttaccgaaggaacacgctacgtcctactaacaatcggaacacgcgacgaacgactacgaccgacgaccggtctagtacttattagttagtcggacgtaggacgtacgttacggttaggttactcggttgtacgttaggaagggtagtacgttacgg

SEQ ID NO: 1164 - DNA, 750 bp, Homo sapiens
  misc_feature: GYAE6OF01DMCVV.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatgggagtttgggctgaccttggggtttttcctcgttgcttcttttaagaggtatccagtgtcaggttcaacgtgggtggaggtccgggggagcggtggtcctggcctgggacgtcgctgagactctcctgtgcagcctctggattcaccttacaactacctatcgtctttgctacgtcggtcccgccagacctccgagggacgaacggggccaagaggtggctgtctaagttatttcgattagagtagtaggtaaacttaatacgtaaataaccgtaacgacctaacggaccgttaccgggtacggtaaacggggtcccgtacttacccgaacccgtacttacccgtaaccggtaacgggtaaacctaaaccgttaccgaaacgggtaaaccaccggtacgttacggttaccttaacctaaacgtaaacggttacggaacctacggaccgttaaacgggaacggtaaccgttaacggtaaccggtaacggaccggtcgttacggttaccctttaagtttacggttgtacggtcggaaacgtaacggttacggtttaaccggttacgggtttaacgttacggtttacggtaatttacgggaaacggggtaagttacgttaccggg

SEQ ID NO: 1165 - DNA, 740 bp, Homo sapiens
  misc_feature: GYAE6OF01APX8L.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcacatggagtttgggctgacctgggttttcctcgttgcttcttttaagaggtatccagtgtcaggttcaacgtgggtgggacgggtccgggggaggtcggtcggtcctggccgtgggacgtcgctgacgactctccgtgtgcacgtcctcgtggtacttcctaccttcaacttacctatgtctttcgacctacggtcgggtacccaccgtacgtaccgtccgagggaccggaacggggccaagggtaggtcggtcgttacgtacgttaaggtttactttacgaattagtaggtaactaggtaaaaccttaataacctaaagtaaccgtacgacgtaacgtaccgttacggtaaggaaccgggtactaactaccaacctcgttaccgacgtaagggacctaactaccggaacgaacctcgtacttcgtacttaactaaacgtaagtcggaacctacgtaacccgtaggtaaccgtaacgtacggtaccgtaaccgtacgggttacgttagttaccgttaatttacggttcggacggtacggtaacgttacgtaaacggtttcggttacgggttagttacggtacggttaacggtaggtaacgggtaagttacggtcccgg

SEQ ID NO: 1166 - DNA, 567 bp, Homo sapiens
  misc_feature: GYAE6OF01CHKMX.18.16.B05.1.454.CMB.1.raw
  modified_base (299)..(299): a, c, t, g, unknown or other
  misc_feature (299)..(299): n is a, c, g, or t
  modified_base (365)..(365): a, c, t, g, unknown or other
  misc_feature (365)..(365): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgtactttgctacgtcgggtccnccgtacgacctccgaggcaaggggccaggacgtggctgtcagttattcatatgataggaaactaancaaatactacgcagactcgaggaacggccattccactatctaccgaggactaatccaaggaacacgctgtactactaacaagtcgacacgctagaacgacgtacgacgaacgacgctacgtactattagtgtcgacggtaagtaacgtacgttacggttacgggttactggttacaagttacggaagggtagtaacgttcgg

SEQ ID NO: 1167 - DNA, 543 bp, Homo sapiens
  misc_feature: GYAE6OF01CIR67.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggaggtccgggggaggcgtggtcctgcctgggacgtcgctgagactctcctgtcgcagcctctggattcacccttcaatacctatgctttgcacgtgggtcccgccagacctccaggcaaggggccagagtggctgtcagttattcatatgataggaactaatacaatactacgcacgactaccgtggaacgggccattccaccactcctaccgagggacctaagttacccgaggaaccacgctcgtctactacaatcggacagcctgaacactagacgacgacgactgtacttattgtgtgacgtagagtactcgtggttatgtagtacgttagagggtgatccgg

SEQ ID NO: 1168 - DNA, 787 bp, Homo sapiens
  misc_feature: GYAE6OF01BITV9.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccgttgggttttcctcgttgtcttcttttaagaggtactccagtgtctaggttcaacgtgggtggaggtccggggagcgtggtcctggcctgggactcgctgacgacctctcctgtcgccagtcctcgtaggtactttcccgtaccttacaaacttaccctagttcggtcctttggccgtacgttccgggtccccgaccgacgtaccgtaccggagggtaccggaacgggggtacccaagggtacggttcgggtcttaggtacccgtttaaggttttaacctttacgaagtttacgtagtaaacgttacggtaaaacttaaacgttacgaaaacttacccgtacggaccgtaacgtacccgttacgggtaacggaaccgggtcctaacttaccaacccgtacttacccgaaccggtaacgggtaaacttaacccgtaaccgaacggtaaaccctacggtaccttagttacctaaccgtaaacgtaaacgtcggaaccaccgtacgtacggaactaaccgtacgtaaccggaccgtacggtacttagtaccttagttgttacgccggacgtaacggtacgttaccgttacggttacgggttaactagggttacgtaccgttagggtaacggtaattacgggtacccg

SEQ ID NO: 1169 - DNA, 718 bp, Homo sapiens
  misc_feature: GYAE6OF01BFHFS.18.16.B05.1.454.CMB.1.raw
  modified_base (488)..(488): a, c, t, g, unknown or other
  misc_feature (488)..(488): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagaggtatccagtgtcaggttcaacgtggtggaggtccgggggaggcgtggtcctgcctggggacgtcgctgagacctctcctgtcgcagcctcgtggactttccaccttacaaacttaccctatcgtctttgctacgtcgggtccgccagacctccgaggccgaacggggccaaggacgtggctgtactagtttatttcagtacgtgtaataggaaacttaatactaaatactacgacagtacgtccggtaggaacggtccatttacacctatcctaccgaaggaacctaacgttaccgaacggaactaccgtacgttntaccgtactaaaccgtaaagttcgggaacctacgaccgttaaggaacgtaaacgtacggtaaccgtaaccgtacggtacgttaacgttaccgttaagttttacgttacggtaacggtaccggtaaagggttaacccggtaacggttttaacggttacgggggttttaaccttacgggttaacgttaaccggtttaaagggaacggggttaaacgttaacgttaccccggg

SEQ ID NO: 1170 - DNA, 583 bp, Homo sapiens
  misc_feature: GYAE6OF01DOY6Q.18.16.B05.1.454.CMB.1.raw
  modified_base (262)..(262): a, c, t, g, unknown or other
  misc_feature (262)..(262): n is a, c, g, or t
  modified_base (469)..(469): a, c, t, g, unknown or other
  misc_feature (469)..(469): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaactggtggaggtccggggggaggcggtggtcctggccgtgggacgtcgctgagactctcctgtgcagcctntggattccaccttcaatactatgtcttgcacgtcggtcccgccacgacctccgaggacgaaggggccaggaggtcggctgtctagttattcatatgatagtaactaatacaatactacgcagctcggaggaacggcgtactccacatccgaccgaacggactaacgttccaaggactaccgtctgttacctactaacaagtcgaacncgtacctagacgtaacctgaccgacgcgtactcgttactaattatcggtagtcggaaggactacgttcggttcgggttactggttacgttaagttggaacggtagtaacgtcgg

SEQ ID NO: 1171 - DNA, 829 bp, Homo sapiens
  misc_feature: GYAE6OF01CJVHP.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgtaccgttgggttttcctcgttgtcttacttttaagaggtatccgagtgtcaggttcaagtgggtggacggtccgggggagcgtggtcctgccgtgggacgtcgctgagctctcctgtgcacgcctgtgacttccaccttacaacttacctatcgtctttgccgtacgtcgggtcccacgacgtaccgtccggaaggtaccggaacgggggccaagggtcggtcggtcttacggttacgttaagttttactttacctaagttatacggtaacgttaaggtaaacctttaaacgtaacctaaaacgttaacccgtaacgtaaccgtaacggtaaccgttacccgggtaagggtaaacccgggtcctaactttacccgaacccttacgtaccccgttaaacccgggaacggttaaaccctaaaccgtttaacccgggaaacgggtaaacccctacgggttaccgttaaccgttaacccgttaaccgttaaaaccgtaaacggttacggaacccgtaaccgtcggtaaacggtaaaccggtaaccgtaacgggtaacccgtaccggtaacggttcgttacgtttaaccgtaacgtttaggttacgtacggtaacggtaacggtaacgttaccggtttagggttacggttacttgggttacgtaacggttaggaacgggtaagtacgttccggg

SEQ ID NO: 1172 - DNA, 773 bp, Homo sapiens
  misc_feature: GYAE6OF01EPW3G.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagaggtatccagtgtcaggttcaacgtggtggaggtccgggggagcgtggtcctgccgtgggacgtcgctgagacttctcctgtgcagtcctcgtggtacttcaccttacaactacctatgtctttgctacgtggtccgccagactccgacggacgaacggggccaggagtcggctgtctagtttattcatatgtatagtaaactagtacaatacgtacgacagtaccgtcgtaggaacggtccgtaattaccaacctacgtaccgttaccggaacgggtaacctaaacgttacccgaaaggtaacctaccggtaccgttacggttaccttaaccgttaaaccgtaaacgtttacgggaacccgtacgggtacccgttaacgggaaaccgtaaacccgtaccggggtaacccgtaaccgggtacccgggtacctttacggtttaaccctttaaagttttaaccggtttcggtaaccggttaacgggtaaacggttaaaccggtttaaccggtttaacccgggtttacggggttttaaccgttcgggtttaacggttaaccggtttaacgggtaaaccgggggttaagtaaaccggtttacccggg

SEQ ID NO: 1173 - DNA, 614 bp, Homo sapiens
  misc_feature: GYAE6OF01DIK40.18.16.B05.1.454.CMB.1.raw
  modified_base (306)..(306): a, c, t, g, unknown or other
  misc_feature (306)..(306): n is a, c, g, or t
  modified_base (475)..(475): a, c, t, g, unknown or other
  misc_feature (475)..(475): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatgggagtttgggctgacctgggttttcctcgttgctcttttaagaggtatccagtgtcaggttcaacgtgggtggagtccgggggaggcgtggtcctgcctgggacgtcgctgagactctcctgtgcagcctctggattcaccttcaactaccctatgtctttcgctacgtcggggtccnccagacctcccgagggcgaaggggccaggaggtggctgtctagttattcgattatgagttaggaaacttaatctaaataacctacgactaacgacgtccggtaggaaccgggcctaagttccaacctactccgtaccgaagggtaacctaacgttccgaacggaaaccnccggtactggtacctactaactaagtcggacacgccgtagaactaacgtacgacgacacggtctgtactagttgtgtcggacgaggtacgtacgttacggtgggttaactggtagtaacgttggaagggtgtagtaccg

SEQ ID NO: 1174 - DNA, 805 bp, Homo sapiens
  misc_feature: GYAE6OF01EJH35.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggtagtttgggctgaccttgggttttcctcgttgcttcttttaagaggtactccagtgtctaggttctaacgtggtggacgggtccgggggaggtcgtcggtcctgccgtggggtacgtcgctggacgtacctcctccgtgtcgcacgtcctcgtggtacttccacctttacaacttacctatgtctttcgactacgtcggggtcccaccgacgtacctccgaagggtaccggaacggggtaccaggtacggtcggtacgtttcgtaccgttaagttttacttttacgaagttagtacggtaacgttaacggtaaaaccttacgttaactaaaacgttaacccgttaacgaccgtaaacggttaccccgtaaccggggtacgggtaaaacccggggtaccgtaaccgttttacccaacccgttaaccttaccccggtaacccggtaacggggtaaacccttaaacggttacccggaaacgggtaaacctacccgttcgtttacccggtaaccttaccgtaaaacttaacgtcggtaaccacggtacgtaacggtaacgtaacgtccggtaaccgaccgtaccggtgttacgttacttagtttacgtcgttagggacctaggtacgttacgttacgttacggtttacgtagttacgtagtacggaaggtgtactaccgg

SEQ ID NO: 1175 - DNA, 866 bp, Homo sapiens
  misc_feature: GYAE6OF01C4J4X.18.16.B05.1.454.CMB.1.raw
  modified_base (243)..(243): a, c, t, g, unknown or other
  misc_feature (243)..(243): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtctaggttcaacgtggtggaggtccggggagcgtggtcctgccgtgggacgtcgctgacnctctccgtgtgcagcctgtggtacttccaccttacaacttaccttagtcgtctttcgccgtaccggttcggggtacccccgacctaacggtacccttacccggaagggacccgggaaacggggggaccctaaggggtacgggttcgggtaccgtttacgggtttaccgttaaggtttttacttttaccgaagttttaagtacggtaaacgttacgggtaaaacctttaaactaaccgtaaacgtttaacccgtaaccggaccgtaaacgggtacccggttacccggggtaagggtaaacccgggtcccttaacgttaccccgaacccgttaaccttaccccggtaacccggtaacgggtaaacccttaaaccgtttacccggaaaacgggtaaacccgaccggttaccgttacggttaacccttaaccgtaaacgtaaacggttcggaaccgtaaccggtaccgtaaggtaaccggtaaccgttacggaacccggtaaccgtacgggtccttagttacctttaagtttacggtacggtacggtaacggtaggtaaccgttacggtttaaccggttacggttacgttacggtagttaacgttagggagggtaacgtcgtaccgg

SEQ ID NO: 1176 - DNA, 850 bp, Homo sapiens
  misc_feature: GYAE6OF01DC6FL.18.16.B05.1.454.CMB.1.raw
tcagtacgagtatgcacgaccggtgctcgatttagagctcacgtaaggggcgtgggagaggagcccagcactggaagtcgccggtgtttccattcggtgatcagcactgaacacagaggactcaccagtgggagtttgggctgaccgttgggttttcctcgttgcttacgttttaaaggaggttactcctagtgtcgaggttcaacgtgggtggaggtccgggggaggtcgtggtcctggacgtgggacgtcgcgtgacgtacttcgtccgtggtcgctacggtcccttcgtacggtacctttccgtaacctttacgaaaacttacccgttaagttcggttccttttcgacccgtaacggttccggggtaccccaccgaacgtacccgttccgaagggaccggaacgggggcctaagggtacggttcggaccttaggttaccgttaaggttttacttacaagttaagtggaaacgttacggtaaaaacttataacgtaaacgtaaccgtaccgactaacggtaccgtcgggtaaaggaccgggtaccttaacgttccgaacctacgtaccgtaaccggtaacgggtaaccttaaaccggtaccggaaacggtaaccgtaaccggttccgttaaccgttaaactaaccgttaaaacggaacggttacggaccgttaacggaacccgttaaggaaaccgtaacgtacgggaaccgtaaccggtacgttacgttacgtactttaacgttagtcggtaacggacggtaagtaacgggttaaccttcgggtttacgggttaaccttgggttaacggttaacgtaacgggtaacgggtaagttaccggttaccggg

SEQ ID NO: 1177 - DNA, 727 bp, Homo sapiens
  misc_feature: GYAE6OF01A7UDB.18.16.B05.1.454.CMB.1.raw
  modified_base (679)..(679): a, c, t, g, unknown or other
  misc_feature (679)..(679): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgtaccttgggttttcctcgttgtcttcttttaagaggtatcctagtgtcagttcaacgtggtggaggtccgggggaggtcggtggtcctggccgtgggacgtcgctggacgtactccgtcctgtcgcacgcctcgtggtacttccacctttacaacttacctatgtctttcgctacgtcgggtccaccgacgtacctccgaggaccggaacgggtccgaggtaggtggacttgtactagtttacgttcaagttagtagaagtagaactaatactaaactacgtacgtacacggtaccgtccgtacggtaacggcctacttaccaacctagtacccgtacgaacgggtaactaaccgttaaccgaacggtaacctaccggtactacgttaacctaacctaaacgaacgttacgaaccgttacgaccgttagaaacgtaccgtagaacccggtactaccggcttacgttaacgttagttaagttcgggtaacggtacccggtaaagtacgggttaacccgttacgggtttaaggggtttacnggtttaaacggacgttacgggtaaaagggtaccgtaaggttacccggg

SEQ ID NO: 1178 - DNA, 711 bp, Homo sapiens
  misc_feature: GYAE6OF01B6KH5.18.16.B05.1.454.CMB.1.raw
  modified_base (307)..(307): a, c, t, g, unknown or other
  misc_feature (307)..(307): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggaggtccgggggaggcgtggtcctgccgtgggacgtcgctgagactctcctgtgcagcctctggacttcacctttcaactaccctatcgtctttgcaccgtggggtcccnccagacctccgaggcgaacggggccaggtaggtcggcttgtaccgtaagtttatttccaagttactggtaatacggaaacttaaatactaaagttaccctaacggcctaacggtaccttacccgggttaggaaacgggtcccgtaattccaaccctagtacccgttaccgaacgggtaacctaacgttacccgaacggtaaccaccggtacttacggtaccctacgtaacaaacgttcggaacctaacgtccgtaacggaacgtaacctacgggaaccgaacgtaccggtacctacgttacttacgtttaagtggtacggacgtacggtaagttaccgttaggttacgggtttaacgttagggttacggtacgttacgggaaggggtaactaaacgggttccgg

SEQ ID NO: 1179 - DNA, 714 bp, Homo sapiens
  misc_feature: GYAE6OF01DF0JR.18.16.B05.1.454.CMB.1.raw
  modified_base (155)..(155): a, c, t, g, unknown or other
  misc_feature (155)..(155): n is a, c, g, or t
  modified_base (255)..(255): a, c, t, g, unknown or other
  misc_feature (255)..(255): n is a, c, g, or t
  modified_base (279)..(279): a, c, t, g, unknown or other
  misc_feature (279)..(279): n is a, c, g, or t
  modified_base (311)..(311): a, c, t, g, unknown or other
  misc_feature (311)..(311): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttccncgttgcttcttttaagaggtatccagtgtcaggttcaacgtggtggaggtccgggggagcgtggtcctgccgtgggacgtcgctgacgactctcctgtcncacgcctgtggattccgaccttanaactaccttatgtctttgctacgtcgggtccnccgagacctccgagggaccgtaacgggggccaaggtacggtcggtcttagtacctagtttattacgagttagtggacttacggtaaaaccttaagtctaaacgttaacgtaccgactaacggtacccgttacggacggaaacgggtcctacgttaccaacctacgtacccgtaccggtaacgggaactaacgttaccgaacggtaaccgacgtcttacgtacctacgtaacgaacgtacggtaaccacggccgtaagaacgtaacggtacggaaccgtaaccggtacggtacgtacgttacgttaacgttagtacggtacgacggtaagaccgttaacgttaacgggttacggttacttacgggttagtaaccggttaggaaacgggtacgtaacggttccgg

SEQ ID NO: 1180 - DNA, 747 bp, Homo sapiens
  misc_feature: GYAE6OF01BTB48.18.16.B05.1.454.CMB.1.raw
tcagtacgagtatgcacgaccggtgctcgatttagagctcacgtaaggggctgggagaggagcccagcactggaagtcgccggtgttccattcggtgatcagcactgaacacagaggactcaccagtggtagtttgggctgtaccgttgggttttcctcgttgtcttctttaagaggtatccagtgtcgtagttacaacgtgggtggacgggtccgggggaggtcgtggtcctcggccgtgggaccgtcgcgtgacgtacgtctccgtgtcgacgcgtccctgtggtacttacctaccttactaaactaccttatcgttcttcgaccgtacgtcgggtcccgacctaacgtacccgtaccgacggacggaacggggacaggtaggtcggcgtcgtacttagtttattactagtagtagtaaagtaacggaaacttaataactaaactaccgtacgacaacgtaccgtacggtacggtaacggaccgttataaccaccgtacttacggtaaccgaacgggtaactaaaccgttaccgaacgaacgaccgtacgttacgtaactaacgtaaacgaacgtacgggtaacaaccggtacctaaaggtaaccgtaaccgtaggaacccggtaacgtcccggttaatttaccgtaacttagtttacgttcgggtacgtaaggtacgtaagtaccggttacgttagggttaaccgttggtaacgtagttaaccggaagtaacggtaagtcccgg

SEQ ID NO: 1181 - DNA, 722 bp, Homo sapiens
  misc_feature: GYAE6OF01CH0YV.18.16.B05.1.454.CMB.1.raw
  modified_base (203)..(203): a, c, t, g, unknown or other
  misc_feature (203)..(203): n is a, c, g, or t
tcagtacgagtatgcacgaccggtgctcgatttagagctcacgtaaggggctgggagaggagcccagcactggaagtcgccggtgttccattcggtgatcagcactgaacacagaggactcaccatggagtttgggctgaccttgggttttcctcgttgcttcgttttaagaggtactccagtgtcaggttcaacgtggtagnggtccgggggaggcgtggtccgtggccgtgggacgtcgctgagactctcctggtacgcagtcctcgtggtacttcctaccttacaacttacctatcgttcgttcgctacgtcgggtcccacgacgacctcgaggcgaacgggccagaggtgctagtctagttattacgtatagtacggtagtaacggaaacttaagtaactaaacgtaaccgtaacgacgtaacgtaccgttacgggtacggaacggtccgtaattacccgacctactaccgtaccgaacggtaacctaacgttaaccgacggtaaaccgtccgtcgttacgtacgtacctaaagtaacgtacggaacgaccgtaccgttacggaacgtaaccgtacggaaccggaccgtaacgttcgttacgttacgttaagtttacggtacggtacggtacgaacggttaacgtacggtttacgggtacgggtttaacgttccggttaaggtaacgttaccgggaagggttaacgaacgttcccggg

SEQ ID NO: 1182 - DNA, 718 bp, Homo sapiens
  misc_feature: GYAE6OF01A064N.18.16.B05.1.454.CMB.1.raw
  modified_base (430)..(430): a, c, t, g, unknown or other
  misc_feature (430)..(430): n is a, c, g, or t
  modified_base (683)..(683): a, c, t, g, unknown or other
  misc_feature (683)..(683): n is a, c, g, or t
tcagtacgagtatgcacgaccggtgctcgatttagagctcacgtaagggggctgggagaggagcccagcactggaagtcgccggtgtttccattcggtgatcagcactgaacacagaggactcaccatggagtttgggctgaccgttgggttttcctcgttgcttcttttaagaggtatccagtgtcaggttcaacgtggtgggaggtccggggggaggtcggtcggtcctggccgtgggtacgtcgctgagtacctctcctgtgcacgcctcgtggtacttcctaccttcaacttacctatgtacctttgactacggtcgggttccccgacacgacctacgacgggacggaacggggcccaaggtacggttcgggaccttgtaccgtaagttttacttttacgattatcgaataggtaaactaacttanaacgtacctaacgacaacggtacccgtagggtacggaaccggtacgtacttacaaccctaatccgtaaccgaacgggtaacctaacgttacccgaagggaacctacgccgttacgtacttaccctaaacgaacgttacggaccctagtacgtaacgtaaacggacgtacggtaaccacgtacggttcgttacgttattaggtttagttccggacgtacgggtaataacggtaacgtttcgggttaggtttacngggttactagggttaacgagggtgtaacgtccggg

SEQ ID NO: 1183 - DNA, 710 bp, Homo sapiens
  misc_feature: GYAE6OF01A5EIK.18.16.B05.1.454.CMB.1.raw
  modified_base (353)..(353): a, c, t, g, unknown or other
  misc_feature (353)..(353): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtactccagtgtctaggttcaacgtggtggaggtccgggggaggcgtggtcctggccgtgggacgtcgctgagacctctccgtgtacgcacgcctgtggtacttccaccttacaacttaccttatcgtctttgctacgtcgggtcccaacgacgtactccgaggacgaacggggccaggngtggcttgtctagtttacttcgatactgtaatacggaactagtacctaaatactacgacacgtaccgtccggtaggaaccgggtctacttcccactacgtccgtaccgtaacggtaacctaacgttaaccgaacgaaacccgtaccgtaccgttacgttaccgttaccaaacggtaagtcgaacgacgttaccgaagaaccgtaacggtacgaaccgaccgtacggtccgttacgttacttaacgttacggttcggtaacggtacggtaacgtaggttaacccgtttgggttaccggtttaacggttggtttaacggtacgttaaacggtaagggttaaccgcggtttaaccccggg

SEQ ID NO: 1184 - DNA, 640 bp, Homo sapiens
  misc_feature: GYAE6OF01BN1BQ.18.16.B05.1.454.CMB.1.raw
  modified_base (304)..(304): a, c, t, g, unknown or other
  misc_feature (304)..(304): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaactggtggagtccgggggagcgtggtcctgccgtgggacgtcgctgagactctcctgtgcagcctctggattccaccttcaaacttacctatgtctttgctacgtgggtccnccagacctccgaggcgaaggggccaggagtggctgtctagttatttcattatgataggaaactaatacaaataccgtacgacagacctccggtagaacgggccgtacttccacctatccgtaccgaagggtaaccaaacgttacccgaagggaaaccaccgtaccttcgttacccttacctaaactaaacgttcggaacctacgtaccctaggaacgtaaaccgtgaaccggacgtaccgggtaccttgttacttagtttagttagacggtacgagtaacgtacgttacgttcgggttaacttggttaggtacttacggaagggtaatacgtacgg

SEQ ID NO: 1185 - DNA, 552 bp, Homo sapiens
  misc_feature: GYAE6OF01BY9T2.18.16.B05.1.454.CMB.1.raw
  modified_base (156)..(156): a, c, t, g, unknown or other
  misc_feature (156)..(156): n is a, c, g, or t
  modified_base (173)..(173): a, c, t, g, unknown or other
  misc_feature (173)..(173): n is a, c, g, or t
  modified_base (259)..(259): a, c, t, g, unknown or other
  misc_feature (259)..(259): n is a, c, g, or t
  modified_base (349)..(349): a, c, t, g, unknown or other
  misc_feature (349)..(349): n is a, c, g, or t
  modified_base (463)..(463): a, c, t, g, unknown or other
  misc_feature (463)..(463): n is a, c, g, or t
  modified_base (488)..(488): a, c, t, g, unknown or other
  misc_feature (488)..(488): n is a, c, g, or t
tcagtacgagtatgcacgaccggtgctcgatttagagctcacgtaagggctgggacgaggagcccagcactggaagtcgccggtgtttccattcggtgatcagcactgaacacagaggactcacccatggagtttgggctgaccttgggttttccncgttgctcttttaaagnggtatccagtgtcaggttcaactggtggagtccgggggagcgtggtcctgcctgggacctcgctgagtactctcctgtgcagcctntggattcaccttcaataccctatgtctttgctacgtcggggtcccgccagacctccgagggtccaaggggccaggagtggctgtcagttnttcatatgatggaaactaagctaatactacgcaagactccggtagaacgggccattcacctatctaccgagggactaagttaccagaaccacgtctgtactctaacaagtgacngacctgaagaacgtgacgacacggntagtactagttatgtgacgagatacgtcgttgggttactgttacagttcgagggagtacgtacg

SEQ ID NO: 1186 - DNA, 814 bp, Homo sapiens
  misc_feature: GYAE6OF01CDXOV.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggtagtttgggctgaccgttgggttttcctcgttgcttcgttttaagaggtactccgtagtgtacgaggttccaagtgggtgggtacggtccgggggagcggtcggtcctggccgtgggacgtcgctagtactacctctccgtggtcgacacggtccttcgtacggtactttaccaacctttacaaacgttaccgtattcgttaccgtttggacccgttaccggttcgggtacccccgaccgtaacggtacccgtcccggaggggtaccggaaacgggggtcccaggggtaacggttccggtcgtttacgttacgttaagtttacttacgtaattcgaaggtagtaaacggtaaacttaacgtactaaacgttacgtaaccggctaacggttacccgtacgggtaaaggtaacccgggtccctaactttacccgaaccctacgttacccggtaaccggaacgggtaaccttaaacccgttaaccgggaacgtaaccgtacgtacgttacgtaacctacgtaaaccgtaacgtcgaacggtacgtacgtaaggaaccgtaacgacggaaccggtactacccggttacttagttaaccttaggtagttacggtacgccggtaagtacggtaaccgtttaggtgggttaacttcggtaagttcgtaaggtacggtaaccgtgttacccgg

SEQ ID NO: 1187 - DNA, 904 bp, Homo sapiens
  misc_feature: GYAE6OF01BOO4I.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatgggagtttgggctgaccttgggttttcctcgttgcttcttttaagaggtatccagtgtcaggttcaacgtggtggaggtccgggggagcggtcggtcctggccgtgggacgtcgctgacgtactctccgtgtcgacgacgtcctcgtaggtacttcctaccctttacaaacttaccctattcgtcctttcgacctacgttcggggtccccaccgtacggacctccggaagggaccggaaaccgggggcccaaggtacggtcgggtcttagtaccgttaagttttacttcgaagttagtaagtacgttaacgggtaaaacttaaacgttacctaaaacgtttacccgtaaccggtacgtaaaccggtaccgttaccgggtaacggggaaaaccgggggtccctaacgtttaccccgaacccgttacgttacccgtaaccggtaacgggtaaacccttaaaccggttacccggaaaaccgggtaaacccgtaaccgggtttacccgttacgggtttaaccctttaaacccgtaaaaccggttaaaaccgggtttaccgggaaacccgtaccgggtaaccccggtaaaggtaaaccgggtaaacccggtaccgggtaaacccgggtaacccggtaaccgggttacttaccggttactttaacgttacgttagggttaccggtacggtaacggtaacggtacgtttaaccggggttacgggtttaccgttagggtttacggtaacgtttaggggaaacgggttaagtaccgttacccgggg

SEQ ID NO: 1188 - DNA, 736 bp, Homo sapiens
  misc_feature: GYAE6OF01EHSO7.18.16.B05.1.454.CMB.1.raw
  modified_base (171)..(171): a, c, t, g, unknown or other
  misc_feature (171)..(171): n is a, c, g, or t
  modified_base (251)..(251): a, c, t, g, unknown or other
  misc_feature (251)..(251): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctgttgcttcttttaagngtatccagtgtcaggttcaactggtggaggtccgggggagcgtggtcctgccgtgggacgtcgctgagtctctcctgtcncacgtccttcgtggtactttcctaccttactaacttacctattcggtctttgcctacgttcgggtcccaccgagtaccgtccgagggtaccggaacgggggccaaggtacggtcgggtctggtactaagtttacttcagttagtgtaagtacggtaaacttaatacgtaaatacgtaaccggtacaacggtaccgtccggtaaggaaccggggtccctaacttacccgaactaccgttacccgtaaccggtaacgggtaacctaacgttacccgaacggtaaaccaccgtccgttagtacctaaccgtaaactaacgtcggaaccgacgtaccgtaggaacgtaaccgtacggacctacgtaccggtacgttcgttactttaacgttagttcggtacggaccggtaagtaacggttaacgttacgggttacgggtttacacggtttacggaacggttcggaacggggtaacgtacgttacccggg

SEQ ID NO: 1189 - DNA, 764 bp, Homo sapiens
  misc_feature: GYAE6OF01D3WHG.18.16.B05.1.454.CMB.1.raw
  modified_base (274)..(274): a, c, t, g, unknown or other
  misc_feature (274)..(274): n is a, c, g, or t
  modified_base (335)..(335): a, c, t, g, unknown or other
  misc_feature (335)..(335): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgtcttcttttaagaggtatccgagttgtctaggttcaacgtgggtggacggtccgggggagtcgtcggtcctcggccgtgggactcgcgtgagactcctcgtgtcgcacgccttnaggtactttccaccctttacaacttaccgtagtcgtctttgccgtacggttccgggtaccnccgtaacggtcctcccggaagggtaccggaaacgggggtccaagggtacggtcggcttgtacgttaagttttactttaccagttacgtaggtaagtaacggtaaaacttacgtaaccgtaaagttaaccacgtacgtaacggtaccgttaccggtagggaaaccggtacccgttacttaaccgaaccttacgtacccgtaaccggaacgggtaaccctaaacgttacccggaaacggtaacccaccggttaccttacggttacctaaaccgtaacgtaacgtccgtaacgtaccgtacgtaagaaccggtagtaaccggaacgaaccggtccgtaattcgttattacgttagttcgaggtacgagttaccgtacgttacggttacggttacgtggttacgttacgtaggtaacggtaagtcggtaccgg

SEQ ID NO: 1190 - DNA, 784 bp, Homo sapiens
  misc_feature: GYAE6OF01DZXNM.18.16.B05.1.454.CMB.1.raw
  modified_base (344)..(344): a, c, t, g, unknown or other
  misc_feature (344)..(344): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcacatggagtttgggctgaccttgggttttcctcgttgtcttacttttaaggaggtatccagttgtcgtaggtttcaacgtgggtgggacggtccggggggaggtcggtggtccgtggccgtgggaccgtcgcgtggacgtctcgtccgtgtcgcacgtcctcgtggtacttccacctttacaaacgttaccttatcgttctttagccgtacgtcgggtcccnccgagtaccgtaccgacgggaccggaaacggggccaagggtacggtcggtcttggttaccttaaggttttaccttagaagttagtagtaaacgtaacgggttaaacttaaactaactaaacgtaacccgttaacgacgtaaaccggaccgttaccgggtacggaaaccggggtaccttacgttaacccaaccgtacttaccgtaaccggaacgggtaaccttaaacgtccgaaacgacgtaccgtcgttaaccgtactaactaaacgtaagtacgaactaccgtacgtagaacgtaaccgtacggaaccgtacggaccggtacttggttaacctttagtttacggtgtacggtaccgtaacggtaagtaaccggtttcggttacgggtttacgttaggttaaccgtaggtttaaccgggaagggttaaatccgttacggg

SEQ ID NO: 1191 - DNA, 715 bp, Homo sapiens
  misc_feature: GYAE6OF01DXRA4.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggtttttcctcgttgcttcttttaagaggtatccagtgtcaggttcaacgtggtggaggtccgggggaggcgtggtcctggccgtgggacgtcgctgagacctctcctgtcgcagcctgtgacttcaccttcaactacctatgtctttgctacgtcgggtcccgccaagtacctccgagggacgaacgggggcccaaggacggtggctgttcgagtttattcgatagtgtataggaaacttaagtactaaataacctacgctaacgaccgttaccggtaggaaacgggtccgtaacttaccaaccgtaactccgtaacctaacggggaaccttaacttaccggaacggtaaccacgtaccgttcgttaccctactaaacgtaacgtcggaacctacggtaccgtacggaacgtaacgtacgaaccgaaccggtaccggtacgttacggttaactttaagtttacgtttacggtacgtacggtaacggtaacggttacgttaccggtttacgggtttaccgttaggttacgttaacggttaccgtaacgggggtaataacgttacccggg

SEQ ID NO: 1192 - DNA, 636 bp, Homo sapiens
  misc_feature: GYAE6OF01AIFGL.18.16.B05.1.454.CMB.1.raw
  modified_base (315)..(315): a, c, t, g, unknown or other
  misc_feature (315)..(315): n is a, c, g, or t
  modified_base (366)..(366): a, c, t, g, unknown or other
  misc_feature (366)..(366): n is a, c, g, or t
tcagtacgagtatgcacgaccggtgctcgatttagagctcacgtaaggggctgggagaggagcccagcactggaagtcgccggtgttccattcggtgatcagcactgaacacagaggactcaccatggagtttgggctgaccttgggttttcctcgttgcttcttttaagaggtatccagtgtcaggttcaacgtggtgggaggtccgggggagcggtggtcctgccgtgggacgtcgctgagacctctctgtgctacgcctcgtggtacttccacccttacaactacctattgtcttcgcgtacgtgggtcccncagacctcgacggcgaaggggccaggtacgtcggctgtactagtttacttnatagtgaagtaggaaactaatactaaatacctaacgactacgtaccgtcgtaggaacggtcgtactacctaccgtactaccgtaccgaacggactaacgttaccgaacggaccacgtctcgttaccgtactaacaagtcgactacgacctgaaccgacgtacggaccgtacgacgtcgtacgtacttagttagttacgttaggagtacggagttaccgttacggttacggttagtcggtcgttacgttagggaacggtgtacgttccggg

SEQ ID NO: 1193 - DNA, 896 bp, Homo sapiens
  misc_feature: GYAE6OF01DLIWC.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccgttgggttttcctcgttgtcttacgttttaaggaggtatcctagtgtctaggttcaacgtgggtgggacggtccgggggaggtcggttcggtccgtcggccgtggggaccgtcggcgtggacgtaccttcctccgtggtcgcctacgtcccgttcgtaggtactttccctaaccctttacaaacttaccttagttcgttccgtttagccgtaccggttccggggtacccaccgtaacggtacccgtacccggagggaccggaaaacgggggccctaagggtacggtcggtaccgttacgttaccgttaaggtttttaacttaccgtaagtttaggtacggtaaacgttaacggtaaaacttaaacgtaccgttaaaacgttaccgtaaccgtaaccgtaacggtacccggttaaccgggtaacgggtaaccgggtacccgttaacgttacccgtaacccgttaaccgttaccccgtaacccgggtaaacggggtaacccttaaacccggtttacccggaaaacgggtaacccgttaacggttacccgttaccggttaacccgttaaacccgttaaacgtaaacggttacccgggaaaccgttaccggtaacgttaacggaaaccggtaaccggtacggaacccgtaccggtaccgttacgttacgttaactttagtttacggtagtacgaacggtagtacgttaacgttcggttacggttactggttacgtagtaggaaggtagtacgtccgg

SEQ ID NO: 1194 - DNA, 631 bp, Homo sapiens
  misc_feature: GYAE6OF01EWGHH.18.16.B05.1.454.CMB.1.raw
  modified_base (263)..(263): a, c, t, g, unknown or other
  misc_feature (263)..(263): n is a, c, g, or t
  modified_base (314)..(314): a, c, t, g, unknown or other
  misc_feature (314)..(314): n is a, c, g, or t
  modified_base (510)..(510): a, c, t, g, unknown or other
  misc_feature (510)..(510): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagaggtatccagttgtcaggttcaacgtggtggaggtccgggggagcgtggtcctgccgtgggacgtcgctgagcttcctcctgtgcacgtcctntggtacttcctaccttacaattaccctatcgtctttgcctacgtcggtccncctacgacctccgaggaccggaaggggccaggagtggtcttagtactagtttactttacgaattagtgaagttaggtaaacttaatacaattaacctacggtacacgtaaccgtccggtaggaacgggaccctattaccacctacgtcctacgacggtactaaactaccgaagacacgtctcgtctacaccgtaancgacacgtcgtagaacgaacgtcgacgactcgggtctacgttattagttagttcgagtacgggacttaggtaacttacggttggttaactgttacgttagtaggacgggtaagtacgtacg

SEQ ID NO: 1195 - DNA, 871 bp, Homo sapiens
  misc_feature: GYAE6OF01C4BSO.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactccaccatggtagtttgggctgaccttgggttttcctcgttgcttcgttttaagaggtatccagttcgtctaggttcaacgtgggtgggaggtccgggggagtcgtcggtcctggccgtgggaccgtcgctagacgccttccgtccgtgtcgcctacgcccgttcgtaggtaccttaccacctttactaaacgttaccttacgttcgttcgttcgccgtaccgtccggggtcccgccgaacggtacccgtaccggacgggccggaaacgggggccccgtaagggtaccggttcggccttaggttacccgttaaggttttaacctttctaagttaagttaggaacgttaacggtaaactttaaacaaccgttaaacgttaaccctaaccggtaccgtaacgtacccgttaccgggaacggttaaccgggtaccgttacttaaccctaccgtaccgtaccgtaccggaaacggtaaccttaaaccggttacccgaacggtaacccgtaaccggtaccgttactaccggttaacctaaaccgttaacgtaccggtaaccgtaccggtaaaccgttacgaaaccggttaaccgaccggaacggtaaccccggtaacgttccggttaaccgtttaacttacggttttagtcgggtttaacggacggttaaacggtaaccgttaaccggtttcgggtttacggtttaccgttaggttaacggttacgttaagggaacggttaagtacggttaccggg

SEQ ID NO: 1196 - DNA, 726 bp, Homo sapiens
  misc_feature: GYAE6OF01EBMP1.18.16.B05.1.454.CMB.1.raw
  modified_base (290)..(290): a, c, t, g, unknown or other
  misc_feature (290)..(290): n is a, c, g, or t
  modified_base (712)..(712): a, c, t, g, unknown or other
  misc_feature (712)..(712): n is a, c, g, or t
tcagtacgagtatgcacgaccggtgctcgatttagagctcacgtaaggggctgggagaggagcccagcactggaagtcgccggtgtttccattcggtgatcagcactgaacacagagactcaccatggagtttggctgacctggttttctcgttgctctttagagtactccagtgtcaggttcaactggtgagtccgggagcgtggtcctgcctgggactcgctgagctctcctgtcgcagcctctggattccaccttacaatacctatgtactttgctacgtggtcccncagacctcgaggcgaacggggccagtagtcggtctgtacgtagtttacttactatactgacgtaggtaaactaattcaaatacgtaacgtaccgtaacgtaccgttaccggtaggtaacggtacccgtaactttacccgaacctagttaccgtaacccgtaacggggtaactaaaccgtttaccggaaacgggttaaaccaccgggtaacccttttcgggaaaccctttaccgtaaacccgttaaaggttaccggtaacgaaacccggtccgttaagaaaccgttaaacggcggtaaacccggacgaacggttcccttggttaccctttaaatttgttacgggttcgtaacggtaacgtacgttaacccgtttacggtaaggttttaccctaggtttacgaaacgttttggaaacgggggtnttaaacccggtcgg

SEQ ID NO: 1197 - DNA, 745 bp, Homo sapiens
  misc_feature: GYAE6OF01CO72E.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagagactcaccatggtaggttgggctgtaccgtttcgggttttccctcggttgtcctttacgttttaaaggaggttactccgtaggttcgtcgtaggttactaaacggtgggtagggtacgggtccggggggaggtcgtcgggtccgtcggccgtgggtaccgtcgtacgtggtacgtctcgtccgtgtcgctacgcctcgtgtctacctacctataactactagtcgtacgttcgctacgtccggtccgccacgtccgtaccgacgggaccggtaaccgggccaggcggttggccgttagtacttagtttaccttatatagttaggaactaaggtaaaacttacgtaaacaacttaccgtaacgacgtaaccggtaccgtaccgggttaacggaccggtacccgttaccttaccgaaccctaccggtaaccggtaccgtaaccgggtaaccttacgtaaaccgggaacgtaaaccgtccgtacgttaccgtactaaccgtaacgaacgtcgaaccgaccgtcgaagtaccgagaccggtacgaaccgcgtacgttatacgtttagtagtcgtagagtacggtacgtaacgttggttaacgtagtgtacgtgtaggaggtactcgtaaccgg

SEQ ID NO: 1198 - DNA, 854 bp, Homo sapiens
  misc_feature: GYAE6OF01A26WH.18.16.B05.1.454.CMB.1.raw
tcagtacgagtatgcacgaccggtgctcgatttagagctcacgtaaggggctgggagaggagcccagcactggaagtcgccggtgtttccagttcggtgatcagcactgaacacagaggactcaccatggagtttgggctgtaccttgggttttcctcgttgcttctttaagagtatccagtgtctaggttcaacgtggtggtaggtccgggggaggtcggtggtcctcggtccgtggggtacgtttcgccgttaggaacgtacctccgtcccgttggtacgacctacgtcccgttcgttaggtactttcctaacccttttacaaaactttacccgttagttcgttccgtttttacggacccgttaaccggttccgggggttacccccgaccggtaaccggttaaccccgtacccggaacggggtacccggaaaaccggggggtcccaaaggggtaccgggttacgggtcccgttaggttaccttaacggttttaacttttccgaaagttacggtaggtaaacgttagggtaaaacttagtaccgtaaacgttacccgtaacgtaccgtaacggtaaacccgttcggtaagggtaaccggtacccttagttacccgacgtaacttacccggtaaccggtaacgggtaaaccttaacgttacccgaaacggtaaccgtaccgttcgttacgtacccttaacgtaaacgtaacggtcgaaccgtacgtcgtaacgaaccgtaaccgtacgaacccgtcgtaccggtacttacgtacttagttacgttcgaggtaccgtagtaccgtcggttacgttacgggtacttaggtacgtacgtaaggaggtaagtcgtacg

SEQ ID NO: 1199 - DNA, 793 bp, Homo sapiens
  misc_feature: GYAE6OF01B17JS.18.16.B05.1.454.CMB.1.raw
  modified_base (244)..(244): a, c, t, g, unknown or other
  misc_feature (244)..(244): n is a, c, g, or t
  modified_base (315)..(315): a, c, t, g, unknown or other
  misc_feature (315)..(315): n is a, c, g, or t
tcagtacgagtatgcacgaccggtgctcgatttagagctcacgtaaggggctgggagaggagcccagcactggaagtcgccggttgtttccagttcggtgatcagcactgaacacagagactacaccagtgggtagtttgggctcgtaccgttgggttttcctcgttgtctttacgtttaaggaggtactcgtagtgtcgtaggttcaacgtgggtaggacgggtccggggagtcgtcggtccnggccgtggcgtcgcgtagacgtctctccgtgacgctcgcctgtacgacttaccgtacttcaactaccgttntcgtacttcgacgtacgtcgggtacccagaccgtaccgaccgaaggccggaacggcctaggtacggtcgtacttggtacttagttttacagtagtagtacgtaagtaaccgaattaaacgacctaaagtaccgaacggtactaacggtacttaccgggaaggttaacccggataccttaaccccgactaacgttccgtaacgaaccggttaacctaaacgttccggaaacgaaccgttcgtactagttaaccctacttaaacggaacgtcggaaacgttacccgtaacggtaacgaaacccggtaacggaccggttaacccggacgtaacggttctttaccgggtaaatttttccgggttagccgggtttaaacgacgggaaaccgttaacgggaccgttttagggttaccggggtttacctaagggtttaaccgtaagggtttaagggaaaacggttaccgttcccggttaaaccgg

SEQ ID NO: 1200 - DNA, 877 bp, Homo sapiens
  misc_feature: GYAE6OF01B2PXJ.18.16.B05.1.454.CMB.1.raw
  modified_base (98)..(98): a, c, t, g, unknown or other
  misc_feature (98)..(98): n is a, c, g, or t
  modified_base (340)..(340): a, c, t, g, unknown or other
  misc_feature (340)..(340): n is a, c, g, or t
tcagtacgagtatgcacgaccggtgctcgatttagagctcacgtaaggggctgggagaggagcccagcactggaagtcgccggtgtttccattcggtnatcagcactgaacacagaggactcaccatggagtttgggctgaccgttcggttttcctcgttgcttacgttttaagagttactacagttgtacgtaggttcaacgtgggtggacggtccgggggagtcgttcggtccgtgtccgtgggaccgttcgcgtgacgtacctctccgtgtcgcacgcctcgtgacttcctaccttacaacttaccttatcgttctttgccgtacgttcgggtcccnccgacggtacctaccggagggaccgtaacggggccgaggtacggttcggtacgtcgttaccgtttaagtttctttactaagttacgtaggtaacgtaaggtaaacctttaataaccgtaaactaccgtaaccgacgtaacggtaccgtaccggtaacgggtaaacgggtcccgttaattacgtaccgtaacgtaccgtccgtaacccggtaaacggtaacccgttaaccgttacccggaaacggaacccgtacccgtcgtttaacccggtacctttaaccgtaaacgtaacgggtaccggtaaaccgtaccgggtacccgtaaggaaacccgttaaccggtaaccgggaacccgaaaccgggttaccggtaacccgtttaacgggtttctttttaaacggtttacgtaggggttaacgtaccggggtttaaagaaccggttttaaccccggttaaagggttttacccgggttaaacggtttgggttttaaaccgtaacggggtttaaacgtttaaacgggggaagttaaacccgggg

SEQ ID NO: 1201 - DNA, 803 bp, Homo sapiens
  misc_feature: GYAE6OF01CMGLH.18.16.B05.1.454.CMB.1.raw
  modified_base (293)..(293): a, c, t, g, unknown or other
  misc_feature (293)..(293): n is a, c, g, or t
  modified_base (536)..(536): a, c, t, g, unknown or other
  misc_feature (536)..(536): n is a, c, g, or t
tcagtacgagtatgcacgaccggtgctcgatttagagctcacgtaaggggctgggagaggagcccagcactggaagtcgccggtgttccattcggtgatcagcactgaacacagagactcaccatggtagtttgggctgtacccgttggggtttttccctcgtttcgtcttcgtttttaaaggaggttatccagttgtctagggtttcaacgttgggtagggtacgggtccggggggagtcggtcggtcctggccgtgggacgtcggacgtgagtacctcctacgtgtcgacncggtccctgtaggtacttccgtaacccttataaccttacctattcggtctttacggcctacggtcggtccaccgacgtacctaccggacggaccgacgggactaggtggtcggcgtttggttacttaacgttttcttacgtattaagtacgtaagttaacgtaaaccttaagtaacgtaactaccgtaacgaccgtaaccgtacccggtacggaacggtaaccggtacccgtaacttaacccncccgtaacttccccggtaacggtaaacgtaacccgttaaacgttaccgaaacggaaccgtaccgtcgttaaccgttactaacgtaaaccgtaaggtacgacgacgttaacgacggtaacgacgtaaccgaacggtccgaccgttacgttacgttaaccgtttgttaagttcggaaccggtaggtaacggtaaccttacgggtttacgttaccgggttaattgggttacgtaaacgggttacggtaacgggaagtttaaccggtccgg

SEQ ID NO: 1202 - DNA, 722 bp, Homo sapiens
  misc_feature: GYAE6OF01EA1NL.18.16.B05.1.454.CMB.1.raw
  modified_base (260)..(260): a, c, t, g, unknown or other
  misc_feature (260)..(260): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagagtatccagtgtctaggttcaacgtggtggaggtccgggggaggcggtggtcctggccgtggggacgtcgctgagacctctcctgtgcncgtcctcgtggtactttccaacccttacaacttaccctaattcgttctttcgcgtaccgttcgggtccccgccgaacgacctcccggagggaccggaaacgggggccagggacggtggcgttcgtactacgtttattctaatagtgtaacgtaggtaaactaacgtacaaacttactaacgctaacgtaccgtacggtacggaaacggggtcctaactcctaacctacgttccgtaaccgaagggtaacctaaacgttaccgaaacggtaacaccgtcttacggtcctaacgtaaactaagtcggtaccacgtcccgtaagaacgtaaccgtagaaccgaaccggttacgtacgttacgttaaccgttagtttaaacgttgggtacggaacggtaacgtaacgtacgttaacggttcgggttaacgtcggtagttacgtagggaagggtaatacggttaccg

SEQ ID NO: 1203 - DNA, 753 bp, Homo sapiens
  misc_feature: GYAE6OF01C4028.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccagtggtagttgggctgaccttgggttttcctcgttgcttacttttaaagagttactccagtgtctaggttcaacgtgggtggacggtccgggggagtcggtggtcctggcccgttggggacgtcgcgtaggacgtacctcctccgtggtcgaccgacgtccttacgttcggtacttttcccaacctttaacgaaacttaccttagttcgttacctttcgccgtaacggttccggggtaccccacctaaggtaccccgtcccggaagggaccggaaacggggccctaaagggtcggttggcccttaggtaccgttaagttttacttacgattagacgtaagtacgtaaaattaacgacttaaacgtacctacgaccgtaagtaccgtcccgggtaaggaacggtacccttacttaccgacctagtaccgtaaccgaagggtaactaaaccgttaccgaacggaacgtaccgtcttacgtacctaccgtaaagacgtacgtacacgtaccgtagaacgtaacgtcggaaccgacgtacgtcgttacgttacttagttagtcgttaacgagtacggtaatacgttacggttaggttctaggtcgttaacgtaggaacggttatcgtaccgg

SEQ ID NO: 1204 - DNA, 672 bp, Homo sapiens
  misc_feature: GYAE6OF01EXAUV.18.16.B05.1.454.CMB.1.raw
  modified_base (174)..(174): a, c, t, g, unknown or other
  misc_feature (174)..(174): n is a, c, g, or t
tcagtacgagtatgcacgaccggtgctcgatttagagctcacgtaaggggctgggagaggagcccagcactggaagtcgccggtgtttccattcggtgatcagcactgaacacagaggacctcaccatggagtttgggctggaccttgggttttcctcgttgcttcttttaagnggtatcctagtgtcaggttcaacgtgggtggaggtccgggggaggcgtggtcctggccgtgggacgtcgctgagactctcctgtgcagcctctggtacttcaccttcaacttacctatgtctttgctacggttcgggtccgccagacctcggacggacggaacggggccaggacgtgggcctgttactagtttattcaattatgagttagtaaactaatactaaatacctacgactacgtaccgtccgtaggaaccgggtcctacttaccacctacttacccgtacgtaacgggaacctaacgttaccgaacggaacctaaccgtctacggttaccttacctaacgtaacgtacggaaccacggtaccgtagaacgaacgtacgaacgtaccgtacggtctagttacttagtttacgttagtacggacggtaggtaacgtacgttaccgttgggttaactgttacggttacgttacggtaagggtaagtagttaccgg

SEQ ID NO: 1205 - DNA, 645 bp, Homo sapiens
  misc_feature: GYAE6OF01B217D.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccctgggttttcctcgttgtctcttttaagaggtatccagtgtcgaggttcaacgtggtggaggtccgggggaggtcgtggtccgtgccgtgggacgtcgctgagactctccgtgtgcagcctctggtattccaccttccaataccttatgtctttagctacgtcggtcccgccagaccgtccgaggcgaacggggccaggagtggtctgtctagtttattcattatgtagtaggtaaactaaagtaccaaattacgacgtacaagaccgttaccgtaggaaccggccgtacttccgaacctactccgtaaccgaagggtacctaattcccgaaggaccgacgtcctggttacctacgtaactaaactccgggaataccggtaccgttaggaacgtaaccgagggtaaccgacgtaccggtaccttgtacctagtttacgttcgtaggacgacgtacgtaccgttacgttcgggtatagtgtactacgaaggtagtaacgttcg

SEQ ID NO: 1206 - DNA, 731 bp, Homo sapiens
  misc_feature: GYAE6OF01DHU61.18.16.B05.1.454.CMB.1.raw
  modified_base (332)..(332): a, c, t, g, unknown or other
  misc_feature (332)..(332): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcacatggtagtttgggctgaccgttgggttttcctcgttgtcttacttttaagaggtactccagtgttcgaggttcaacgtgggtgggtacgggtccgggggaggtcggtggtcctgccgtgggacgtcgcgtgacgtactctccgtgtcgctacgtccgtcgtggtacttcctaccttactaactacctatgtcttgcctcgtcggtccnccagacctacgaggaccgaacggggccgaggacggtggtcttacgttacgtagtttacttacaagttagtagtagtagtaaacttaataactaacttaaccgtaacgccggtaacgtacccgtaccggtaagggtaaccgggtccttaacgttcccaaccgttccgtaccgtacccggaagggtaacctaaacgttccgaaacggtaaccgtaccggtcttacgttaccttaaccgtaacaacggtacgactacggtcgtaaggaacgtacggtaacgtacgacgtccgttacttacgttaacgttagtttacgtcggttagacggtaagtaacgttacggttacggttacggtttagtaggttacttaacggttagggaaaggtacgttacggtccgg

SEQ ID NO: 1207 - DNA, 746 bp, Homo sapiens
  misc_feature: GYAE6OF01DPDFF.18.16.B05.1.454.CMB.1.raw
  modified_base (123)..(123): a, c, t, g, unknown or other
  misc_feature (123)..(123): n is a, c, g, or t
  modified_base (227)..(227): a, c, t, g, unknown or other
  misc_feature (227)..(227): n is a, c, g, or t
  modified_base (261)..(261): a, c, t, g, unknown or other
  misc_feature (261)..(261): n is a, c, g, or t
  modified_base (282)..(282): a, c, t, g, unknown or other
  misc_feature (282)..(282): n is a, c, g, or t
  modified_base (589)..(589): a, c, t, g, unknown or other
  misc_feature (589)..(589): n is a, c, g, or t
  modified_base (615)..(615): a, c, t, g, unknown or other
  misc_feature (615)..(615): n is a, c, g, or t
tcagtacgagtatgcacgaccggtgctcgatttagagctcacgtaagggctgggagaggacgcccagcacgtggaagtcgccggttgtttccagttcggtgatcagcactgaacacagagacncactagtggtagttggctgtcgttcggtttcctgttgtcttacgtttaagacggtactcgtagttcgtacgtagtaccaggtgggtgggtacgggtccgggggngtcggtcggtcgtacggtcggtagggccttcggntaggacctctcgtcgtagtcncgacgtccgtgtacgacctttccgacttacgaacgttacctaatcgtaggtccgttcgacggaccgtcccgacggtacggtacccggagggaacgggggtacgtcggtacggtacgtcctacacgttaactaactagtaaccgtaaacgtaacgtaacggtaaaacgtaacctaacgtaacttaaccggaaccgtagtaaccgtacgtacggtcggtaaacgggccggggtaaacgtaccctagttaccgaaccgtccggtacccgaacgggaaccgtaaccgaacccgtaacgtaaaggacccttnaaccctaatacttacggcctacgaanacgtacgcgtacgccgtaccggacgcgtaaccgggaccggtcggtaccgttcggttaccttagtctggacccggagtccggaacgtccggtcgtagagtcggacggtcgaccgttctaggttccgttaacg

SEQ ID NO: 1208 - DNA, 623 bp, Homo sapiens
  misc_feature: GYAE6OF01D7RS7.18.16.B05.1.454.CMB.1.raw
  modified_base (400)..(400): a, c, t, g, unknown or other
  misc_feature (400)..(400): n is a, c, g, or t
  modified_base (469)..(469): a, c, t, g, unknown or other
  misc_feature (469)..(469): n is a, c, g, or t
  modified_base (472)..(472): a, c, t, g, unknown or other
  misc_feature (472)..(472): n is a, c, g, or t
  modified_base (526)..(526): a, c, t, g, unknown or other
  misc_feature (526)..(526): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccgttgggttttcctcgttgcttcttttaagaggtatccagtgtcaggttcaacgtgggtggaggtccgggggaggcggtggtccgtgccgtgggacgtcgctgagtactctctgtcgcacgcctcgtggacttcctaacccttacgaactcctatcggtctttcgctacgtcggccgtccacgacctccgagggaccggaacggggccaggtaggtcggtctgttacgagtttacttacagtacgtgatagaactaanactaatacacgcagtacctacggtagaacggtctactccaactctctacgaggactaagtccgaagacncgnttacgtctacgtaacaaggtcgaacgtccgcgtaagaacgaacgtgaccgaacnccggtatagttactattgtacggacgtacggtacgtagtaacgttcggtaggttacctaggttacgtaacgttacgggaaagggtcgtagtacccgg

SEQ ID NO: 1209 - DNA, 638 bp, Homo sapiens
  misc_feature: GYAE6OF01EYG3U.18.16.B05.1.454.CMB.1.raw
  modified_base (446)..(446): a, c, t, g, unknown or other
  misc_feature (446)..(446): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagttgtcaggttcaacgtggtggacggtccgggggaggcgtggtcctgccgtgggacgtcgctgagtactctccgtgtcgcacgtcctcgtggtacttccacctttcaaacttaccctatcgtctttgctacgtcgggtcccgacgacgtacctccgacgggcggaacggggccaggaggtcggcttgtacttagtttacttcatagtcgaagtacgtaactaagtacaatactacgacagtaccgtcgagacggtccgattcactntccgacgaggtactaagtaccgaaggtaccacgtcttgtacctaacgtaacgaactcggaactcgtacgaacgaacgaaccgtgaacgtaccgacgtcttacgtactttagttagttggacgtacggacggtattacggtcggtttaacggttcgtaggttacgtacgttaagggacggtattacgtaccgg

SEQ ID NO: 1210 - DNA, 706 bp, Homo sapiens
  misc_feature: GYAE6OF01BWACB.18.16.B05.1.454.CMB.1.raw
  modified_base (252)..(252): a, c, t, g, unknown or other
  misc_feature (252)..(252): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcacatggagtttgggctgtaccttgggttttcctcggttgcttcttttaagaggtatccagtgtcaggttcaagtggtggaggtccgggggagcgtggtcctgccgtgggctcgctgacgctctcctggtncacgcctcgtggtacttccacctttacaaacttaccttagttacgttctttggcctacggttcgggtcccgaccgtaacggcctaccgacgggcggaaacggggccaggaggtcgggcttggtacgttagttttatttacaagttagttaggtaacgtacggtaaaacttactaacaaagttaacccgtacgaacttaacggaccgtaccggtggaaaccgggtccctaactacccgactacgtaccgtaccgaacgggtaacctaaacgttacccgaacggtaaccacggtacgtacgttaccttaaccgtaacgtaagtccgacgacgttccaggtacaacgtacggaccgacgtacgtacgttcgtattacgttagtttcggacgtagaacggttagtaacgttggttaccggttgtacggtacgttaggtagtaagggtagtaacgtcgg

SEQ ID NO: 1211 - DNA, 781 bp, Homo sapiens
  misc_feature: GYAE6OF01D6PW7.18.16.B05.1.454.CMB.1.raw
  modified_base (98)..(98): a, c, t, g, unknown or other
  misc_feature (98)..(98): n is a, c, g, or t
  modified_base (184)..(184): a, c, t, g, unknown or other
  misc_feature (184)..(184): n is a, c, g, or t
tcagtacgagtatgcacgaccggtgctcgatttagagctcacgtaaggggctgggagaggagcccagcactggaagtcgccggtgtttccattcggtnatcagcactgaacacagaggactcaccatggagtttgggctgaccttgggttttcctcgttgcttacttttaagaggtatccagtntacaggttcaacgtgggtggacggtccgggggagcgtggtcctggcctgggaccgtcgctgagctctctgtgcagcctgtgtattccaccttacaattacctagtgtcctttagcacgtggtccgcacgacctccgaggtcggaacgggcaaggtaggtggtcgtgtactagtttatttacattacgtgtaactaggtaaactaagtactaaatacgtacgtacgtaacgtccgtaccggtaggtaaaccggtctaacttaccaacctaaccgttcctaaccggaacggtaaactaaccgttacgaaacgtaaccgtacggtccgttacgttaccctaacgttaaacgaacggttaccgaaccgtagtaacccgtaggtaaaccgtaacggtcggtaaacccggtaaacggtacccggttacgttaccggtttaacccgttttaagttaacggtttacggtaccggtaccgggtaaaacgggttaaaccgttaacccgggtttaacgggttaagggttttaacccgtaaagggttttacgggtaaacgttttaaccgggggaaaaggggttaacggtaaaccccgtttacccggggg

SEQ ID NO: 1212 - DNA, 817 bp, Homo sapiens
  misc_feature: GYAE6OF01BM411.18.16.B05.1.454.CMB.1.raw
tcagtacgagtatgcacgaccggtgctcgatttagagctcacgtaaggggcgtgggagaggagcccagcactggaagtcgccggtgtttccattcggtgatcagcactgaacacagaggactcaccatggagtttgggctggaccttgggttttcctcgttgcttctttaagaggtatccagtgtcaggttcaacgtggtggaggtccggggagcgtggtcctgccgtgggacgtcgctgacgctctcctgtcgcacgtccttcgcggtattacaccttacgaattaccctatcgtctttcgccgtacgtcggtccgacacgacctccgaggtaccggacggggtccaggacgtcggtcgtgtacgttacgtttattactagttatggtaacgtaagggtaaaacttaagtacctaaaacgttaaccgaccggtaaccgtaacgttaaccccgttacgggtaaacgggtaaaccgggtacccgtaactttaacccgaaacccgttacgttaccccgtaaccgggtaacgggtaaacccttaaacccggttaaccggaaacccgggtaaaaccgttaaccccgggtaacctttaccgggttaacccttaaaccgttaaacggtaaacggtttaaaccgggaaccctaacgggtaccctaaggaaacccggtaacgtacgggtaaacccgtaaccggtaaccgggtccttacgttacgtttaacgttaggttccggtaacgtacggaaacggttcgtaacgttacggttacgttacgttgttaacggttacgttaaccggagggtaaccgagttcccgg

SEQ ID NO: 1213 - DNA, 784 bp, Homo sapiens
  misc_feature: GYAE6OF01B6AV9.18.16.B05.1.454.CMB.1.raw
  modified_base (475)..(475): a, c, t, g, unknown or other
  misc_feature (475)..(475): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccagtggtagtttgggctgtaccgttgggttttcctcgttgtcttacgttttaagaggtactccagtgtcgaggtctacagtggtcggacgggtccggggagtcggtgtccgtcggccggtggtcgtcgctaggacgtcctcgtcgtggtcaccgacgtccgtcgtagtacttacccgtaccttactaaccttacgtgttcgtacctttcggaccgtccggggttccgggtacccctacgaacggtacccgtaccgggaaggggacccgggtaaggggacctagggtacgggtcgtcgttacggtacgtttaggttttactcgaatttaggtagtaacgtaacgtaactaanccgtaaacgtacgacgtacgtaacgtaccgttcgggtaaaggtacccgtacgtaacgttacctaccgtacgtacccgtacgtaacgtaaccgtaacgtaccggaacgtaacgtcccgtacgttcctaaccgtacgtaaacgtacgtacgtaaccgtacgaccgtaaggtaaccgtacgtaccggaacgtacgttacggtcgttacgtttacttagttacggttcggtaacggtacgaaccggttaacgtacccggttagttacccggttacgttacggtacgttaaggtacggggtaaagtcgtaacgg

SEQ ID NO: 1214 - DNA, 811 bp, Homo sapiens
  misc_feature: GYAE6OF01A867L.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttctttaagaggtatcagtgtcaggttcaagtggtggacggtccgggggagcggtggtcctgccgtgggacgtcgcgtgacgtctcctccgtgtgcacgccttcgtggtacttacctaccttacaaacttaccttagttacgttcctttaggaccgttaccggtccggggttaccccgacccgtaacgtaaccccgttcccggaaccggggacccgggaaaacggggggtccccgaaaggggacggttcgggtcctttacggttaaccgtttaaaggttttaccttttaagaagttacgttaggtaacgttaacggtaaaactttaaacctaactaaaacgttaacccgtaacggaactaaccggtaccgtaccggtaaggggaaccggtactaacgttaccaccgtacttacccgacggtaacggtaacctaaacgttaccggaaaggtaacccacggtccgttaacgttaccttaaaccgtaacaacggtacgaacgtaccgtaactaggaaacctacgtaccggaacgaacccggtacgtacgttacgttacgtttattaggttcggaacggtacggtaagtacgtaacgttacggttaggtttacgtaaggttcgtaagtaccgggaaggttaacgtacggtccgg

SEQ ID NO: 1215 - DNA, 822 bp, Homo sapiens
  misc_feature: GYAE6OF01DVKS3.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggactgaccttgggttttcctcgttgcttcttttaagaggtactccagtgtcaggttacaacgtggtgggtaggtccggggggaggcgttcgggtcctgccgttggggacgtcgctggaacgctctcctggtcgccacgccttcgtaggtacttacctacctttactaaacttaccttaacttcggttctttacgccgtacgttcggggtcccgacctacgtacctccggaaggaccgggaacgggggccaaagggcggttgggcgttacgttacgtaagtttactttactaagttataggtagtaacggtaaacttaaactaacttaaacttaaccgttaacgacctaacgtacgttacccgggtaaggtaaccggggtaccgttaacgttacccgaaccttaaccgttaccgtaacccgggtaacggtaaacctaaacgtttacccggaacggtaaaccgtacgtccgttaccgtacgttaacctaaaccgtaaggtacggtaacacgtcggttaaacgaacgtaaccgtacggaccgtaaccggtcgtacggttacgtttaagtttaacgtttaggttacggtacggtacggtaacgaacgggtttaacgtaacccgggttacgggttttacggtacggttcggttaaacgtttagggaaacgggtaacgtacggttacccggg

SEQ ID NO: 1216 - DNA, 745 bp, Homo sapiens
  misc_feature: GYAE6OF01CWS5W.18.16.B05.1.454.CMB.1.raw
  modified_base (383)..(383): a, c, t, g, unknown or other
  misc_feature (383)..(383): n is a, c, g, or t
  modified_base (683)..(683): a, c, t, g, unknown or other
  misc_feature (683)..(683): n is a, c, g, or t
tcagtacgagtatgcacgaccggtgctcgatttagagctcacgtaagggcgtgggagaggagcccagcactggaagtcgccggtgtttccattcggtgatcagcactgaacacagaggactcaccagtggtagtttgggctgtaccgtttcgggtttttccttcgttgtcctttacgtttttaaaggtaggttactccgtagttgttccgtaggttcaacgttgggtgggtacgggtccgggggtaggtcggttcggtccgttcggcccgttaggggaccgttccgcgtggacgtcgttccttccgtgtcgcgtaccgtccttcgtacggtactttacctaccttactaacgtacttagtcgttcttcgcgtcgttacggccnccgacgacgtaccgaggacggacgggccaggtacgtcgtcgttagtcttaagttacttagtaagtacgtagtagtaacgtaaactaactaacgaaacgttacgtacgtacgtaacgtacccggtacggtaacggtaccggtctaaccgttaccgaacccttacgtccgtaaccggtagtaaacctacgttaccgaaacgtaaccgtccttccgtacgtacctaaacgtaaacgacggtcgaacgttacgaacgttagaaccgaacgtacgacgacgtccgttgtatcgtttaatcgtagngtaacgtagacgttacgttggtttcgtagttcgtacgtacgtaggtacggaacgtgtcccgg

SEQ ID NO: 1217 - DNA, 724 bp, Homo sapiens
  misc_feature: GYAE6OF01EYNJA.18.16.B05.1.454.CMB.1.raw
  modified_base (98)..(98): a, c, t, g, unknown or other
  misc_feature (98)..(98): n is a, c, g, or t
  modified_base (262)..(262): a, c, t, g, unknown or other
  misc_feature (262)..(262): n is a, c, g, or t
  modified_base (286)..(286): a, c, t, g, unknown or other
  misc_feature (286)..(286): n is a, c, g, or t
  modified_base (341)..(341): a, c, t, g, unknown or other
  misc_feature (341)..(341): n is a, c, g, or t
  modified_base (686)..(686): a, c, t, g, unknown or other
  misc_feature (686)..(686): n is a, c, g, or t
tcagtacgagtatgcacgaccggtgctcgatttagagctcacgtaaggggctgggagaggagcccagcactggaagtcgccggtgtttccattcggtnatcagcactgaacacagaggactcaccagtggtagtttgggctcggtaccgttgggtttttcctcgtttgtcttacgtttttaaagaggttatcctagttcgtctaggttcaacgtgggtaggacggtccgggggagtcggtggtcctggaccgtgggactcgngtgaacgtctctccgtgtcgctancctgtcggtacttcaaccttacaacttactattcgtctttgctacgtcgggtccncgtaagcctaccggagacggaacgggcaggtagtcggtcttagtacttagtttacttcaagttgtgtaacgtagtaaactaactacgtaaactacctaacgaccgtaacggtacccgtaccgggtaaggaaccgggttaccgtaacttacctaaccgtacttacccggtaaccgtaagggtaaacctaacggttaaccgaagaccgtaccgtcgttactacctaacgtaaagaacgtcggaacctcgtaacgtacgaactaacgcgtaaccgacgtacggtactacgttacgttattacgttaggagtaacggtaacgtacgtaacggttcgggttacggttacnggttaacgttacgttagaaccgggttaatcggtaccgg

SEQ ID NO: 1218 - DNA, 738 bp, Homo sapiens
  misc_feature: GYAE6OF01D77Y0.18.16.B05.1.454.CMB.1.raw
  modified_base (153)..(153): a, c, t, g, unknown or other
  misc_feature (153)..(153): n is a, c, g, or t
  modified_base (157)..(157): a, c, t, g, unknown or other
  misc_feature (157)..(157): n is a, c, g, or t
  modified_base (161)..(161): a, c, t, g, unknown or other
  misc_feature (161)..(161): n is a, c, g, or t
  modified_base (171)..(171): a, c, t, g, unknown or other
  misc_feature (171)..(171): n is a, c, g, or t
  modified_base (182)..(182): a, c, t, g, unknown or other
  misc_feature (182)..(182): n is a, c, g, or t
  modified_base (244)..(244): a, c, t, g, unknown or other
  misc_feature (244)..(244): n is a, c, g, or t
tcagtacgagtatgcacgaccggtgctcgatttagagctcacgtaagggcgtgggagaggagcccagcactggaagtcgccggtgtttccattcggtgatcagcactgaacacagaggactcaccgatgggagttgggctgactgggttttcngttncttntttaagagtntacctagtgtnaggttcaacgtgggtggcggtccggggagcgtgcctgcgtggacgtgctgagctctcgtgtnctacgtcctgtcggtaattcctaccttacaacgttaccctagttcgtactttcgacgtaccgtacgggtaccccgccgtaagaccgtccgacggaaccggtagggggacccaggtacggtcgggccttaggttacgtagtttaacttagaagttacgtaggtaacgtaggaaacctaagtactaaacgtaactaaccggtacacgtaaccgtacgtaacggacggacgtaacttacacccgtaattcccgaaggaacgtaaacctagttaccaaacggaacactccgttaacgttccaacttaaccaacggttacgtaacgtaccgtacgtaagaacctacggtaaacctagggtaaccgtcccggttaagtactaaccgtttattaacgggttcctaacggaacgtaccgggttaaccgtaacggttttacggttaacggtttccgtaaacgtttcgggttaactggggttaaacggtaacgtttcggaacgg

SEQ ID NO: 1219 - DNA, 738 bp, Homo sapiens
  misc_feature: GYAE6OF01A9QCK.18.16.B05.1.454.CMB.1.raw
  modified_base (220)..(220): a, c, t, g, unknown or other
  misc_feature (220)..(220): n is a, c, g, or t
  modified_base (401)..(401): a, c, t, g, unknown or other
  misc_feature (401)..(401): n is a, c, g, or t
  modified_base (551)..(551): a, c, t, g, unknown or other
  misc_feature (551)..(551): n is a, c, g, or t
tcagtacgagtatgcacgaccggtgctcgatttagagctcacgtaaggggctgggagaggagcccagcactggaagtcgccggtgtttccatcggtgatcagcactgaacacagaggactcaccatggagtttgggctgacctgggttttcctcgttgcttcttttaagaggtatccagtgtcaggttcaacgtggtggaggtccggggagcgtggtccngccgtgggacgtcgctggagtactctcctgtgcctagccttcgtggactttcgaacccttactaaacgttacctagttcgtcctttacgccgtaaccgttccggggtaccccgcctaacggtacctccggacgggaccgaaacggggtcccaggacggttggcgttgtaccgtaagttttnttaccaagttactaggtagtacggtaaacttaacgttacaaacgttaccgtaacggtacacggttaaccgtaccggtaaggaaccgggtcctaacttaccgacctaactcccgtaccgaacgggtactaaacgttaccgagggtaaaccncgtacttcggtactacgtaacgtaagtcggactacgtccgtagaaccgtacgtacggaacccgtagaccgttgtacgttacgttagttacgtggtacgtacgggtaacgtaacgttccggttacggttacgggttaacttcgggttaacgttacgttaggtaacggggtaaaccttaggtacccggg

SEQ ID NO: 1220 - DNA, 767 bp, Homo sapiens
  misc_feature: GYAE6OF01EYZRV.18.16.B05.1.454.CMB.1.raw
  modified_base (485)..(485): a, c, t, g, unknown or other
  misc_feature (485)..(485): n is a, c, g, or t
tcagtacgagtatgcacgaccggtgctcgatttagagctcacgtaagggctgggagaggagcccagcactggaagtcgcggtgtttccattcggtgatcagcactgaacacagagacctcacagtggtagtttgggctgtaccgttggtttttcctcgttgtctttacgttttaaagaggttactccagttgtacgtaggttaccaagtgggtagggacgggttccgggggaggtcggttggtccgtcggtaccgttggggaccgtcgcgtggacgtaccgttccgtccgtaggtcgccgtacgtccgttacggtagttacctttaccgaaccctttaagtaaccttaccctaagtttccgttctttacggaccgttaaccggtccgggtaccgaaccgtaacggtaccccgttaacggaacgggtaccggaacggggaccaaggtacggtcgtagttactaacggtttattattacgattacgngtaagtaagttaaactataactaacgtaaccgaccgtcgtaacgtcccgtaaggtacggacggttactacgtaccaacgtactcgtaccgagtaacgtacgtaacgaacgtactaacgtgttacgtaccttacgtaagtacgtacgaacgtcggtactaggaaccgtacgtacgaccgtaacgtcgtacttacgttaactttagttcgtagacggttagacgttaagtacgttacggttacgttaacgttcgtacgttaacgtaggaagtacgtcgtaccgg

SEQ ID NO: 1221 - DNA, 743 bp, Homo sapiens
  misc_feature: GYAE6OF01AOYDG.18.16.B05.1.454.CMB.1.raw
  modified_base (130)..(130): a, c, t, g, unknown or other
  misc_feature (130)..(130): n is a, c, g, or t
  modified_base (134)..(134): a, c, t, g, unknown or other
  misc_feature (134)..(134): n is a, c, g, or t
  modified_base (152)..(152): a, c, t, g, unknown or other
  misc_feature (152)..(152): n is a, c, g, or t
  modified_base (167)..(167): a, c, t, g, unknown or other
  misc_feature (167)..(167): n is a, c, g, or t
  modified_base (238)..(238): a, c, t, g, unknown or other
  misc_feature (238)..(238): n is a, c, g, or t
  modified_base (262)..(262): a, c, t, g, unknown or other
  misc_feature (262)..(262): n is a, c, g, or t
tcagtacgagtatgcacgaccggtgctcgatttagagctcacgtaaggggcgtgggaggaggagcccagcactggaagtcgccggtgtttccattcggtgatccaggcactgaacacagaggactcaccntggnttgggctgactggtttcncgttgctctttaagngtatcagtgtacaggttcaacgtggtgacggtcggggagcgtgtcctcggccgtggactcgctgagtaccncgtcgtagtcgacgatccgttcgngtaccttcgtaccctagtaaactacccgtagtcgttagtttacgacaccggttaccggttacccgacccggttaagcccttaaccggaaggaccgtaaacgggggtcctagggaacgttccggtaacttgggaaacctaggtttttaactaccgtaagtagtagttaaaccggtcgtaaaacgttaacgttaacgaaaactttacggtaaccgtacaggtaccgttacgggtaacggaacggtcttaccggtactaccgtactaccgttacgaacggtacgttaccaacgtaacgaacgtactaccgttagtacccttaacgaacgtaagtacgtactaacgtctacgggtaaagtaccgtaggtaaccgacgttaccgtacgttacccggtattaccggtaatccgttagcggttaaacggtataccggtaaggttacgtaggttaccgtaggttacttaggaaggtacgtaacgtccgg

SEQ ID NO: 1222 - DNA, 823 bp, Homo sapiens
  misc_feature: GYAE6OF01BS8OF.18.16.B05.1.454.CMB.1.raw
  modified_base (329)..(329): a, c, t, g, unknown or other
  misc_feature (329)..(329): n is a, c, g, or t
  modified_base (438)..(438): a, c, t, g, unknown or other
  misc_feature (438)..(438): n is a, c, g, or t
  modified_base (523)..(523): a, c, t, g, unknown or other
  misc_feature (523)..(523): n is a, c, g, or t
tcagtacgagtatgcacgaccggtgctcgatttagagctcacgtaagggctgggagaggacgcccagcactggaagtcgccggtgtttccattcggtgatcagcactgaacacagaggtacctcacctagtggtagtttgggctcgtaccgttcgggttttcctccggttagccttacgtttaagaggttactcgtacgtgtcgtaggttacaacgttgggtaggacggtccgggggaggtccgtggtccctggtccgtgggacgtcgctagacgtccttcctccgttggctacgacgtcccgttagtcggtattacctaccccgttanaacgttactagtcgttcttacgccgtacggtcccggtcggtccaacggacctacggaaggcggtaaaccggccgtaggacggttcggtcttacgtacgttaaccgtttnttaacgattaacgtgtaaacgtggtaaaactacgtaactaacgtaccgtacgtacgaccgtactcgggagtaccggtaccgttanaccgtacctgtacccagggtaacgtacttaaccggtacgtacggaacccgtcgacttaccgtcctaaacgttaagaccgtaggtaccaccggcttaacggcgtaaaccggttaccgggaaacccgtccgggtttaaccacgggttttaaccgtacgttttaacgttacggttaccggggtaaagtaaccccgggttaacgtaagggtttaaaccccggtttacggggtttaacgtttacgggttacgtttaacggttaccggttaggggtaaacggttaaccttaacgggggttaccccc

SEQ ID NO: 1223 - DNA, 891 bp, Homo sapiens
  misc_feature: GYAE6OF01CIAVZ.18.16.B05.1.454.CMB.1.raw
  modified_base (157)..(157): a, c, t, g, unknown or other
  misc_feature (157)..(157): n is a, c, g, or t
  modified_base (274)..(274): a, c, t, g, unknown or other
  misc_feature (274)..(274): n is a, c, g, or t
tcagtacgagtatgcacgaccggtgctcgatttagagctcacgtaaggggcgtggggagaggagcccagcactggaagtcgccggtgttccatcggtgatcagcactgaacacagaggactcaccatcggagtttgggcctgaccttgggttttccncgttgcttacttttaaggacggtatccgagtgtcagggttcaacgtggtggacggtccggggggagcgtgggtcctggaccgtgggacgttgccgtagacgtacttctcctgggtcncgacgtcctcgtaggctttccgtaacccttcaaaactttaccctaattcggtccttggtacccgtacggttccgggttccccgacgttaaggaccccttaccggaacgggacgggtaaacggggaccctagggtaacggtcggtccgtttaaggttccgttaaagttttagttaccgtaagttacggttacggaagtaaccgggtaaacttaaacgtacgttaaaacaaccggtttaaccgaacgtaaccgtacggtaaccggtacggtaaacgggcccgttataccctaaaccgcgttaacgtaacccggtaacgggtaaacgtaaacgttaccgaaacggtaaaacccgtccgtaaccgttaccggttaaccttaacgttaaaacggaaaccggtaccggtaactaaccggtaccggttaacgaaaccggtaaacccgttacggggaacccgaaccggttaacccgtacggttacttacggttaaactttcgggtaaccgttgggaaccgggttaacgtagggttaaaccggtttccggtttaaacggggtttcccgttaaggttacgggttaaacggttacggtaaacgggggtagttaaccgggttaacccgg

SEQ ID NO: 1224 - DNA, 1036 bp, Homo sapiens
  misc_feature: GYAE6OF01AP70S.18.16.B05.1.454.CMB.1.raw
tcagtacgagtatgcacgaccggtgctcgatttagagctcacgtaaggggctggggagaggagcccagcactggaagtcgccggtgtttccattcggtgatcagcactgaacacaggaggactcacctagtgggtagtttgggctacgtaccgtttcggggtttttccctcgttgtcctttacgtttttaaaggaggttacttccgtaggttcgttaccgtaagggtttacctaaacggttcggggttacggggtaacggggttcccggggggggtagggtccgggtttcggggttcccgttacgggtcccgggttacggggggtaccggttccggtccggttaggggaaccggtcccttttccgtacccggtttgggtaccggacctaccgggttcccgttaccggttacgggttaacctttaccccttaaccccgttttaaacgttaaaaccgttttaacccctaaggtttccggttaccggtttttacgggacccgttaacggggttacccgggggttcccccgaaccgttaaacgggtaccccgtaccgggaaaacgggggacccggggtaaaaccgggggtcccgtaaggggtaccgggttccgggttaccgtttaacgggtttaaccggtttaaggtttttaactttactaacgttaggtacggtaaacggtacgttaaaaaccttacgtaacctaaagttaaccccgttacgaaccgttacggtaacggtccgggtaacggggtaaccgtccgtaacgttccgtaacgttaccgtaccgaacggtaaccggtaactaaccgttaaccggaaggtaacccgtacggttcctacgttaccgttaaacctaacggtaacgtacgtacgtacgtgtaaccggtaacgtaccacgggtaaacccggtcggtaaccgttgtttaacgtacttttacggttaggttacgtacggaaccggttaattaaccggttcggttaacgggttcggtaacttacggtaagtacggtaggtagggtacccgttaaccgtcggg

SEQ ID NO: 1225 - DNA, 763 bp, Homo sapiens
  misc_feature: GYAE6OF01EYY5K.18.16.B05.1.454.CMB.1.raw
  modified_base (175)..(175): a, c, t, g, unknown or other
  misc_feature (175)..(175): n is a, c, g, or t
  modified_base (221)..(221): a, c, t, g, unknown or other
  misc_feature (221)..(221): n is a, c, g, or t
  modified_base (419)..(419): a, c, t, g, unknown or other
  misc_feature (419)..(419): n is a, c, g, or t
  modified_base (752)..(752): a, c, t, g, unknown or other
  misc_feature (752)..(752): n is a, c, g, or t
tcagtacgagtatgacacgaccggtgctcgatttagagctcacgtaagggctgggagaggagcccagcacgtggaagtcgccggtgtttccattcggtgatcagcactgaacacagaggactcaccatggagtttgggctgtaccttgggttttcctcgttgcttacttttaagnggttatccagttgtctaggttcaacgtgggtggacggtccgggggngtcgtggtcctggccgtggggacgtcgcgtaggagtccttccgtccgtggtcgacctacggtccccttgttaggtaacctttcctaaccctttactaactacccttaggtcttcctttgccgtacggttcgggaccccaccgtaacgccgtccggaacgggaccggaacggggcctaaggcggttcggcttaacggtntttaagttttattagggatttaccgtgaaagttacggtaaactagttaacaaccggtacttaacgctaaggttacccgtacgtaggggaaaccggtcctaacgttacccaccgtacttcccgaacgggaacggtaaccttaaacgttacccggaaaggtaccctccgtacgtttacggtaacctaccgttaaactaaggggccttaaccacggtaacccgtaggaaaccttaccggaccgacggtaaccgcgttacgttcgttaaacttgttcgttacgggagtacggcggttaaatcccgttagggttgtactggtaactagtccggaaagntaacggtcccg

SEQ ID NO: 1226 - DNA, 898 bp, Homo sapiens
  misc_feature: GYAE6OF01AYHHT.18.16.B05.1.454.CMB.1.raw
  modified_base (164)..(164): a, c, t, g, unknown or other
  misc_feature (164)..(164): n is a, c, g, or t
  modified_base (264)..(264): a, c, t, g, unknown or other
  misc_feature (264)..(264): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccagtggagtttgggctgtaccgttgggttttcctcggttntcttcgttttaaagaggtatccgaggtgtactacggttacaacgtgggtgggacgggtccggggggaggtcggtcgggtcctcggccgtaggggcgtcgngtcgacgtactcctccgtgtcgcgtacgtccttcgtcggttacttccttaaccctttaccaaaccgtttaacccttgttccgttaccgttaccggtaccctaacccgggttccggggtcccccgtaccgtaaccgtacccgtcccggaacggggtaaccgggaaaccgggggtcccgaagggttaccggtaggggtcctttacgggttacccgtttaagggttttaaccttacgttagttaaaccggttgtaaacggttaaccggttaaaacttaaactaaccgttaaacgttaaccgttaaaccggccggtaaacgttaccccggttccgggttaaacggtaacccggggtaccctttaacgttaccccgaacgttaaccgttacccggtaacggtaaccgggtaccgtaaaccggttaaccgaaacggtaacccggtaccgtaccgtacgttacccgtaacgtaaccgtaagtacggaacctaccggactacgacgtaccgacgtacgaaccgtacgtacgttctaacgttacgtaggttcgaaacggtacggtaacggtacggttaacgttacgggttacgggttacttacgttagggttacgttaccgggaaggttaacggtccgtacgg

SEQ ID NO: 1227 - DNA, 827 bp, Homo sapiens
  misc_feature: GYAE6OF01AKJLL.18.16.B05.1.454.CMB.1.raw
  modified_base (160)..(160): a, c, t, g, unknown or other
  misc_feature (160)..(160): n is a, c, g, or t
  modified_base (252)..(252): a, c, t, g, unknown or other
  misc_feature (252)..(252): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttncttcttttaagaggtatccagtgtcaggttcaactgggtggaggtccgggggagcgtggtcctgccgtgggcgtcgctgagctctcctgtcncagcctgtggtacttccacccttcaacttacctattcgtctttcggcctacggtcgggtccccgacctacggtacctcccgagggtaccgaacgggggcccaggtacggtcggtccttggtacttaggttttattttacctaagttagttaggtaacgttaacggggtaaaaccttaacgttacctaaaacgtttaacccgtacgaccgtaacggtaacccggtttacccgggttaaaggggaaacccggggtacccgtactttacccgaaccccttacgttaccccgtaaccccgggtaagggtaaacccctaaaccgtttaaccccggaacgggtaaaccctaccggtacgttaccggttacccgtaaccgtaaaccgtaacggtacggtaaccgtaaccggtcccgtaaggaaccggtaaacgttaccgggaaccgtaacccggtacggttaccgttacgttaccgtttacgtttacggttggtacggtaccggtaggtaacgttaccgttacgggttacgggtttactacgggttacgtacgtaaccggtagggtaacgtcggttacccgg

SEQ ID NO: 1228 - DNA, 801 bp, Homo sapiens
  misc_feature: GYAE6OF01D6JBP.18.16.B05.1.454.CMB.1.raw
  modified_base (785)..(785): a, c, t, g, unknown or other
  misc_feature (785)..(785): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtactccgagtgtccaggttcaacgtggtggacggtccggggaggtcggtggtcctcgccgtgggacgtcgcgtgagactctcctgtcgcacgcctcgtggtacttctaccttacaactacctatcgtcttcgccgacgttcggccgccgtacgacctccggaaggaccggaacggggacgacggtaggtcggtacgtcgttacgtacgtttatttcgaattacgtggtacgtaacggtaaattaaccgtaacgttaacttaaccgtaacgtaccgtaacgtacccgtttacgggtaacgggtaacggtacccgttaccttaacccgtaaccctacgtttaaccccgaacccggggtaacgggtaaacttaaacccgtaacccgaaaacaacccggtaaccgttctaccggtttaaacccaacctttaaacgtaaaccggtaccggaacctacggtacccgtaaacgggtaagaaacccggtccgtaaacccggtacggaccgttccgtttaactcggtttaattaccggtgtacggaaccggtaacggttagtaccgttaaccggtttcgggttaagttcgggttaaacgtacgttaaaagggtacgggtnttaaccgttacccggg

SEQ ID NO: 1229 - DNA, 676 bp, Homo sapiens
  misc_feature: GYAE6OF01DJPOX.18.16.B05.1.454.CMB.1.raw
  modified_base (264)..(264): a, c, t, g, unknown or other
  misc_feature (264)..(264): n is a, c, g, or t
  modified_base (269)..(269): a, c, t, g, unknown or other
  misc_feature (269)..(269): n is a, c, g, or t
  modified_base (273)..(273): a, c, t, g, unknown or other
  misc_feature (273)..(273): n is a, c, g, or t
  modified_base (280)..(280): a, c, t, g, unknown or other
  misc_feature (280)..(280): n is a, c, g, or t
  modified_base (288)..(288): a, c, t, g, unknown or other
  misc_feature (288)..(288): n is a, c, g, or t
  modified_base (311)..(311): a, c, t, g, unknown or other
  misc_feature (311)..(311): n is a, c, g, or t
tcagtacgagtatgcacgaccggtgctcgatttagagctcacgtaagggctgggagaggagcccagcactggaagtcgccggtgttccattcggtgatcagcactgaacacagaggactcaccatggagtttgggctgaccgttgggttttcctcgttgcttcgttttaagaggtatccagtgtccaggttcaacgtgggtggaggtccgggggagtcggtggtcctggccgtgggacgtcggctggaagtctcgtcctgtgcngcctntggntcacctnaactactntgtctttgctacgtcgggtcccncgacgtccgtccgagggaccgaaggggccaggaggtggctgtcgttattatcagtatgactagtaaactaatactaagtacctacgacgtaacgccgtttacggagggaaccggtcctaaacgttccaaccgtacttacctacccggaagtacctaaccgttacgaacggtaaaccacgtcttcggttacctaacaaacgtagtacgaaccgagtccctaaggaacgtaacgcggtaacgacggaccgttcggttagttaacttaacgtttggtaacggtcggagtaacggtaggtttaacccgttaggttacgggtttacgtggttaacggttagttacgggtaagggtagttacggttacggg

SEQ ID NO: 1230 - DNA, 738 bp, Homo sapiens
  misc_feature: GYAE6OF01B0BSL.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagagactcaccagtggtagtttgggctggaccgtttcgggttttccctcgttcgtcttacgttttaaagaggttactccgaagttgtcgtaggttcaacgtgggtggtacggtccgggggaggtccggtggtccgtcggtccgtagggaccgtcggcgttgacgtaccttctccgtgtcgcgtacgcctgtcggtacttaccgtaccttacgaaacttacctagttcgttctttcgacgtacggtcggtcccgtaccaacgtccgtacgacgggacggaaccggggccaggtaacggttcggtacgttcggttacttaagttttacgttacgagttaacgtagtaacgtaacgtaaactaacttacgtaaacgtactaaccggactaaccgtaccgtacggtaaggaaccggtactaccgtaccaaccgtacgtacccgtacgaacggttaacctaaccgtaccggaaagaccctacgtcgtacgtaacctagtaaacagtacgaagccgtacgtacgaacgtacgacgtaccgacgtacgttcgttagtacttagtttcgaggtacgacggtacgttagtaccgttacgttcgtatgttagacgttacgaggtaacgtcgtcgg

SEQ ID NO: 1231 - DNA, 491 bp, Homo sapiens
  misc_feature: GYAE6OF02GSCUM.18.16.B05.1.454.CMB.1.raw
  modified_base (487)..(487): a, c, t, g, unknown or other
  misc_feature (487)..(487): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggaggcgtggtcctgcctgggacgtcgctgagactctcctgtgcagcctctggattcaccttcaatacctatgctttgcactgggtccgccagactccaggcaaggggccagagtggctgtcagttattcatatgatggaactaatcaatactacgcagactcgtgaaggccattcacatctcaggacatccagacacgctgtctctacaatgacagcctgagactgacgacacgctgtctatattgtgcgagagactactggttactgtgattcgaggtanatcg

SEQ ID NO: 1232 - DNA, 509 bp, Homo sapiens
  misc_feature: GYAE6OF02F2UKV.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccagactccaggcaaggggccagagtggctgtcagttatttcatatgatggaactaatcaatactacgcagactccgtgaagggccgattcaccatctccagggacaattccaggaacacgctgtctctacaaatgacagcctgagaactgacgacacggctgtctattattgtgcgagagactacgtggttactgtgtattcgagggagatcg

SEQ ID NO: 1233 - DNA, 509 bp, Homo sapiens
  misc_feature: GYAE6OF02F0WQ6.18.16.B05.1.454.CMB.1.raw
  modified_base (293)..(293): a, c, t, g, unknown or other
  misc_feature (293)..(293): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggattttgggctgacctgggttttcctcgttgctcttttaagaggtatccagtgtcaggttcaactggtggagtccggggagcatggtcctgcctgggacgtcgctgagactctcctgtgcagcctctggattcaccttcaatacctatgctttgcactgggtccnccagactccaggcaaggggccagagtggctgtcagttatttcatatgatggaactaatcaatactacgcagactccgtgaagggccgattcaccatctccagggacaattccaggaacacgctgtctctacaaatggacagcctgagaactgacgacacggctgtctattattgtgcgagagactactgggttactggtgattcgagggagtaacg

SEQ ID NO: 1234 - DNA, 508 bp, Homo sapiens
  misc_feature: GYAE6OF02JA5Y3.18.16.B05.1.454.CMB.1.raw
  modified_base (391)..(391): a, c, t, g, unknown or other
  misc_feature (391)..(391): n is a, c, g, or t
  modified_base (435)..(435): a, c, t, g, unknown or other
  misc_feature (435)..(435): n is a, c, g, or t
  modified_base (449)..(449): a, c, t, g, unknown or other
  misc_feature (449)..(449): n is a, c, g, or t
  modified_base (502)..(502): a, c, t, g, unknown or other
  misc_feature (502)..(502): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccagactccaggcaaggggccagagtggctgtcagttattcatatgatggaactaatcaatactacgcagactccgtagaaggccgattcacatcncaggacattccaggacacgctgtctctacaaatgacagcctganactgacgacacggntcgtctattattgtgcgagacgacttacgtgggttactgtgtattgagggtanagttcg

SEQ ID NO: 1235 - DNA, 496 bp, Homo sapiens
  misc_feature: GYAE6OF02GPM41.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccagactccaggcaaggggccagagtggctgtcagttattcatatgatggaactaatcaatactacgcagactccgtgaaggccgattcacatctcaggacattcagacacgctgtctctacaatgacagcctgagactgacgacacgctgtctattatgtgcgagagtactactggttactgtgtattcagggtagatcg

SEQ ID NO: 1236 - DNA, 505 bp, Homo sapiens
  misc_feature: GYAE6OF02GJI9V.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccagactccaggcaaggggccagagtggctgtcagttattcatatgatggaactaatcaatactacgcagactccgtgaagggccgattcaccatctccagggacaattccaggaacacgctgtctctacaaatgacagcctgagaactgacgacacgctgtctattatgtgcgagagactactggttactgtgattcgagggagaatcg

SEQ ID NO: 1237 - DNA, 523 bp, Homo sapiens
  misc_feature: GYAE6OF02GSTIL.18.16.B05.1.454.CMB.1.raw
  modified_base (441)..(441): a, c, t, g, unknown or other
  misc_feature (441)..(441): n is a, c, g, or t
  modified_base (479)..(479): a, c, t, g, unknown or other
  misc_feature (479)..(479): n is a, c, g, or t
  modified_base (506)..(506): a, c, t, g, unknown or other
  misc_feature (506)..(506): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccaggcctccgggggaagggccggagtgggtggccaacataatgcaagatggaactgagaagaactatgtggactctgtgaagggccattcaccatctccagagacaacactaagacttactgtatctgacaaatgaacagcctanagacgccgagaccacggctgtgtattactgtgcgaagngcagtggctgggacagtcggacgtcgnggggaccaagggacccg

SEQ ID NO: 1238 - DNA, 504 bp, Homo sapiens
  misc_feature: GYAE6OF02G6UW7.18.16.B05.1.454.CMB.1.raw
  modified_base (295)..(295): a, c, t, g, unknown or other
  misc_feature (295)..(295): n is a, c, g, or t
  modified_base (386)..(386): a, c, t, g, unknown or other
  misc_feature (386)..(386): n is a, c, g, or t
  modified_base (499)..(499): a, c, t, g, unknown or other
  misc_feature (499)..(499): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccnccagactccaggcaagggccagagtggctgtcagttattcatatgatggaactatcaatactacgcagactcgtgaaggccattcacatcncgaggacatcagacacgctgtctactacaaatgacagtcagagaactagacgacgacgctgtacttattatgtcgacgagacgtactacgttggttactgtgattcgaggtanagtcg

SEQ ID NO: 1239 - DNA, 509 bp, Homo sapiens
  misc_feature: GYAE6OF02IL16H.18.16.B05.1.454.CMB.1.raw
  modified_base (295)..(295): a, c, t, g, unknown or other
  misc_feature (295)..(295): n is a, c, g, or t
  modified_base (390)..(390): a, c, t, g, unknown or other
  misc_feature (390)..(390): n is a, c, g, or t
  modified_base (411)..(411): a, c, t, g, unknown or other
  misc_feature (411)..(411): n is a, c, g, or t
  modified_base (462)..(462): a, c, t, g, unknown or other
  misc_feature (462)..(462): n is a, c, g, or t
  modified_base (503)..(503): a, c, t, g, unknown or other
  misc_feature (503)..(503): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccnccagactccaggcaaggggccagagtggctgtcagttattcatatgatggaactaatcaatactacgcagactcgtgaaggccgattcaccatcnccaggacattccaggacacgntgctctacaaatgacagcctgagaactgacgacacggctgtctattattgngtcgagagactacgtggttaactggtagtattcgagggtanaagtcg

SEQ ID NO: 1240 - DNA, 510 bp, Homo sapiens
  misc_feature: GYAE6OF02GHL9G.18.16.B05.1.454.CMB.1.raw
  modified_base (392)..(392): a, c, t, g, unknown or other
  misc_feature (392)..(392): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccagactccaggcaaggggccagagtggctgtcagttatttcatatgatggaactaatcaatactacgcagactccgtgaagggccattcaccatcncaggacaattccaggaacacgctgtctctacaaatgacagcctgagactgacgacacggctgtctattatgtgcgaagagactacgtggttactggtgtattcgagggtagtaagtcg

SEQ ID NO: 1241 - DNA, 494 bp, Homo sapiens
  misc_feature: GYAE6OF02JGLM1.18.16.B05.1.454.CMB.1.raw
  modified_base (411)..(411): a, c, t, g, unknown or other
  misc_feature (411)..(411): n is a, c, g, or t
  modified_base (490)..(490): a, c, t, g, unknown or other
  misc_feature (490)..(490): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggagcgtggtcctgcctgggacgtcgctgagactctcctgtgcagcctctggattcaccttcaatacctatgctttgcactgggtccgccagacctccaggcaaggggccagagtggctgtcagttatttcatatgatggaactatcaatactacgcagactccgtgaaggccgatcacatctcaggacatccagacacgctgctntacaatgacagccagagacgtgacgacacgctgtctagttatgtgcgagagactagtggttactgtgtatcgagggtanatcg

SEQ ID NO: 1242 - DNA, 624 bp, Homo sapiens
  misc_feature: GYAE6OF02JHMFV.18.16.B05.1.454.CMB.1.raw
  modified_base (171)..(171): a, c, t, g, unknown or other
  misc_feature (171)..(171): n is a, c, g, or t
  modified_base (257)..(257): a, c, t, g, unknown or other
  misc_feature (257)..(257): n is a, c, g, or t
  modified_base (299)..(299): a, c, t, g, unknown or other
  misc_feature (299)..(299): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatgggagtttgggctgacctgggttttcctcgttgctcttttaagnggtatccagtgtcaggttcaactggtggagtccgggggaggcgtggtcctgcctgggacgtcgctgagactctcctgtgcagcctntggattcaccttcaatacctatcgctttgctacgtgggtccnccagtacctccgaggccgaaggggccaggagtcggctgtcagttattcatatgataggaactaatcaatactacgctagactccgtaggaacgggtccaattccacctactacctaccgaaggacctaacgttccgaacggaacaccgcttaggtccttactaacgtaacgtacggtacacggtctaggaacgaacgtacgaaccgtaccgacgtaccttgttaacgttatttagttcggtaggaccggtaaggtaacgtaccgttaacggttacgggtttactagggttacgtaggttaccggaagggtacgtaacgttaccgg

SEQ ID NO: 1243 - DNA, 593 bp, Homo sapiens
  misc_feature: GYAE6OF02GYOQS.18.16.B05.1.454.CMB.1.raw
  modified_base (298)..(298): a, c, t, g, unknown or other
  misc_feature (298)..(298): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagaggtatccagtgtcaggttcaactggtggagtccgggggagcgtggtcctgcctgggacgtcgctgagactctcctgtgcagcctctggattcaccttcaatacctatgctttgctacgtgggtcccnccagacctccgaggcaaggggccaggagtggctgtcagttattcatatgataggaactaatcaatactacgcagacctccgtaggaacgggccgtaattccaccacttcctaccgagggaactaacttccgaaggaaccacgctacgtcctactaacaaagtcgaaccagcctaggaacgtaacgtcgaaccgaacacggtctcgtaccttattacgttagtcggacgtacggaacgtacgttacgttagggtttaagttcggttaggtaacgtttcggaagggtataacgtcgg

SEQ ID NO: 1244 - DNA, 693 bp, Homo sapiens
  misc_feature: GYAE6OF02F96U2.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcacgtgggtccgccagactccaggcaaggggccaggagtggctgtcagttatttcatatgtataggtaaactaatactaaattaactacgacacggaaccgttaccggtaggaacggggtaccgtaagtttcccaaccctaacgttcccgtacccgaacggggtaacctaaacgtttacccgaacgggaaacctaccggtacgtttacgttacctaccttaaacaaaacgttcgggaacctacgacccgttaggaacgtaaccgtacggaaaccgaaccgaccgggtaccttacggttaaccttaagttttacgtttaggttacggtaccggaaggtaacggtaaccgttacgtttacggggtttaaccgttggttacgtagtttaccgaaggggtacgtaagttccgg

SEQ ID NO: 1245 - DNA, 535 bp, Homo sapiens
  misc_feature: GYAE6OF02F6U1M.18.16.B05.1.454.CMB.1.raw
  modified_base (485)..(485): a, c, t, g, unknown or other
  misc_feature (485)..(485): n is a, c, g, or t
  modified_base (489)..(489): a, c, t, g, unknown or other
  misc_feature (489)..(489): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgctttgcactgggtcccgccagacctccagggcgaaggggcccaggagtggctgtcagttatttcatatgatggaactaatacaaatactacgcaagacctccgtaggaacgggccgaattccaccatcctaccgaggacaattccgaaggaaccacgctgtctctacaaatggacagctagacgactgacgacacgctagtctattnttgngcgagagactacgtggttacgtgtgtagttcgagggtagagtacgg

SEQ ID NO: 1246 - DNA, 633 bp, Homo sapiens
  misc_feature: GYAE6OF02JJ0ZU.18.16.B05.1.454.CMB.1.raw
  modified_base (599)..(599): a, c, t, g, unknown or other
  misc_feature (599)..(599): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggagcgtggtcctgcctgggacgtcgctgagctctcctgtgcagcctctggacttcaccttcaatacctatgctttgcactgggtccgccagacctcgaggcaaggggccagagtggctgtctagttatttcgatagtgactaggaactaatcaatactacgctaacgactccgtaggaacggtccgattccaaccataccgtacgaacgggacctaaacgttaccgaacggaaccgtacgccgttacggttaccttacctaaacgaaacgttcggaacctacggtcccgtagaacggtaaaccgttacgaaccgaaccgtaccggtacttacggtttactaagtttacgttagtacggacgtaaggtaacgtacgttaggttacgggtttaanggttacgtagttacggtacgggtagtacgttcgg

SEQ ID NO: 1247 - DNA, 505 bp, Homo sapiens
  misc_feature: GYAE6OF02FMR88.18.16.B05.1.454.CMB.1.raw
  modified_base (294)..(294): a, c, t, g, unknown or other
  misc_feature (294)..(294): n is a, c, g, or t
  modified_base (432)..(432): a, c, t, g, unknown or other
  misc_feature (432)..(432): n is a, c, g, or t
  modified_base (501)..(501): a, c, t, g, unknown or other
  misc_feature (501)..(501): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgctttgcactgggtccnccagactccaggcaaggggccagagtggctgtcagttatttcatatgatggaactaatcaatactacgcagactccgtgaagggccattcacatctcaggacaattccaggaacacgctgtctctacaatgacagccngagactgacgacacgctgtctattattgtgcgagagtactacgtggttactggttgagttcgagggtanatcg

SEQ ID NO: 1248 - DNA, 508 bp, Homo sapiens
  misc_feature: GYAE6OF02G2EU0.18.16.B05.1.454.CMB.1.raw
  modified_base (467)..(467): a, c, t, g, unknown or other
  misc_feature (467)..(467): n is a, c, g, or t
  modified_base (497)..(497): a, c, t, g, unknown or other
  misc_feature (497)..(497): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgctttgcactgggtccgccagactccaggcaaggggccagagtggctgtcagttattcatatgatggaactaatcaatactacgcagactcgtgaagggccgattcaccatctcagggacaattccagaacaagctgtctctacaaatgacagcctgagaactgacgacacggctgtactattattgtgngagaagactacgtggttactggtgtagttnagggtagatcg

SEQ ID NO: 1249 - DNA, 629 bp, Homo sapiens
  misc_feature: GYAE6OF02J2G8W.18.16.B05.1.454.CMB.1.raw
  modified_base (254)..(254): a, c, t, g, unknown or other
  misc_feature (254)..(254): n is a, c, g, or t
tcagtacgagtatgcacgaccggtgctcgatttagagctcacgtaagggcgtgggagaggagcccagcactggaagtcgccggtgtttccattcggtgatcagcactgaacacagaggactcaccatggagtttgggctgacctgggttttcctcgttgctctttaagaggtatccagtgtcaggttcaactggtggagtccggggagcgtggtcctgccgtgggacgtcgctgagactctcctgtgcagcctntggacttccaccttcaaatacctatcgtcttgcacgtggcccgcagacctcgagcgaagggccaggagtggcctgtacagtttattcatatgaatggaaactatacaactacgtacgctacgtacctcggtaggaaacgggtcctaattccacgtactacctaccgaacgggaactaacgttaccgaacggtaaccacgtcgttacgtaccttacgtaaactaaacgtcggaacctacgaccgttaggaacgtaaccgtacggaaccggaccgtaccgggtaccttacgtacttacgtttagtgtacgtaccggaagtacgtacttacggttacggttacttaggtacgtacttacggacggtacgtacgtccgg

SEQ ID NO: 1250 - DNA, 609 bp, Homo sapiens
  misc_feature: GYAE6OF02JBDXR.18.16.B05.1.454.CMB.1.raw
  modified_base (154)..(154): a, c, t, g, unknown or other
  misc_feature (154)..(154): n is a, c, g, or t
  modified_base (170)..(170): a, c, t, g, unknown or other
  misc_feature (170)..(170): n is a, c, g, or t
  modified_base (299)..(299): a, c, t, g, unknown or other
  misc_feature (299)..(299): n is a, c, g, or t
  modified_base (335)..(335): a, c, t, g, unknown or other
  misc_feature (335)..(335): n is a, c, g, or t
  modified_base (365)..(365): a, c, t, g, unknown or other
  misc_feature (365)..(365): n is a, c, g, or t
  modified_base (448)..(448): a, c, t, g, unknown or other
  misc_feature (448)..(448): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttccncgttgctcttttaagnggtatccagtgtcaggttcaactggtggagtccggggagcgtggtcctgcctgggacgtcgctgagactctcctgtgcagcctcgtggatttcacctttcaataccctatcgctttgctactgggtccnccagactccaggcaagggccagagtgctgtcagttnttcatatgatggaactaatcaatactacgnagactccgtagaacgggtccattacacatctacgagggactaatccgagtaaacacgctcgtactactaacaaacgtcgaacncgaccctaggaacgtaaacgtagaaccgtaaccgtacggtacgtacgtactttaagtacgtttggttacggacggaacgtaacggttaaccttacggtaccgggttttaacgtacgttacgggttaacgttccgggtaaaggggttacggaaaccgttcgg

SEQ ID NO: 1251 - DNA, 733 bp, Homo sapiens
  misc_feature: GYAE6OF02IUIXO.18.16.B05.1.454.CMB.1.raw
  modified_base (269)..(269): a, c, t, g, unknown or other
  misc_feature (269)..(269): n is a, c, g, or t
  modified_base (348)..(348): a, c, t, g, unknown or other
  misc_feature (348)..(348): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagaggtatccagtgtcaggttcaactggtggagtccggggagcgtggtcctgcctgggacgtcgctgagctctcctgtgcagcctcgtggattcgaccttnaactacctatcgtctttgctacgtcgggtccgccaagtcctccgaggcaaggggccaaggcgtggcctgtactaagttnttacaattagtagtaactcggtaaactaagtactaaacgttactacgactaacgtaacgtccggtaggaaacgggccctaagttacccaaccgtacgttaccgtacccggtaacgggtaacctaaacgttacccgaaacggggtaaacctaccgggtaccgttacggttacccttaacccgttaaacgtaaaaccgttacgggaaacctaccggtaacccgttaacggaaaccgtaaacgttaaccggaacccggaaacggtaaccgggttccttaaggttaccgtaagtttacgttacggtcgtaacggtaaccggtaagtacccggtaacgtttacgggttaactacggttacgtagttaaccggaaggtacgtaaacttcgg

SEQ ID NO: 1252 - DNA, 656 bp, Homo sapiens
  misc_feature: GYAE6OF02IFKJQ.18.16.B05.1.454.CMB.1.raw
  modified_base (298)..(298): a, c, t, g, unknown or other
  misc_feature (298)..(298): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcctacgtgggtccnccagacctccgagggcgaaggggcccaggacgtggctgtctagtttatttcatatgatggaactaatacaatactacgcacgactcgtagaacgggtcctattccaccacttaccgtaccgaagggtacctaaacgttaccgaacgggaaacctacgtaccttacggttaccttaccttaacgaaacgttcgggaactacggtaccgtaaggaacggtaaaccgtacggaaccgtaacgaccgggtacttacggttaccgttaagtttacttaggtacggtacggaaggtaacgtacgttaacggttacgggtttaactcggttacggtacgtttacggaagggtacgtaagttccgg

SEQ ID NO: 1253 - DNA, 521 bp, Homo sapiens
  misc_feature: GYAE6OF02JBQ4I.18.16.B05.1.454.CMB.1.raw
  modified_base (336)..(336): a, c, t, g, unknown or other
  misc_feature (336)..(336): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggactcgctgagactctcctgtgcagcctgtggattcaccttcaatacctatgctttgctacgtcgggtccgccagactccaggcaaggggccaggagtggctgtctagttnttcatatgatggaactaatcaatactacgcagactccgtagacggcattcacatcacgaggacatccaggacacgtctgtctactaacaatgacacgcctagacgacgtgacgacgacgctgtactagttatgtacgcgtagtactacgtacgttggttactgtgtagttcgaggtacgtagtcg

SEQ ID NO: 1254 - DNA, 592 bp, Homo sapiens
  misc_feature: GYAE6OF02HPQ5P.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtgggtcctgcctgggacgtcgctgagactctcctgtgcagcctctggattccaccttcaatacctatgctttgctacgtcgggtccgccacgactcccgaggccgaaggggccaggagtggctgtcagttattcatatgataggtaactaatacaatactacgacagtacctaccgtagaacgggccgattaccacattccaccgaagggactaacttccgaaggtaacacgtctcgttcctactaactaaagcggaacacggactagaacgaacgtgaaccgacgacgcttagtcttattattgtagtacggtaagacgtacgttaacggttggtttaaccgtgttacggtattaccggaagggtacgtaattaccgg

SEQ ID NO: 1255 - DNA, 558 bp, Homo sapiens
  misc_feature: GYAE6OF02G3L2E.18.16.B05.1.454.CMB.1.raw
  modified_base (427)..(427): a, c, t, g, unknown or other
  misc_feature (427)..(427): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattccaccttcaatacctatgctttgcactgggtcccgccagactccaggcaaggggccaggagtggctgtctagttattcatatgatggaactaatcaatacacgcagactcgtagaacgggcctattcaccatcctacgagggactaacgttccaaggaacacgctntctactaacaactggacagcctagaacgaactcgacgaccgacgactgtacttattattgtagacggagtaacgacgttaacgttcgggtttactggttacggtagtttaccggagggtacgtagtaccgg

SEQ ID NO: 1256 - DNA, 524 bp, Homo sapiens
  misc_feature: GYAE6OF02I1UQV.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccagactccaggcaaggggccagagtggctgtcagttattcatatgatggaactaatcaatactacgcagactcgtagaacgggccattcaccatcctccgaggacaattccaaggaacacgctgtctactacaatcgacacgctagacgactagacgacgacgctgtactattattgtcgcgtagacgtactacgtggttactgtagtagttacgagggtatagtcgg

SEQ ID NO: 1257 - DNA, 567 bp, Homo sapiens
  misc_feature: GYAE6OF02HM0EC.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgctttgcactgggtccgccagactccaggcgaaggggccagagtggctgtcagttattcatatgatggaactaatcaatactacgcagactcgtgaacgggccgattccaccatcctaccgaagggactaaacttccaacggtaaccacgctgtcttactaacaaatcgggacacggcctaggacgaacgtgaccgacgacggcttaggtaccttagttacttggtaggacgtaagacggtactacgttagggttaccttggttacggattacggagggtataagtccgg

SEQ ID NO: 1258 - DNA, 567 bp, Homo sapiens
  misc_feature: GYAE6OF02GLOKP.18.16.B05.1.454.CMB.1.raw
  modified_base (444)..(444): a, c, t, g, unknown or other
  misc_feature (444)..(444): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgccgtgggacgtcgctgagactctcctgtgcagcctcgtggacttccaccttcaataccctatgtctttgcactgggtccgccagactccaggcaaggggccagagtggctgtcagttattcatatgatggaaactatcaatactacgcagactccggtagaagggccgtatccaccatctccgaggacattccaggaacacgctgtctactaacaagtgaacncgactagacgaacgtcgacgaaccgacggctacgtctatttattggtcgtacgaacggaagtacgttaccggttagggtttacctaggttacgtaagtttacggaaggggtactagttaccgg

SEQ ID NO: 1259 - DNA, 517 bp, Homo sapiens
  misc_feature: GYAE6OF02HFM0I.18.16.B05.1.454.CMB.1.raw
  modified_base (426)..(426): a, c, t, g, unknown or other
  misc_feature (426)..(426): n is a, c, g, or t
  modified_base (443)..(443): a, c, t, g, unknown or other
  misc_feature (443)..(443): n is a, c, g, or t
  modified_base (487)..(487): a, c, t, g, unknown or other
  misc_feature (487)..(487): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcagtaactactacatggcctggatccgccaggctccagggaagggctggagtacgtctcatacatcagtaacactggaaataccatatactagcagactctgtgaggggccgatttcaccatcgccaagggacaacgaccaagagctcacattatctncagatgactgccctganagccgagccgtcggtccttatactgtgcgagagactccccgggnacgtgcgtggaccgaccggtctcggttaac

SEQ ID NO: 1260 - DNA, 623 bp, Homo sapiens
  misc_feature: GYAE6OF02F6NW9.18.16.B05.1.454.CMB.1.raw
  modified_base (254)..(254): a, c, t, g, unknown or other
  misc_feature (254)..(254): n is a, c, g, or t
  modified_base (380)..(380): a, c, t, g, unknown or other
  misc_feature (380)..(380): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggagcgtggtcctgcctgggacgtcgctgagactctcctgtgcagcctntggattcaccttcaataccctatgtctttgcacgttcgggtcccaccacgaccttcccgaagggccgtaacgggggcccaaggaggttgggccttggtcagttactttcattatgatggaactaancaatactacgcagactcgtagacggctatcaccatcctcgaggtactaagttccaaggaacacgcttacgtcctcgtaacaaagtcggaactacgaccgtagaacgtaaccgtacggaccgtaccgaacggtcgtacgttacctaagtttagttgttacgacggtaacggaacgtaacccgttaacggtcgggtttaaccgttggttacggttaatttacggaacgggtacgtaagttaccgg

SEQ ID NO: 1261 - DNA, 560 bp, Homo sapiens
  misc_feature: GYAE6OF02I7V5Q.18.16.B05.1.454.CMB.1.raw
  modified_base (300)..(300): a, c, t, g, unknown or other
  misc_feature (300)..(300): n is a, c, g, or t
  modified_base (510)..(510): a, c, t, g, unknown or other
  misc_feature (510)..(510): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggaggtccgggggaggcgtggtcctgccgtgggacgtcgctgagactctcctgtgcagcctctggattcaccttcaatacctatgctttgctacgtgggtcccnccagacctccgaggcgaaggggccaggagtggctgtctagttattcatatgataggaaactaatcaatactacgacaagacctccgtaggaacgggtcctattaccacctactcctaccgaagggacctaacttccaacggaacacgtctagtctactaacaaagtcgacacgcctagaacaacgtacgacgacgacgctagtactattntgtgacgagacgtactacgttggttactgtagtatcggaggtagtagtcg

SEQ ID NO: 1262 - DNA, 520 bp, Homo sapiens
  misc_feature: GYAE6OF02HXJ2X.18.16.B05.1.454.CMB.1.raw
  modified_base (515)..(515): a, c, t, g, unknown or other
  misc_feature (515)..(515): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgctttgcactgggtccgccagacctccaggcaaggggccagagtggctgtcagttattcatatgatggaactatcaatactacgcagactcgtgaacgggtccattccactactctaccgagggactaagtccaggaacacgctcgtctactacaagtgacagctgacgactgacgacacggctcgtacttattattgtgcgtagacgtactacgtggttactgtcgtatcgaggtanagtcg

SEQ ID NO: 1263 - DNA, 574 bp, Homo sapiens
  misc_feature: GYAE6OF02F18X5.18.16.B05.1.454.CMB.1.raw
  modified_base (256)..(256): a, c, t, g, unknown or other
  misc_feature (256)..(256): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctntggattcaccttcaatacctatgtctttgcacgtcggggtcccgccacgactccgaggcgaacgggggcccaaggagtcgggctggtactaggtttatttcaattatgtatggaactaatacaaattactaacgacaagtacctaccgtaggaacgggcctagtaccaccatccaccgacgggtactaacttccaaggaaccacgtcgtcgttctactaacaaatgacacgcctgacgaacgagacgacgacgctcgtactattattgtcgtacgagtagtactacgttggttactgtagtattcggaggtagagtcg

SEQ ID NO: 1264 - DNA, 628 bp, Homo sapiens
  misc_feature: GYAE6OF02GUB8E.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgccagacctccaggcaaggggccagagtggctgtcagttattcatatgatggaactaatcaatactacgcagactccggtagaacgggccgattccacctactcctaccgacgggactaacgttccgaacggaaccaccgacttcggtccttaccgtaacaaagttcggaacctaggacccttaggaacgtaaaccgtgaaccgaaccgaacggtcttacgttacttaagtttagtttcggtggtaccggtaaggtaacgtaccgtttaacggttaggggttttacgttaggttacggttacgtttacggaaggggttaacgtaacgttaccgg

SEQ ID NO: 1265 - DNA, 567 bp, Homo sapiens
  misc_feature: GYAE6OF02G5XTQ.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaattacctatcgtctttgctacgtcggggtcccgccacgactccgaggccaagggggccaggagtggctgtcagttattcatatgatggaactaatcaatactacgcagacctcgtaggaacgggccgattccaccattcctaccgaacgggtaccaacgttccaaggaaccacgtctcgttacctcttaacaagtcgacacgcctagacgactgaccgacacggtctgtacttattattgtagcggtagagtacgtacgttcggttactggttagtagttacggagggtagtatcgg

SEQ ID NO: 1266 - DNA, 663 bp, Homo sapiens
  misc_feature: GYAE6OF02GEB63.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgccgtggggggtccctgagactctcctgtgcaggccctgcattcattctttaatagttattggatgcacgtgggtccgccaggcgtccgggggaaggggccggaggtgggtcggccaacgataatgacaagatggaactgaagaagaactatggtaggactcgtggtaggaagggccgtattccgactactcctcgagacgacaaacaacgtaagtaacctttactagtatacctagaacctaaagtcgaaacgtacgccctacgaaggacggccgaacggaaccgacgggtccttggttacttaacgtttaccgtggttacgacgggaagtacgacgtaagggttcggaaccggttagggggaaccctaggttacggggaaccggttccgggtaccgggggggaacccaaacgggggggtacccctaacccggggttacccg

SEQ ID NO: 1267 - DNA, 606 bp, Homo sapiens
  misc_feature: GYAE6OF02HYJS3.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtctgccgtgggacgtcgctgagactctcctgtgcagcctctggattcaccttcaatacctatgctttgcacgtcgggtccgccacgactccgaggcgaaggggccagagtggctgtcagtttattcatatgtataggaactaagtacaatactaacgcacgactccggtagaacgggccgtacgttcaacctactcctaccgaaggtaaccaacgttaaccaaacgaaccaccgacctagttacctctaactaaagtcgaacgtaacgcgtacgaaggtaaccgtacgaaccgacgaccgacgttacgtacttagttattggtcgaggtaagtaagtactacggttagggttaccgttggtacgtagtttacggaagggtagtaacgtacg

SEQ ID NO: 1268 - DNA, 687 bp, Homo sapiens
  misc_feature: GYAE6OF02IQCMN.18.16.B05.1.454.CMB.1.raw
  modified_base (248)..(248): a, c, t, g, unknown or other
  misc_feature (248)..(248): n is a, c, g, or t
  modified_base (277)..(277): a, c, t, g, unknown or other
  misc_feature (277)..(277): n is a, c, g, or t
  modified_base (293)..(293): a, c, t, g, unknown or other
  misc_feature (293)..(293): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtgctgagctctcctgtgcngcctcgtggattcaccttcaatacctatnctttgcacgtggtccncctagacctccagggcgaacggggccagagtggctgtcagttattcatatgatggaactaatcaaatactacgacaagactccgtagaacgggccgtaacttaccaccgtaacttacctacccgaacgggtaacctaaacgttccgaaacgggtaaccgtacgtaccgttacgtaccgtttactaaacgtaaaacttcgggaaccgtaacgccgtaaggtaacggaaccgtaggaaccggaaccgaaccgggtccttacggttaattaacgttttacgtttagggtacggtaccggtaaaggtaaccgtaaccggtttaacggttacggggttttaacccttagggtttacggttacggtttaaccgggtaaggggtaacgtacgttaaccggg

SEQ ID NO: 1269 - DNA, 568 bp, Homo sapiens
  misc_feature: GYAE6OF02IX3EQ.18.16.B05.1.454.CMB.1.raw
  modified_base (162)..(162): a, c, t, g, unknown or other
  misc_feature (162)..(162): n is a, c, g, or t
  modified_base (259)..(259): a, c, t, g, unknown or other
  misc_feature (259)..(259): n is a, c, g, or t
  modified_base (380)..(380): a, c, t, g, unknown or other
  misc_feature (380)..(380): n is a, c, g, or t
  modified_base (464)..(464): a, c, t, g, unknown or other
  misc_feature (464)..(464): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctnttttaagaggtatccagtgtcaggttcaacgtggtggaggtccgggggagcgtggtcctggccgtgggacgtcgctgagactctcctgtgcagcctntggaacttaaccttcaactacctatgtctttgccacgtggtccgcagactccgaggcgaaggggccaggacgtgggctgtactagtttacttcatatagataggaactatactaatactancagactcgagagggcatcacatctacgaggacacgtcaaggacacgctcgtacctcgtaacaagtcgaacacgtcagagaacgngaccgacgaccgtnttacgtnttaagttcttaggtcacggaagtcggtaacttacggttaggttacgtaggtacgtagttacggagggaacgtagtccgtacgg

SEQ ID NO: 1270 - DNA, 816 bp, Homo sapiens
  misc_feature: GYAE6OF02H61F2.18.16.B05.1.454.CMB.1.raw
  modified_base (156)..(156): a, c, t, g, unknown or other
  misc_feature (156)..(156): n is a, c, g, or t
  modified_base (172)..(172): a, c, t, g, unknown or other
  misc_feature (172)..(172): n is a, c, g, or t
  modified_base (319)..(319): a, c, t, g, unknown or other
  misc_feature (319)..(319): n is a, c, g, or t
tcagtacgagtatgcacgaccggtgctcgatttagagctcacgtaaggggctgggagaggagcccagtcactggaagtcgccggtgtttccattcggtgatcagcaactgaacacagaggactcaccatggagtttgggctgacctgggttttccncgttgctcttttaagnggtatccagtgtcaggttcaacgttggtggacgtccgggggagcgtggtcctgccgtgggaccgtcgctggagactctccgtagtcgcagtcctcgtggacttccaccctttcaaattcctagtcgctttgactacgtcgggttccnccgaggaccctaccgaaggaccgaaggggcccaaggtcgtcggacttgtacgtaagttttatttcagttactgtagtacggaaacttaagtccaaattacgtaacgactacgtacctccgggtaggaaacggggtcctaactttccaacctacgttccgtacccggtaacggggtaaacctaaacgtttacccgaaacgggtaaaccctacggtaccgttacgttacccttaccgttaaaaccgtaaaggttcgggaaaccgtacggtaacccgttaacgggaaaccggttaaccgttacggaaacccggtaaccgtaaccccgggttaccgttacggtttaaccgtttaacgtttttaacgtttccgggttaacggtcccggtaaaggtaccgttaaaccggtttaaccgggttttacggggtttaacccgtttacgggttaaccggttaaccgttttaaccgggaaacggggttaaccgtaacgtttacccgggg

SEQ ID NO: 1271 - DNA, 575 bp, Homo sapiens
  misc_feature: GYAE6OF02JER7R.18.16.B05.1.454.CMB.1.raw
  modified_base (296)..(296): a, c, t, g, unknown or other
  misc_feature (296)..(296): n is a, c, g, or t
tcagtacgagtatgcacgaccggtgctcgatttagagctcacgtaaggggcgtgggagaggagcccagcactggaagtcgccggtgttccattcggtgatcagcactgaacacagaggactcaccatggagtttgggctgacctgggttttcctcgttgctcttttaagaggtatccagtgtcaggttcaactggtggagtccgggggagcgtggtccagcctgggacgtcgctgagactctcctgtgcagcctctggattcaccttcaatacctatgctttgctactcgggtccncagcctcgaggcaagggccagagtggctgtcagtttattcgatatgataggaactaatcaatcacgcagactccgtaggaacgggtcccaatttccgaccacgttcctacgacgggactaacgttcgaacggtaacacgctagtctactaacaagtcggaactagccgtagacgaactgaacgacgacgtcctcgtactattacgtctagacgtagaacggtacttacgtgggtttaacctggttacgtacgtttacggaagggttacgtaagttccgg

SEQ ID NO: 1272 - DNA, 594 bp, Homo sapiens
  misc_feature: GYAE6OF02JYAKK.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttctttaagaggtatccagtgtcaggttcaactggtggagtccgggggagcgtggtcctgccgtgggacgtcgctggagactccgttcccgtggtcgaccaggtcccttcgtagggtacttccaaccctttcaaattaccctatcgtctttgcctacgttcggggtcccgccgacgacctccgaaggtccgaaggggcccaaggacgtggctgtctagttattcatatgataggaactaatacaatactacgacagactcgtagacggccatcacatcacgaggacagtcagaacacgctacgtctactaacaagcggacagcctagaacacgtcgaacgacgacggactagtacttattacgttgacgacggtaacgacgtacgttaccggttagggttactacggttgacgttaggagggtaatacgttacg

SEQ ID NO: 1273 - DNA, 619 bp, Homo sapiens
  misc_feature: GYAE6OF02FSOFP.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctgtggattccaccttcaatacctatgtctttgctacgtcgggtcccgccagtacctccgaggacgaaggggccaggaggtggctgtctagtttattcatatgataggaactatacaaatactaacgcagtacctcgtaggaacggcctattccaacctatcctaccgaagggaactaacgttccgaacggtaaccacgccgttgtacctactaacaaacgtcgaactacgctaggaacgtaacgtacgacgtaaccgacggtccttaggttacttagttagtttggacggacgtaggtaacggtacttaacggttggtttaacgtggttacgtacgtttaccgggaagggtacgtaagttcccgg

SEQ ID NO: 1274 - DNA, 640 bp, Homo sapiens
  misc_feature: GYAE6OF02JZUZ2.18.16.B05.1.454.CMB.1.raw
  modified_base (171)..(171): a, c, t, g, unknown or other
  misc_feature (171)..(171): n is a, c, g, or t
  modified_base (328)..(328): a, c, t, g, unknown or other
  misc_feature (328)..(328): n is a, c, g, or t
  modified_base (445)..(445): a, c, t, g, unknown or other
  misc_feature (445)..(445): n is a, c, g, or t
tcagtacgagtatgcacgaccggtgctcgatttagagctcacgtaaggggcgtgggagaggagcccagcactggaagtcgccggtgtttccattcggtgatcagcactgaacacagaggactcaccatggagtttgggctgacctgggttttcctcgttgcttctttaagnggtatccagtgtcaggttcaactggtggagtccgggggaggcgtcggtcctggaccctggggactcgctggacgacttctcctggtagcacgtcccttcgtggactttccaaccctttcaaataccctagtcgtcctttgaccacgtggggtccccnctaagacctccgaggccgaagggccaagtgtggcctggtcctagtttattcatagttggaatacggtaaactataccgtaatacccgtacgacaagtccgtcggtacggacggcctntacacctactcctacggagaactactacgtacgaacctacgctgtcctacaactacgtacgacgcgtacgtagactacgtagacgacgacgtcgtcgtacttagttacctgtacgacggtaacgtctaaccgttaaggtttacggttactttgggtaaccgtacgttacccgggaaggggtacttaacgttccgg

SEQ ID NO: 1275 - DNA, 616 bp, Homo sapiens
  misc_feature: GYAE6OF02JC8HU.18.16.B05.1.454.CMB.1.raw
  modified_base (295)..(295): a, c, t, g, unknown or other
  misc_feature (295)..(295): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctctttaagaggtatccagtgtcaggttcaactggtggagtccggggagcgtggtcctgcctgggacgtcgctgagactctcctgtgcagtcctctggattcaccttcaatacctatgctttgctacgtgggtccnccagacctcgacggcgaagggccaggaggtcggactgtcagttattcaatatgatggaaactatcaatacacgcacgacgtaccgtagaaacgggtccctagttccaacctataccctccgaacgggtaactaacgttccgaaacggtaacaccggtactcggtactacctaaactaaacgtcggaaacacgtaccgtaaggaacctaaccgacgaaccgtacgacgggtactacggtactagttacgttgtacgtacgaagtaacgtcgtaacgttagggtttacctaggtgttacgtacggagggtagtacgttaccgg

SEQ ID NO: 1276 - DNA, 689 bp, Homo sapiens
  misc_feature: GYAE6OF02IWZEA.18.16.B05.1.454.CMB.1.raw
  modified_base (153)..(153): a, c, t, g, unknown or other
  misc_feature (153)..(153): n is a, c, g, or t
  modified_base (217)..(217): a, c, t, g, unknown or other
  misc_feature (217)..(217): n is a, c, g, or t
  modified_base (510)..(510): a, c, t, g, unknown or other
  misc_feature (510)..(510): n is a, c, g, or t
  modified_base (653)..(653): a, c, t, g, unknown or other
  misc_feature (653)..(653): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcacatggagtttgggctgacctgggttttccncgttgctcttttaagaggtatccagtgtcaggttcaacgtggtggagtccggggagcgtggtcngccgtgggactcgcgtgacgctcgtccgtgtacgcacgcctgtaggattccaccttcaaactcctagtgtcttggactaccgtggggtccccacgacgtacctaccgaggacccggtaaaggggcccaaggtaggtggcccgttagtaccgttaaggtttacctttacaagtagtagaacgtagtaaaactagtaccaaattacctacgactacgtacctaccggtaggaacgggtctaacgttccgaactactacgtaccgtaagggtaacctaacgttacgaacggaaccncgtaccttgtaactaccaaacgttaaacgcgggaacaccggtacaggtaacgtaacgtaaccgaacggtaaccgtacgtaccgtattaaccgttatttacgtggtacgtcgaaacggtaatccgttaacggtaggtttaccgnggttaacgtgttaacgggaaggtaacgtagtaccgg

SEQ ID NO: 1277 - DNA, 582 bp, Homo sapiens
  misc_feature: GYAE6OF02IVZ18.18.16.B05.1.454.CMB.1.raw
  modified_base (296)..(296): a, c, t, g, unknown or other
  misc_feature (296)..(296): n is a, c, g, or t
  modified_base (345)..(345): a, c, t, g, unknown or other
  misc_feature (345)..(345): n is a, c, g, or t
  modified_base (473)..(473): a, c, t, g, unknown or other
  misc_feature (473)..(473): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggtttcctcgttgctcttttaagaggtatccagtgtcaggttcaactggtggagtccgggggagcgtggtcctgcctgggacgtcgctgagactctcctgtgcagcctctggattcaccttcaactacctatgtctttgcacgtgggtccnccagactccgaggcgaacggggccaggagtggctgtcagttattcatangtataggaactaaatcaatactacgcaagactcgtgaacgggccattccactatcctacgaggactaacgtcgaacggaacaccgctagttacctactaacaaagtcggaacacgacgtagaacgtanacgtaacgacgtacggcttgtacctaagtttacttgtacgtacggaagtacgttaccgtaacgttgggttaacctgggttacgtagttacgtaggggaatacgtaccgg

SEQ ID NO: 1278 - DNA, 640 bp, Homo sapiens
  misc_feature: GYAE6OF02JXS8B.18.16.B05.1.454.CMB.1.raw
  modified_base (302)..(302): a, c, t, g, unknown or other
  misc_feature (302)..(302): n is a, c, g, or t
  modified_base (573)..(573): a, c, t, g, unknown or other
  misc_feature (573)..(573): n is a, c, g, or t
  modified_base (611)..(611): a, c, t, g, unknown or other
  misc_feature (611)..(611): n is a, c, g, or t
tcagtacgagtatgcacgaccggtgctcgatttagagctcacgtaaggggcgtgggagaggagcccagcactggaagtcgccggtgtttccattcggtgatcagcactgaacacagaggactcaccatggagtttgggctgacctgggtttcctcgttgctcttttaagaggtatccagtgtcaggttcaactggtggaggtccgggggaggcggtggtccgtgccgtgggacgtcgctggagactctcctgtgcagcctctggattcacttcaactacctatgtcttgacacgtcggtccnccagacctcgacggcgaacgggccgaggagtgggctggtctaagtttacttacgactatcgaagtaggtaaactaactacgaatactaacgacacgtacctaccgtacggaacggaccgtagttacccaactactaccgttacgaacggaacctaacttcccgaaaggaaccacgtccgttagtccttaactaacaaacggtgaacctagtcgtacgtacgaaccgtacggaccgtaacgtacggacctacgtacgttaactattgggtanacggaagtacgttaactacggttaggttactacggttnaaacggttcgtaagggtacgtaacgtcgg

SEQ ID NO: 1279 - DNA, 579 bp, Homo sapiens
  misc_feature: GYAE6OF02GL8LI.18.16.B05.1.454.CMB.1.raw
  modified_base (257)..(257): a, c, t, g, unknown or other
  misc_feature (257)..(257): n is a, c, g, or t
  modified_base (307)..(307): a, c, t, g, unknown or other
  misc_feature (307)..(307): n is a, c, g, or t
  modified_base (364)..(364): a, c, t, g, unknown or other
  misc_feature (364)..(364): n is a, c, g, or t
  modified_base (449)..(449): a, c, t, g, unknown or other
  misc_feature (449)..(449): n is a, c, g, or t
  modified_base (506)..(506): a, c, t, g, unknown or other
  misc_feature (506)..(506): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactgggtggaggtccgggggagcgtggtcctgcctgggacgtcgctgagactctcctgtgcagcctntggtacttccaccttcaattacctatcgtctttgcctacgtcgggtcccnccacgacctccgaggcgaacggggccaaggacgtggctggtctagtttattcattangagtaggaactatcaatactacgcaacgtaccgtccgtaggacggtcctatccactatccacgacggactaacgtccgaagaacncgctgtactactacaacgtgacacgtccgtagacgtacgtgaaccgacgacgtcgtntactagttcttggagacggtagagtaccgtagttaggttactggtacgttagttacggacgggtagtagtacg

SEQ ID NO: 1280 - DNA, 510 bp, Homo sapiens
  misc_feature: GYAE6OF02GXB6M.18.16.B05.1.454.CMB.1.raw
  modified_base (294)..(294): a, c, t, g, unknown or other
  misc_feature (294)..(294): n is a, c, g, or t
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (464)..(464): a, c, t, g, unknown or other
  misc_feature (464)..(464): n is a, c, g, or t
  modified_base (468)..(468): a, c, t, g, unknown or other
  misc_feature (468)..(468): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaatacctatgctttgcactgggtccnccagactccaggcaaggggccagagtggctgtcagttattcatatgatggaactaatcaatactacgcagactccgtaggaggccgattccacntcnccaggacaatccaagacacgctgtctactaacaatcgacacgctagagaacgtgacgacacggctgtctattnttgngcgagacgactacgtggttactgtgtacttgaggtagatcgg

SEQ ID NO: 1281 - DNA, 832 bp, Homo sapiens
  misc_feature: GYAE6OF02G56LL.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtactccagtgtcaggttcaacgtggtggacggtccgggggaggcgtggtcctggccgtgggaccgtcgctggacgtacctctccgtgtcgcgacgcccttcgtggtacttcctaccttacaaacttaccctatcgttcctttgcctacgttcggggtcccgccacgtaccctccggaggaccggaacggggccaggtagtggcttgtactagtttattacattatgtataggaaacttaagtactaaattactaacggctaacgtaccgtccggtaaggaacggggtaccgtaacttacccgaaccctaacgttacccgtaaccggaacgggtaacctaaaccgtttaccgaaacgggtaaacccgtaccgtacccgttacggttaccttaccttaaacgtaaacgttaacgggaaccgtacggtacccgttaagggaaaccgttaaacggtaccggtaaaccggtaaccgtaacccgggttacccgtttacggttaacctttaacggttttaacgtttacggggttacggaacccgggtaacgggttaaaccggttaaacccgtttaacggggtttaccggggttttaaacggtttacggtttaacggttaccggtttaacccgggtaaagggggtaacgttaaccgggtttacccggg

SEQ ID NO: 1282 - DNA, 958 bp, Homo sapiens
  misc_feature: GYAE6OF02ICHS0.18.16.B05.1.454.CMB.1.raw
tcagtacgagtatgcacgaccggtgctcgatttagagctcacgtaaggggctgggagaggagcccagcactggaagtcgccggtgtttccattcggtgatcggcactgaatacaggagactcaccatggagtttgggctgagctgggttttccttgttgctattttaaaggtgtccagtgtgaggtgcagctggtggaggtccgggggaggcgttggtccagccgtgggggtccctgaactctcctgtgcagcctcgtggtcaccttcagtggctctgctatgcacgtcgggtccgccgacggtcttaccccgggggaaagggccgttagggggtaagggttcgggggtttcgggaccccggtttaagtttaacggaaacggtaccgaaaaaggtaccttaaaacgacggttttaacccggaccggaaccgaacggacctaaagttacgttacggtaccggttacgggaccgggtttacggggtaaggtaaaacggggtcccggttaacggggtttaccccgtaacccggttacccgttacccggtaaaacggttaaaacgttacggttaaactttaaccggaaaaaacggtaaaccggtaaccggggtaaccgttaaacgttccgttaacggtaaacttaaaacgtaacggaaaccgtacggtaaacccggtaaacggaaaaaccccgggtaacgggtaaacccgggtacccgggtaaccgggtttaacggttaaccgtttaaccgtttaacggttaaacccggttaaacgggtaaaccgggtaggggtttaacggtaaaccggtttttaacggttaacggggtttttaacggggggttaaacgttttacgggtaacccggggttaaaccggggggttaaacccggggggggttaaccttaaacccgggtttaaccggtaaccgggtttaacgggttaccggggttaaccccggggg

SEQ ID NO: 1283 - DNA, 614 bp, Homo sapiens
  misc_feature: GYAE6OF02FKMRL.18.16.B05.1.454.CMB.1.raw
  modified_base (171)..(171): a, c, t, g, unknown or other
  misc_feature (171)..(171): n is a, c, g, or t
  modified_base (556)..(556): a, c, t, g, unknown or other
  misc_feature (556)..(556): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagnggtatccagtgtcaggttcaactggtggaggtccgggggaggcgtggtcctgccgtgggacgtcgctgagacctctcctgtgcagtcctcgtggtacttccaccttcaatacctatgtctttgcacgtggtccgccagtacctccgaggcgaacggggccaggaggtggctgtctagttacttcattatcgataggtaactatactaatacgtacgacagtaccgtcgtaggacggtccgtattaccacgtcttaccgtccgaagggtacctaaacgttaccgaaacggtaaccgaacgtccgttcgttaccttactaaactaagtacgactaacgctacgaacgtaacgtagaccacgacggtctagttacttatacgttaggngtacgaggtacgtacgttacgttaggttactcgtagtagttacggagtagtagtccgg

SEQ ID NO: 1284 - DNA, 522 bp, Homo sapiens
  misc_feature: GYAE6OF02JYZ27.18.16.B05.1.454.CMB.1.raw
  modified_base (297)..(297): a, c, t, g, unknown or other
  misc_feature (297)..(297): n is a, c, g, or t
  modified_base (409)..(409): a, c, t, g, unknown or other
  misc_feature (409)..(409): n is a, c, g, or t
  modified_base (437)..(437): a, c, t, g, unknown or other
  misc_feature (437)..(437): n is a, c, g, or t
  modified_base (442)..(442): a, c, t, g, unknown or other
  misc_feature (442)..(442): n is a, c, g, or t
  modified_base (462)..(462): a, c, t, g, unknown or other
  misc_feature (462)..(462): n is a, c, g, or t
  modified_base (466)..(466): a, c, t, g, unknown or other
  misc_feature (466)..(466): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttagcactcgggtccnccagacctccaggccaaggggccagagtcggctgtctagttattcatatgatgaactatacaatactacgcagactcgtagaggcatcacatctcgaggacattccagaacncgctgtctactacaactgacagctgaanacganacgacacgctagtactattnttgngtcgagacgtacgtacgttggttaacttggtacgtagttacgagggtactagttcg

SEQ ID NO: 1285 - DNA, 854 bp, Homo sapiens
  misc_feature: GYAE6OF02IEM91.18.16.B05.1.454.CMB.1.raw
  modified_base (154)..(154): a, c, t, g, unknown or other
  misc_feature (154)..(154): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttccncgttgctctttaagaggtatccagtgtcaggttcaacgtggtggaggtccgggggagcgtggtctgccgtgggacgtcgcgtgacgtactctccgtgtgcacgcctcgtggtacttccaccttcaactacctatcgtctttggctacgtcgggtccacctaggtacctccggaagggaccggtaaacgggggcccaaggtacgtcggcgttagtaccgttagtttacttcgaagttacgtggtaacgttacggtaaactaaacgtacaaacgtttaccgtaacgacctaacgtaaccgttccgggtaagggaaccggggtacccgttaacgtttacccgaaccgttacgtacccgtaacccgtaacggggtaaacctaaccgtttaacccgaaacggggtaaaccctaccgggtaccgtttaccggttaacccgttaaccgttaaacccggtaaaacgttcgggaaaccgtaccggttaacccggttacgtaaaccgggttaaacctaacgggtaaacccgtaacgggttaacccggttccgtttaaacggttaccgttttaacgtttaacggttacgggttacggtaaccgggtaaacgtaacggttaaccggtttaacccgggtttaaggggtttacccgttacgggttacgttaacgggttaaccgggaacgggttaacgttacggtttaacccggg

SEQ ID NO: 1286 - DNA, 705 bp, Homo sapiens
  misc_feature: GYAE6OF02JW7GQ.18.16.B05.1.454.CMB.1.raw
  modified_base (265)..(265): a, c, t, g, unknown or other
  misc_feature (265)..(265): n is a, c, g, or t
  modified_base (297)..(297): a, c, t, g, unknown or other
  misc_feature (297)..(297): n is a, c, g, or t
tcagtacgagtatgcacgaccggtgctcgatttagagctcacgtaaggggcgtgggagaggagcccagcactggaagtcgccggtgtttccattcggtgatcagcactgaacacagaggactcaccatggagtttgggctgacctggttttcctcgttgcttcttttaagaggtatccagtgtctaggttacaacgtggtggacggtccgggggaggtcgtggtcctgccgtgggacgtcgctgacgctctctgtgacagcctcnggtacttctaccttcaactactatcgtctttnacctacgtcgggtcccgcctacgtaccctaccgacggacgaacggggcccaggacggtcgggacttcggtactaggtttaccttacgagtaacgttgaacgttagggtaaactaagttacctaacgttaacctaaccggtgtaaacggtccctttaccgggtaaggaaccgggacccgttaatttacccgaacctaaaccgttcctaaccgtaacggggtaaccctaaacgttcccaaacgggtaacccgaaccggtacttacgttaccgttaacgttaaccaaacgtcggtaacgacgtaacccgtggaaccgacgtacgacgacgtaccgtgtacttactacttagtcgtagtacgaagtctaacgtcgttacggtagttcggtatacgttacgaggacgtatcgg

SEQ ID NO: 1287 - DNA, 683 bp, Homo sapiens
  misc_feature: GYAE6OF02FZLZR.18.16.B05.1.454.CMB.1.raw
  modified_base (639)..(639): a, c, t, g, unknown or other
  misc_feature (639)..(639): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattccaccttcaatacctatgtctttgcacgtcggtccgccagtacctccgaggaccgaacggggccaggagtggctgtctagtttattcatagtgtatacggtaaactaactactaatactacgcaacgtaccgttaccggtagggaacgggccgtaactttaccaacctacgtccgtaccgaacgggtaactaaacgttaccgaaagggaaacctccggacttacgtacctacttaacgaaagttacggaacctacggtacctaaggaacgtaaccgtacggaaccgaaccgtaaccgggccgtttacgtacgtttagtttaacgtttggacggtacggaaggtaaccggttaacttaaccggtttcggggttttaacncgggtttaggtaacgtttacgggaaggggtaatacggttaccgg

SEQ ID NO: 1288 - DNA, 686 bp, Homo sapiens
  misc_feature: GYAE6OF02IPV3S.18.16.B05.1.454.CMB.1.raw
tcagtacgagtatgcacgaccggtgctcgatttagagctcacgtaaggggctgggagaggagcccagcactgaaagtcgccggtgtttccattcggtgatcagcactgaacacagaggactcaccatggagtttgggctgaccttgggttttcctcgttgcttcttttaagaggtatccagtgtcaggttcaactggtggaggtccgggggaggcgtggtcctgccgtgggacgtcgctaagacctctcctgtgcacgccctgtggtacttcctaccctttacaattacccgtatgtcctttgccaccgttgggtcccgaccacgtacctcccgagggaccggaaacgggggcccaaggagtcggtctggtacgtagtttatttacatagtgtaagtaggtaactaatactaattaccacgacgaacgtccgtacgtacggaacgggtcccgtattcccaacgtactacctaccggaaggaacctaacgtaaccgaaggaaccacgtccttacgtacttaacctaaccgtaagtccgaactacgaccgttagaacgtaacctaggaaccgaaccggtaccgtcgttaggtacctttaagtttacgttaggtcgaaggtacgtaacggtaccttaggttcggtttacgtgtacggttacgttaggaggtaagttacgtacgtaccgg

SEQ ID NO: 1289 - DNA, 649 bp, Homo sapiens
  misc_feature: GYAE6OF02JDE42.18.16.B05.1.454.CMB.1.raw
  modified_base (255)..(255): a, c, t, g, unknown or other
  misc_feature (255)..(255): n is a, c, g, or t
  modified_base (298)..(298): a, c, t, g, unknown or other
  misc_feature (298)..(298): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatgggagtttgggctgacctgggttttcctcgttgctcttttaagaggtatccagtgtcaggttcaactggtggagtccgggggagcgtggtcctgcctgggactcgctgagactctcctgtgcagcctntggattcaccttcaatacctatgtctttgctacgtcgggtccnccagacctccgaggcgaaggggccaggacgtggctgtctagttattcatatgatgaactatcaatacacgcaagtaccgtccgtaggaacggtcctaattccacctactccgtaccgaacgggaactaacgttaccgaagggtaaaccaccggtacttacgtaccttacctaaaccgtaaagtcggaacacgtaccgtaaggaacgtaacgtacgaaccgacgaccggtacgtacgttacttaacgtttacgttcggtacggacggtaacggtaacgttaccggttaaccggttcgggtttaaccgttggttacggttaacgttacgggaacgggtaactacggttaccgg

SEQ ID NO: 1290 - DNA, 688 bp, Homo sapiens
  misc_feature: GYAE6OF02IHO1N.18.16.B05.1.454.CMB.1.raw
  modified_base (298)..(298): a, c, t, g, unknown or other
  misc_feature (298)..(298): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgtctttgctactcgggtccnccagacctccgaggcgaaggggccaggagtggctgtcagtttattcatatgagtaggaaactaactcaaatactacgacaacgacctccggtaggaacgggtccgtaattccgaccaactccgtaccgaacgggtaacctaaacgttacccgaacgggaaaccctaaccggccttacggttaccttaccttaaaccgtaaacgtacgggtaaccaacggtaccgtaggaaaccggtaactacggaaccggaaccgtaccgggtacttacggttaaccttaagtttacgtttacggtacgtaccgggtaaggtaacgtaaccgttaaccggttagggtttaaccttagggttacgtaagtttacccgggaagggttaacgtaagttcccgg

SEQ ID NO: 1291 - DNA, 583 bp, Homo sapiens
  misc_feature: GYAE6OF02G5XDW.18.16.B05.1.454.CMB.1.raw
  modified_base (171)..(171): a, c, t, g, unknown or other
  misc_feature (171)..(171): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatgggagtttgggctgacctgggttttcctcgttgctcttttaagnggtatccagtgtcaggttcaactggtggagtccgggggagcgtggtcctggccgtgggacgtcgctgagactctccgtgtgcagcctctggacttccaccttacaactacctatcgtctttgcctacgtcgggtccaccagcctccgaggcgaagggccagagtgctgtctagttattcatatgataggaataagtactaatactacgactagaccgtacgaggaacggtcgtaacttaccacctactccaccgtaacggactaaacgtaccgaggaacgacgtactacgttcctactaaacaagtacgacacgtacgtagaagtaacgcgaccgaacgccgagttcgtattattagtgtgacgagactacgtcgttagggttactaggtatacgtaggacggtatagtcgg

SEQ ID NO: 1292 - DNA, 693 bp, Homo sapiens
  misc_feature: GYAE6OF02JBQ4R.18.16.B05.1.454.CMB.1.raw
  modified_base (171)..(171): a, c, t, g, unknown or other
  misc_feature (171)..(171): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagnggtatccagtgtcaggttcaactggtggaggtccgggggagcgtggtcctgccgtgggacgtcgctgacgactctcctgtgcagcctctggacttcacctttcaatacctatcgtctttcgctacgttcgggtcccaccagtacctccgaggaccgaaggggcccaaggacggtcggccttgtactaagtttactttcaattacgttgaagttacggaaacttaatactaaagttaaccgtacgacctaacgtaccttaccgggtaaggaaaccggggtccctaagtttacccaaccgtacgtaccgtaccgaacgggtaactaacgttaccgaacggtaaccaccggtactcgttacctacgtaacgtaactacggacacggaccgtaggaacgtaaccgtacggaaccgacgtacggtcctacgttaacttagtttacgttggtacgtaccggtaaggtaccgtaacgttaacggttcggtttaacgtgttacgtacgttacggaagggtactagtaccg

SEQ ID NO: 1293 - DNA, 740 bp, Homo sapiens
  misc_feature: GYAE6OF02HD1JY.18.16.B05.1.454.CMB.1.raw
  modified_base (211)..(211): a, c, t, g, unknown or other
  misc_feature (211)..(211): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggttatccagtgtcaggttcaacgtggtggacggtcggggngcgtcggtcctgccgtgggacgtcgcgtgacgtcctcctccgtgtcgccacgtcccgttcgtaggtacttacctaaccgttactaaacttacccttagtcgttcgtttacgccgttacgggttccgggtaccccaccgtaaggtacccgttaccggaacgggaaccgggaaccgggggacccgaagggtcgggtcggtcgttacgtacttaggttttaacttcgaatttagtagtagtaacgtaaacttaatactaaactacgacgacgtaacgtaccgtacggaaggaacgggtccttaacgtccaaccgtactcccgtaacgaacggtaacctaacgtaaccgaacggaaacctacggtcttacgtacctaaactaacgtaaacgtcgaaccgtacgacgtaacgtaacgtaacgtacgaaccgtacgacggtccgttagttacgttattacgttcgtagtacggtaagtacgtaccgttaaggttacggttacgtcgtacggtagttacggtacgtacgtatacgg

SEQ ID NO: 1294 - DNA, 723 bp, Homo sapiens
  misc_feature: GYAE6OF02GNSPV.18.16.B05.1.454.CMB.1.raw
  modified_base (306)..(306): a, c, t, g, unknown or other
  misc_feature (306)..(306): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaactggtggagtccgggggagcgtggtcctgcctgggactcgctgagctctcctgtgcagcctcgtggacttcaccttcaataccctatcgtctttgactacgttcgggtccccncgtaagacctaccgaggaccgaacggggccaggacggtcggcttcgtctaagtttattacattagtagtataggaaacttaagtacctaaattaccgtacgactaacgtaccttaccggaagggtaaaccggggcccttaacgtttaccaacccgtacgttacccgtacccggtaaacgggtaacctaaacgttaccgaaacgggtaacccaacggtccttacggttaccttacgtaaaccgtaaagtcggtaaccgacgtaccgtaggtaaaccgtaacgtacggaacgaaccgtaccgtacttcgtaacgtttagttacgtttacgtacggaacggtaacggtacgttaaccggttacgttacgggtttaccgttagtacggttacgttacggtaaacgggttacgtactaccgg

SEQ ID NO: 1295 - DNA, 613 bp, Homo sapiens
  misc_feature: GYAE6OF02JDYBN.18.16.B05.1.454.CMB.1.raw
  modified_base (283)..(283): a, c, t, g, unknown or other
  misc_feature (283)..(283): n is a, c, g, or t
  modified_base (503)..(503): a, c, t, g, unknown or other
  misc_feature (503)..(503): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttctttaagagtatccagtgtcaggttcaactggtggagtccgggggagcgtggtcctgccgtgggacgtcgctgagtctcgtcctgtcgcagcctcgtggtacttccaccttcaatacctntagctttgcacgtcgggtcccgcaacgtacctcccgaggccgaaggggcccaggaggtggctgtactagttgttcattatgacgtaggaaactaatcgaaactacgtacgcagtaccgttccgtacggaacggtccgattcccaccgtactaccgtccgaagggactaacgttaccgaacgggtaaccacgtcctaggtccttacaacgaaatcgggacngtacctagtagaacgtgaccgacgacgtctacgtcttacttagttgtcgacggaagtactacgtaaggtcggtttaacgtggtacgttagtacggagggtactagtacgg

SEQ ID NO: 1296 - DNA, 528 bp, Homo sapiens
  misc_feature: GYAE6OF02GBZ1Y.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattcaccttcaatacctatgctttgcactgggtccgcagactccaggcaaggggccagagtggctgtcagttattcatatgatggtaactaatcaatactacgcagactcgtggaacggccgatcaccatctccgagggactaatccaggaacacgctcgtctctacaatcgacacgcctagacactcgaacgacgaccgctgtcttagttattgtagcgtaagacgtacgtacgttaggttactgtgtagttcgagggtagtaatcgg

SEQ ID NO: 1297 - DNA, 649 bp, Homo sapiens
  misc_feature: GYAE6OF02F4USH.18.16.B05.1.454.CMB.1.raw
  modified_base (211)..(211): a, c, t, g, unknown or other
  misc_feature (211)..(211): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaactggtggaggtcgggggngcgtggtcctgcctgggactcgctgacgctctccgtgtgcagcctcgtgacttcaccttacaactacctatgtctttcgctacgttcgggtcccgaccacgtacctccgaggaccgaacggggccaggaggtcggctgtactagtttacttcaagtatagtataggaaactaatactaaactactacgccaacgtaccgttaccggtaggaacgggtcctaacgttccaacctactaccgtaccgaacgggaacctaacgttaccgaacggaacctaccgtactcgttactactaacaaacgttacggacacggcctagaacgacgtacgaaccgaccgtaccggctgttacttattagttgtacgacggtaagtacgtacgttaacggttggttaacgttggttagtaaccggttggaaacggtacgtaagtccggg

SEQ ID NO: 1298 - DNA, 819 bp, Homo sapiens
  misc_feature: GYAE6OF02H1VAL.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggtttttcctcgttgcttctttttaagaggtatccagtgtcaggttcaactggtggaggtccgggggagcgtggtcctgcctgggacgtcgctgagtactctcctgtcgcacgccttcgtggactttcctaaccctttcaaaactttaccctattcggtaccttttcgctaccgttcggggtccccgaccctaaggacccttcccgaacgggacggaacgggggcccgaaggacggtgggtcttacggttcagtttttactttcgaattatggaagttcggtaaaactttaaatacctaaaactttaacctaaccgtaccgaagttaaccccgtaccgggttaaggaaaaccgggggtaccctaacgtttacccaacccgtacgtacccttaaccggtaaacggggtaaacctaacggtttacccgaaacgggtaacccaaccggttaccgtttacgttacccttacgttaaacccgtaaagtcggaacacgtacccgtaggaaacgtacggttagaaccggtaccgtacggtacttaacgttacttaacgttttagttcggtaacggtaccgggtaacggtaacggttaaaccggttaccgggttttacgggttttaaccgttagggtttacggttaaccgtttacgggaacgggtaacggtaattcccggg

SEQ ID NO: 1299 - DNA, 600 bp, Homo sapiens
  misc_feature: GYAE6OF02FKA0X.18.16.B05.1.454.CMB.1.raw
  modified_base (473)..(473): a, c, t, g, unknown or other
  misc_feature (473)..(473): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaacgtggtggaggtccgggggagcgtggtcctgcctgggacgtcgctgagactctcctgtgcagcctctggattccaccttcaatacctatcgtctttgctacgtgggtcccgcacgtacctccgaggcgaacggggccaggacgtggctgtctagtttattcatatgagtagaactaatacaatacacgctaacgtactccggtaggaacggtcctaataccaccatacctacgaaggactactaccgagaaccacgctcgtctactacgtaacgtcgacngacgtagaacgtacgtacgaacgacgacgtctacgtacttagttacgttgtacgtacggtaagtacggtaccgttacggttacggttacgtcgttacgtaacgttacggaagggtacgtagttacgg

SEQ ID NO: 1300 - DNA, 769 bp, Homo sapiens
  misc_feature: GYAE6OF02H18TU.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggtagtttgggctgaccttgggttttcctcgttgcttcttttaaggaggtatccagtgtctaggttacaacgtggtggaggtccgggggagcggtggtcctggccgtgggtacgttgctgacgtactctccgtgtcgcagtcctcgtggtacttccgtacctttacaaacttaccgtattcgttcctttacgcccgttaacggttcggggtccccaccgtaacgtacccgtaccgagggtaccggaaacgggggtccagggtacggtcggtaccttggtacctaaggtttattaccgattagtgtaacgtacggtaaacttaactaactaataacctaacggctaacggtaaccgttccggtaaggaaacgggtccctaacgtttccgaacctacgttaccgtaaccggaacggtaacctaaaccgttaccgaaacggtaaaccctccggtcttacggtacctaactaaacgaagtcgaacaccgtacgtaaggtaacgaaccgtacgtaaccgacgaccgtacgttacgtacgttaagttcgtaggtacgtacggtaacggtacctaacggttaacgggtttcgggtttaactcgggtttaagttaccggttaggggaacggttaacggtacgttacccgg

SEQ ID NO: 1301 - DNA, 716 bp, Homo sapiens
  misc_feature: GYAE6OF02JLBOR.18.16.B05.1.454.CMB.1.raw
  modified_base (404)..(404): a, c, t, g, unknown or other
  misc_feature (404)..(404): n is a, c, g, or t
tcagtacgagtatgcacgaccggtgctcgatttagagctcacgtaaggggcgtgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtctgccgtgggcgtcgctgagtactcgtcctgtgcacgtcctcgtaggtacttccgtaccttcaactacctagtcgtctttgcctacggttcgggtcccaccgtagccctaccgacggtacggaacggggtccaggaggtcggctagtacgtagtttactttcagtagtgtagtacgaaacctttaancctaaagttaccgacgacgtaacgtaccgttaccggtaagggaacggggtaccctaacgtttccaacccgtacttaccgtaccggaacggtaacctaacgttaccgaacggtaaccgtacccgtcgttcttacctacttaaaccgaaacgtacgaccgtacgccgttaaggaacgtacgtacgaaccggtaccgaccggtcttaccggttacttaagttacgttcgtacggtacggtacggtaacgtacggttacgttacgggtttaactggttacgtacgtttaacggacggggtaaccgtagttacccgg

SEQ ID NO: 1302 - DNA, 560 bp, Homo sapiens
  misc_feature: GYAE6OF02F2CG3.18.16.B05.1.454.CMB.1.raw
  modified_base (402)..(402): a, c, t, g, unknown or other
  misc_feature (402)..(402): n is a, c, g, or t
  modified_base (454)..(454): a, c, t, g, unknown or other
  misc_feature (454)..(454): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggaattggggctgagctgggttttcctcgttgctattttagaagtgtccagtgtgacgtgcagctggtggagtctgggggaggcttggtccagcctggggggtccctgagactctcctgtgcaggccctgcattcatctttaatagttattggatgctactggtccgccaggcgtccgggggaagggccggagtggggtgccaacataatgacaagatggaactgagaagaactatgtggactctgtgaagggccattcaccatcctccagacanaaccactaagaactttacagttaactctagaccaaaatcgtaaccagccctnaacggacgacccgaaggaccaccgggtctagtgtaacttactggtgacggaaagacgacaggttcggcgttaggggactaagtcgggacgttcggtggggaacccg

SEQ ID NO: 1303 - DNA, 837 bp, Homo sapiens
  misc_feature: GYAE6OF02FF93A.18.16.B05.1.454.CMB.1.raw
  modified_base (258)..(258): a, c, t, g, unknown or other
  misc_feature (258)..(258): n is a, c, g, or t
  modified_base (284)..(284): a, c, t, g, unknown or other
  misc_feature (284)..(284): n is a, c, g, or t
  modified_base (314)..(314): a, c, t, g, unknown or other
  misc_feature (314)..(314): n is a, c, g, or t
tcagtacgagtatgcacgaccggtgctcgatttagagctcacgtaagggtctgggagaggagcccagcactggaagtcgccggtgtttccattcggtgatcagcactgaacacagaggactcaccatggagtttgggctgacctgggttttcctcgttgctctttaagaggtatccagtgtcaggttcaacgtggtggagtccgggggagcgtggtcctgcctgggactcgctgagacctctcctgtcgcagtccctntggattccaccttcaattacccttancgtacctttgcctaacgttcggggtacccnccaggtacctccgaaggacgtaaacggggcccaaggacggttcgggccttagggttactaacggtttacttttaccgaagttacgttacggaacgttaacggggtaaaccttaaacgttaccggtaaaattaccccgttaaccgggacctaaacgggtaacccgttacccccgggttagggaaaacccgggggttaccctaacgtttacccgaacccgttatacccgttacccggaaacggggtaaccctaaacgtttcccgaaacgggttaaacccaccggtacgttaccggttacctaaccttaaacgaaacgttacggaacctacggtaccgttacgaacggtaaacccgttaggaacccggaacgtaccgggtaccttacggttacctttaacgttacgtttacggtacggaccgggtaaacggtaacggtaacccgtttaacgggttacggggttttaaccgtacgggttaacgttaaccgtttacgggaacgggggtaactaacggtttaccccggg

SEQ ID NO: 1304 - DNA, 695 bp, Homo sapiens
  misc_feature: GYAE6OF02I9R23.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggaggtcgggggagcgtggtcctgcctgggacgtcgctgagctctcctgtgcagcctctggtacttccaccttcaatacctatcgtctttgctacgtcgggtcccacagacctccgaggcgaacggggccaggagtcggctgtactagtttacttcattatgagttaggaactaatacaaacttacaacggacctaagtaaccgttaccggtagggaaaccgggtcctatttacccacctacttcccgtaccgaacgggtaacctaacgttaccgaacggtaaaccgaccgtcttacggttaccttacctaaacgtaaaccgtacggaacgtacgtaccgtacgaacggaaacctcgaaaccgaccgtaaccggtcgttcgttaactttaagtttagttcggtacggtaccggtaaggtaaccgttaaccggttaccggtttagggtttaaccgtaggttacggttacgtttaaccgggaagggtacgtaacgtaccgg

SEQ ID NO: 1305 - DNA, 667 bp, Homo sapiens
  misc_feature: GYAE6OF02JOLXZ.18.16.B05.1.454.CMB.1.raw
  modified_base (381)..(381): a, c, t, g, unknown or other
  misc_feature (381)..(381): n is a, c, g, or t
tcagtacgagtatgcacgaccggtgctcgatttagagctcacgtaagggcgtgggagaggagcccagcactggaagtcgccggtgtttccattcggtgatcagcactgaacacagaggactcaccagtggagtttgggctgaccttgggttttcctcgttgcttcttttaagaggtatccagtgtcaggttcaactggtggaggtccgggggagcgtggtcctgccgtgggacgtcgctgacgactctcctgtgcagccctgtggacttcaccttcaatacctatcgtctttagctacgtgggtcccgcagacctccaggcgaacgggccaggagtcggctgtactagtttattaccgatacgtgacttaggaaactttanacctaaattacgtaccgacgtaaccgtaccgtaccgggttacggaaacggggtcccttaagttccaccgtactccgtaccgtacgggaactacgtacgacgtaacacgtcgtctactactaacgacgtacgtaccgacgtaccagaactacgtaccgaacgtccgaccggtacgttacgttactagtttaacgttgtacgtacggtaacggtaactaacggtttaacggtaccggtttacgttaggttacgttaaccgttaacggtaggtaacgttaccgtaccgg

SEQ ID NO: 1306 - DNA, 726 bp, Homo sapiens
  misc_feature: GYAE6OF02H2FNF.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccgttgggtttttcctcggttgtcttacgttttaaaggaggtatccgagtgtcgtaggttacaacgtgggtaggacgggtccgggggaggtcggttcggtccgtcggtccggtaggggtaccgtcggtaccgtaggaacggtaccttcgttaccgtcggtacgccgaccgtcttcggtaggtacttcccgtaccttaacaacgttactacgttgtctttcgaccgtacgtcgggtaccgtacgtaacgacctacggacggtacggtaacgggaccgtaggacgtacggtcgtaggtaccgtaagtttacttacagttagtcgtaagtacgtaaactaatacgtaactacacgtacgacgtactaccggtaggacggtactacgtaccacgttaccgctaacgacgtaactacgtaccggaaagacgtacgtctagttacccgtaataaccgaaagttcgaacgactacgtacggtaacaacggtaccgacggacgtaacgttcgtctaatttcgtagtgtacgtaggaattcgtagttacgttacgtacgttgtacgttaggtacgtaacggtacgagttaccgg

SEQ ID NO: 1307 - DNA, 752 bp, Homo sapiens
  misc_feature: GYAE6OF02JIG1V.18.16.B05.1.454.CMB.1.raw
  modified_base (387)..(387): a, c, t, g, unknown or other
  misc_feature (387)..(387): n is a, c, g, or t
  modified_base (408)..(408): a, c, t, g, unknown or other
  misc_feature (408)..(408): n is a, c, g, or t
tcagtacgagtatgcacgaccggtgctcgatttagagctcacgtaaggggcgtgggagaggagcccagcactggaagtcgccggtgtttccattcggtgatcagcactgaacacagaggactcaccatggagtttgggctgacctgggtttcctcgttgctcttttaagaggtatccagtgtcagtcaactggtggaggtccggggagcgtggtcgtgctgggactcgctgagtactctcctgtagccacgcccgtcttgggactttccgacccgtttcgtaacgtaaaccttacctaaccgtagtcggcctgggtaactccccggacgacgggccttacccgggaaggggtaacggggtcctgggtaaccgtaccgtctacgtaanaaccgtataccggtataaacncgttagaaaacttaccatttaacaccgtaccggctaacgtcttccgaggttccggggaggaccccggttatttaccaaccgtaccgtccggaccgtacgggaaaccctaaccggaccgtaaacgaccggaactacccgtaactaacgtttaacgtaccgttacaccgtaagtactcggtaacttacccggacccgttaggaacgttaccggacccggtaaggttcccggtacgtttaccggtttacctaacgtcgggttacggcgtaacggaccggtaccggtacccgtagtacccgttacgtaccgggtccgacccggtaccggttaccggtaccggttaacg

SEQ ID NO: 1308 - DNA, 767 bp, Homo sapiens
  misc_feature: GYAE6OF02IX7XE.18.16.B05.1.454.CMB.1.raw
  modified_base (696)..(696): a, c, t, g, unknown or other
  misc_feature (696)..(696): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgtctacttttaaggagtatcagtgtcgtaggttacaacgtggtacggtacgggtcgggggagtcggtcggtccgtcgccggtgggacgtcgcgtgtacgtacttccgtccgtgtacgcctacgtccttgtaggtacttccctactttacaacgttaccttagtcgttctttacggacctaccggttccgggtccaccgtacgtaacccgcccggtaacggacgggaaaccgggcctaaggggtcggtcggtcgttcggtaacttacgttttacgttactagttacgttaggaacttaacggtaaacttaacttacgaaactttacgacgacgtaacgtaccttaccggaggtaacggccttactacctaaccgtactccgtaacgggaaccgtaattaccggtacccgaacgtaacgtcgtctaccgttacctaaactaaacgtaacgtccggtaacaccggttacgaaacgtacgtaaccgtaacgaccgtaacccgacgggtttcagttaaccttagtcgttagtcgaaaccggngttaaaccgtccggttaacggtaggtttacgtaggttccgttaagtaccgggtaacgggatttacgtacgg

SEQ ID NO: 1309 - DNA, 737 bp, Homo sapiens
  misc_feature: GYAE6OF02IGKA9.18.16.B05.1.454.CMB.1.raw
  modified_base (253)..(253): a, c, t, g, unknown or other
  misc_feature (253)..(253): n is a, c, g, or t
  modified_base (279)..(279): a, c, t, g, unknown or other
  misc_feature (279)..(279): n is a, c, g, or t
tcagtacgagtatgcacgaccggtgctcgatttagagctcacgtaaggggctgggagaggagcccagcactggaagtcgccggtgtttccattcggtgatcagcactgaacacagagactcaccatggagtttgggctgaccttgggttttcctcgttgcttctttaagaggtatccagtgtcaggttcaacgttggtggagtccgggggagtcgtcggtcctggccgtagggcgtcgctgagtctctcgtgngcagtcctgtagtcttcctaccttanaacgtactatcgtctttgcgtacgtcgggtcccgacacgtacctccgaggacgaaacgggccgtaagacgtggcgttcgtacgtaagtttactttacgagtagttacgagttaacggtaaacttaacgtacgtaaaactttaacgacggtaacgtacgtaaccgtttaccgggaacggaaaccggggtcttaaacggtacctaaccaaccgttaccggtacccggaaacgggtaaacctaaccgtaccgtaaacgggtaacctaaccggttcgttacgttaccgttaaccgaaacgttaaagtcgaacctaccggttacctaacggtaacgaccgtaccggaaccgaacgtccgggttactacgttacgttagtttaagtcgtaagtacggtaggacctaaccggttagttacggttaacgttcgtaggtcgtacgggtaggtaaccggtataccggg

SEQ ID NO: 1310 - DNA, 666 bp, Homo sapiens
  misc_feature: GYAE6OF02GMB03.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctatgcagcctgtggtattccaccttcaattacctatgtcctttgccactgggtcccgccagactccgagggcaacgggggccaggaggtggctgtctagttattcatatgatggaactaatcaatacacgcagtactcgtaggaacgggccattccacctactcctaccgaacgggtaactaacgttaccgaacggtaaccacggtctacgttaccgtaccttaaccaaacgttcggaacctacggtacccgtaggtaacgtaaccgtacgaacccggtaaccgtaccgggttaccttaggttacctttaagtttacgtttagtacgggtaccggtaaggtaaccggttaccgttaccggtttagggtttaccgtttaggttacggttaacggttcggtaacggggttacgtagttacccgg

SEQ ID NO: 1311 - DNA, 642 bp, Homo sapiens
  misc_feature: GYAE6OF02JF43R.18.16.B05.1.454.CMB.1.raw
  modified_base (306)..(306): a, c, t, g, unknown or other
  misc_feature (306)..(306): n is a, c, g, or t
  modified_base (357)..(357): a, c, t, g, unknown or other
  misc_feature (357)..(357): n is a, c, g, or t
tcagtacgagtatgcacgaccggtgctcgatttagagctcacgtaaggggcgtgggagaggagcccagcactgaagtcgccggtgtttccattcggtgatcagcactgaacacagaggactcaccatgggagtttgggctgacctgggttttcctcgttgctcttttaagagtatccagtgtcaggttcaactggtgagtccggggagcgtggtcctggaccgtgggacgtcggactggagacctctccgtgtcgacagcctcgtggacttcaccttcaatacctatcgctttgcacgtggtcccncacgactccgaggcaaggggtccagtaggtcggctgtactagtttactttnatatgataggaactagtacaataccgtagacagtacccgtcgaagtaacgggtcctaataccaacgcttccaccgtaaggacctaacgttaccgaaggtaaccgacggtcttaggttcttaccgtaactaaacgtcgactaacggcccgtaagaacgtaacgtacgaaccgtacgtaccgtccgtagttcttacgtttaacgttcgaggtcgtaaggtaccgtacgttaacggtacgggttaccttaggtacgttaccgtacggtaagggtacaccggtttacgg

SEQ ID NO: 1312 - DNA, 623 bp, Homo sapiens
  misc_feature: GYAE6OF02HWIJU.18.16.B05.1.454.CMB.1.raw
  modified_base (154)..(154): a, c, t, g, unknown or other
  misc_feature (154)..(154): n is a, c, g, or t
  modified_base (299)..(299): a, c, t, g, unknown or other
  misc_feature (299)..(299): n is a, c, g, or t
  modified_base (329)..(329): a, c, t, g, unknown or other
  misc_feature (329)..(329): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttccncgttgctcttttaagaggtatccagtgtcaggttcaactggtggagtccgggggagcgtggtcctgcctgggacgtcgctgagactctctgtgcagcctctggattcaccttcaaattacctatgtctttgcacgtcgggtcccnccagacctccgaggtcgaacggggccaagngtcggctgtcagttattcatatgatggaactaatcaatacgtacgacagtactccgtaggaaggtcccgagtttaccacctactactccgaacgggtactaacgttaccaacggaaccaaccgctaggtccttactaacaaacgtcggaaccacgtccgtaggaacgtaacgtacgaaccgacgacggtacgtcttaccgttagtttacttgggtacgtaccggtaggtaacgacgttaccgttaggtttaacgtggttacggttacgttacggtaagggtacgtaacgttcgg

SEQ ID NO: 1313 - DNA, 640 bp, Homo sapiens
  misc_feature: GYAE6OF02FN94K.18.16.B05.1.454.CMB.1.raw
  modified_base (306)..(306): a, c, t, g, unknown or other
  misc_feature (306)..(306): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagaggtatccagtgtcaggttcaactggtggagtccgggggagcgtggtcctgcctgggacgtcgctgagtacctctcctgtgcagtcctctggattccaccttcaataccctatgtctttcgctacgtcgggtcccnccgagtacctccgaggcgaacggggccaaggagtggctgtcagtttattcatatgataggaacttaatactaaatacgtaacgcaacgtacctccggtaggaacggggtaccctagttaccaacctagtccctacgaacgggtacctaacgttaccgaaacggaacctaccgtaccgttcgttaccttaccttaacgaaacgtcgaacctacgacgtaggaacgtaacgtcgaacggtaccgacggtacctagtacttagttattcgtagcggaagtacgtaccgttacggttacggttacgttggtgtacgttacggaaggtagtagttccgg

SEQ ID NO: 1314 - DNA, 565 bp, Homo sapiens
  misc_feature: GYAE6OF02GYD5N.18.16.B05.1.454.CMB.1.raw
  modified_base (298)..(298): a, c, t, g, unknown or other
  misc_feature (298)..(298): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggagcgtggtcctgcctgggacgtcgctgagactctcctgtgcagcctctggattcaccttcaataccctatgtctttgcacgtgggtcccnccagacctccgaggcgaaggggccaggagtggctgtcagtttattcatatgatggaactaatacaatactacgcagctcggtagaagggccattccactatctaccgaggacaacttccaaggacacgctcgtactctaacaacgtgactacgcctagaacgaactacgaacgacgacgtctacgttacttaagtttattagtgaacggtagacgtacctaagttcgggttactcggttagtagtttcggagggtagtaacgtccgg

SEQ ID NO: 1315 - DNA, 702 bp, Homo sapiens
  misc_feature: GYAE6OF02H4KHG.18.16.B05.1.454.CMB.1.raw
  modified_base (172)..(172): a, c, t, g, unknown or other
  misc_feature (172)..(172): n is a, c, g, or t
  modified_base (251)..(251): a, c, t, g, unknown or other
  misc_feature (251)..(251): n is a, c, g, or t
  modified_base (488)..(488): a, c, t, g, unknown or other
  misc_feature (488)..(488): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagnggtatccagtgtctaggttcaacgtggtggaggtccgggggagcgtggtcctgccgtgggactgctgagcctctcctgngcacgctcgtgtacttctaccttcaaacttacctattgtcctttcgacgtaccggttcggggtcccacccgtagaccccgtaccgacgggaccggaacgggggaccaaggtgtccgggccttggttaccttaaggttttaactttccaagttagttaggtaacgtaacgggttaaacctaataacgtaaacttacgtacgacgtacgtacgtacggaggtaacggcctacgttaccncgtactcccgtaccggaacgtaactaaccgtccgaaaggtaccacgtcttggtaccttacgttaaacaacgtacgactacggtacctaaggtaactaaacgtcggaaaccgttaccgtaccgtgttacgttaaccttagttacgttgacgtaggaaagttacgtacgttacgggttagtcgttagttacgacgttaggaacggtagtactcggg

SEQ ID NO: 1316 - DNA, 734 bp, Homo sapiens
  misc_feature: GYAE6OF02JB0WN.18.16.B05.1.454.CMB.1.raw
  modified_base (98)..(98): a, c, t, g, unknown or other
  misc_feature (98)..(98): n is a, c, g, or t
tcagtacgagtatgcacgaccggtgctcgatttagagctcacgtaaggggctgggagaggagcccagcactggaagtcgccggtgtttccattcggtnatcagcactgaacacagaggactcaccatgggagtttgggctgacctgggttttcctcgttgcttcttttaagaggtatccagtgtcaggttcaactggtggaggtccgggggagcgtggtcctggcctgggacgtcgctggagccttctcctggtgcacgcctcgtggacttccaccttacaaacttaccctatcgtctttacgctacgttcggggtccaccaaggacctaccgaggtaccgaagggggcccaaggtacggtcggtcgttaggtactaaggttttactttcgaattagtacgtactacggtaaacttaactacgttaaacttactacggactaacggtaccgttccggtaagggaaaccggggtccctaatttacccgaacctacgttcccgtaaccgaacgggtaactaaccgttaccgaaacggtaaccgaccggtcgttagtacccgttaacgtaaacgtaaacgttacggaaccgtacggtacccacggtaaacgaaccgttacgggaaacccgtacgaaccgggttctacggttattacgtttagttggtacggacgtaacgacgtaacgttcggttaacggttacgtagttagtacgtacggaacggtagtaacgtcgg

SEQ ID NO: 1317 - DNA, 638 bp, Homo sapiens
  misc_feature: GYAE6OF02I8YUF.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccggggaggcgtggtcctgccgtgggacgtcgctgagactctcctgtgcagcctctggtacttcaccttacaattaccctatcgtctttgactacgtcgggtccgccagtacctccgaggcgtaacggggccaggaggtcggctgtacgtagtttattcatatgatagaactaatactaatacacgacagtaccgtacgtggaacggtccgtattcgacctatccgtaccgacgggactaacgttccgaacgtaacgcgtacgtcgtactaccgtaacaacgttcggactacggtacgtaggaacgaaccgtcggaacgaccggtaccgtcttacggttactaagtttacgttggacgttcgtaaggtacgttaccgttacggttacggttacgttacgggtacgttacgtacggtaaggggtaacgtcgttaccgg

SEQ ID NO: 1318 - DNA, 724 bp, Homo sapiens
  misc_feature: GYAE6OF02HYVGF.18.16.B05.1.454.CMB.1.raw
  modified_base (357)..(357): a, c, t, g, unknown or other
  misc_feature (357)..(357): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcagttcaacgtggtggaggtccggggagcgtggtcctgccgtgggacgtcgcttggagtacctctccgtgtgcgacgtcccgtgtaggtactttcgtaccttacaaactacctatcgtctttgcctacgtcgggtcccgaccgacgtacctccgaggcggaacggggccaggnggtggtcgtgtacgtagtttatttctaattagtgtaagttacggtaaacttaacgtaactaaacgttaaccgtaacgtaccgaagtaacccgttccgggtaacgggaaccgggtaccgtacttacccaaccgtactccgtaccggaagggtacctaaacgtacgaacggaacgaccgtacgttacgtactaccgtaaagtaaacgtaggaacctacggaccgtaagaacggtaacgtacggaaccgacgtacccggtgttacgttacgttatttacgtttcgtaggtacgtaacggtaacggtaccgttaacggttacgggttattcggttacggtacgttaacgggacgggttacgtacgtaccgg

SEQ ID NO: 1319 - DNA, 758 bp, Homo sapiens
  misc_feature: GYAE6OF02JM68I.18.16.B05.1.454.CMB.1.raw
  modified_base (169)..(169): a, c, t, g, unknown or other
  misc_feature (169)..(169): n is a, c, g, or t
  modified_base (209)..(209): a, c, t, g, unknown or other
  misc_feature (209)..(209): n is a, c, g, or t
  modified_base (260)..(260): a, c, t, g, unknown or other
  misc_feature (260)..(260): n is a, c, g, or t
  modified_base (264)..(264): a, c, t, g, unknown or other
  misc_feature (264)..(264): n is a, c, g, or t
tcagtacgagtatgcacgaccggtgctcgatttagagctcacgtaagggcgtgggagaggagcccagcactgaagtcgccggtgttccattcggtgatcagcactgaacacagacggactcaccatggagtttgggctgacctgggttttcctcgttgctcttttaagnggtatccagtgtcaggttcaactggtggagtccgggggancgtggtcctgcctgggacgtcgctgagacctcgtcctggtgcacgtccctntggnttcgaccttcaatacctatgtcctttgaccgtacgttcggtaccgccaagtacctacccgaggcgaaacggggcccaaggacggtccgggtactggtcctaacggttttcttacgtagtaattcggtaactacggggtaaaccttaacgtcgaaactttaaccgtacggactacggtaccttccggaggaaccgggtcctaagttaccaaccgtacgttacctaccggaacggtaaccgtaacttaccgaacgggtaaaccaccgtacgttacgttacctttaacgtaacctaaacgttgggaaccctacggtaaccgtaccgaaacggtacccgttaacggaaccggtaaccgggtaaccggttaccgttacgttaacgttaacgtttaaccgtttcggtaacgtgggtaaccggtaccgttaacggttaccgttacggggtttacctaacgggtacgttaccggttacggaccgggttaagtacgttaccgg

SEQ ID NO: 1320 - DNA, 731 bp, Homo sapiens
  misc_feature: GYAE6OF02G8HKE.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctctttaagaggtatccagtgtcaggttcaactggtggagtccgggggagcggtggtcctgcctgggacgtcgctgagactctcctgtgcagtcctcgtggacttcacctttcaaactacctatcgctttcgcctacgtcgggtcccgccgagactccgaggccgaacggggccaggaggtggctgtcctagtttacttcatatcgataggtaactaatactaaactaaccgtacgacgaacgtaccgttaccggaggtaacggggtccctaagttacccaaccctacgttactacccggtaaacgggtactaaacgttacccgaaacgggtaaccaaccggtccttacgttaaccgttacctaaacgtaaagttacgaacctaacggtcccgtaacggaaccggtaaaccgtaccggaaaccggtaaccgtaaccgggtaccttaacggtttaccgttaacgtttaacgttggttacggacgggtaacgtaaccgggttaccgttaacggttacgggtttaacgttcggttaacggttacgttaacggtaagggtaacggtagttaccggg

SEQ ID NO: 1321 - DNA, 601 bp, Homo sapiens
  misc_feature: GYAE6OF02IQYND.18.16.B05.1.454.CMB.1.raw
  modified_base (251)..(251): a, c, t, g, unknown or other
  misc_feature (251)..(251): n is a, c, g, or t
  modified_base (308)..(308): a, c, t, g, unknown or other
  misc_feature (308)..(308): n is a, c, g, or t
  modified_base (332)..(332): a, c, t, g, unknown or other
  misc_feature (332)..(332): n is a, c, g, or t
  modified_base (352)..(352): a, c, t, g, unknown or other
  misc_feature (352)..(352): n is a, c, g, or t
  modified_base (410)..(410): a, c, t, g, unknown or other
  misc_feature (410)..(410): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcacatgggagtttgggctgacctgggttttcctcgttgcttcttttaagaggtatccagtgtcaggttcaactggtggagtccgggggagcgtggtcctgccgtgggacgtcgctgacgctctcctagtncagcctgtggacttcaccttcaatcctatgctttgcacgtggtccgccagacctcgnggcgaaggggccagagtggctgtntacgtttattcaatatacgngtaggaaacttaatacaattacacgacagtacctcgtaggacgggccgtaatccaccngttaccgcctaacgggtaccaaattccaaacgaaccgacgtcctgttcctactaaccgtaaatggaacaacgccgtagtacgaactacgaacgtaacgccggtacgtcttaactagttacgttgacggacgtacgtacggtacttacggtacggtttagtggtacttacgtacgtagggtacgattaccgg

SEQ ID NO: 1322 - DNA, 585 bp, Homo sapiens
  misc_feature: GYAE6OF02JPSX3.18.16.B05.1.454.CMB.1.raw
  modified_base (342)..(342): a, c, t, g, unknown or other
  misc_feature (342)..(342): n is a, c, g, or t
  modified_base (458)..(458): a, c, t, g, unknown or other
  misc_feature (458)..(458): n is a, c, g, or t
  modified_base (483)..(483): a, c, t, g, unknown or other
  misc_feature (483)..(483): n is a, c, g, or t
  modified_base (487)..(487): a, c, t, g, unknown or other
  misc_feature (487)..(487): n is a, c, g, or t
  modified_base (556)..(556): a, c, t, g, unknown or other
  misc_feature (556)..(556): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagttgggctgaccttgggttttcctcggttgcttgttttaaagaggtactccagtgtactaggttcaacgtgggtggacggtcgggggaggtcgtggtcctggccgtgggcgtcgcgtgacgacctctacctgtgcacgtcctgtggtcttctaccttacaatacctattcgtctttgcgtcgtgccgcacgctccgacggacgacggcaggngtcggctgtctaagttacgttactatactgagtagtaactatacgtatactacggctacgacctacgtaggaacggtctactctacctatctacggaacgaactactacgagaacncgctatcgactaagatacgactacncgtnagtaccgacgtacgacacgtcgtcttacttagttcgtagtcgtagaataccgagtaccgttaggtagtntacggttagacggaaggtagtaacgtcgg

SEQ ID NO: 1323 - DNA, 631 bp, Homo sapiens
  misc_feature: GYAE6OF02ID309.18.16.B05.1.454.CMB.1.raw
  modified_base (256)..(256): a, c, t, g, unknown or other
  misc_feature (256)..(256): n is a, c, g, or t
  modified_base (297)..(297): a, c, t, g, unknown or other
  misc_feature (297)..(297): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatgggagtttgggctgacctgggttttcctcgttgctcttttaagaggtatccagtgtcaggttcaactggtggagtcggggagcgtggtcctgccgtgggacgtcgctgacgactctcgtgtgcagcctntggacttcaccttcaactacctatgcttgcacgtgggtccncacgctccaggcgaaggggcctaggagtcggctgtcgtagtttattccgatagtgaagtgaaactatacaatacagctagactcgtagacggctattacgatactaatctacgaagggtactaaatccgtaacggaactacggtactcgttacaacgtacgtaaagtcggactaacgtcccgtaaggtaccgaaacgttcgaaaccggtacctaaccgggtcttacggtttaacttacgttacggtttaggtaccggaacggtaacggttacggtaaccgtttaacgttacggggtttacttacggtacgttaaggtccgaagggtagtaaccg

SEQ ID NO: 1324 - DNA, 603 bp, Homo sapiens
  misc_feature: GYAE6OF02FPEW1.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgctcttttaagaggtatccagtgtcaggttcaactggtggagtccgggggaggcgtggtcctgcctgggacgtcgctgagactctcctgtgcagcctctggattccaccttcaataccctatcgtctttgcacgtgggtccgccagacctccaggcgaaacggggccaggaggtcggctcgtactagtttatttcattatgataggtaactaatcaaatactacgctagacctcgtaggaacggtccgtaattcaacctactcctaccgaaggaactaacttaccgaaggaaccacgctagtacctacgtaacaacgtcgaacacgtacctagaacgtaactacgaccgacgacggtctaggtacttaagttgttagtcgacgaagtacgtaacttacggttaggttacgttggtcgttacggttacgtaagggtagtagtacgg

SEQ ID NO: 1325 - DNA, 740 bp, Homo sapiens
  misc_feature: GYAE6OF02GHQQE.18.16.B05.1.454.CMB.1.raw
  modified_base (266)..(266): a, c, t, g, unknown or other
  misc_feature (266)..(266): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggttactccgagtgtcaggttcaacgtggtggaggtccgggggagcgtggtcctggccgtgggactcgctagacgactctctgtcgcagtcctntggtacttcaccttacaatacctatcttcgttcgcctaggttcgggccctaccgacgtaccgtaccggaggtaccggaacggggtcctaagggtacggttcggccttacggtcttaaggttttactttaccgattacgttggaacgttaggtaaacttaagtacctaaagttacctaacgtacgaacgttaccggtacggtacgggtaaacgggtccctaacgttaacccgtaccctaacgttaccccgtaacgtaaacgggtaccttaaaccggtaccgtaacggaaaccgtccttaccgtagttaccctaacgtaacgaacgttcggaaacctggacccgtaggaacctacggtaccgaaccggtaccgtaccggtacttaccggttatttaacgttatacggtacgacgtaaggaccgttaacttcgggttacggtagtcgtcgttacgtacggtacggtactacgtaccg

SEQ ID NO: 1326 - DNA, 714 bp, Homo sapiens
  misc_feature: GYAE6OF02IRDPY.18.16.B05.1.454.CMB.1.raw
  modified_base (264)..(264): a, c, t, g, unknown or other
  misc_feature (264)..(264): n is a, c, g, or t
  modified_base (325)..(325): a, c, t, g, unknown or other
  misc_feature (325)..(325): n is a, c, g, or t
tcagtacgagtatgcacgaccggtgctcgatttagagctcacgtaaggggcgtgggagaggagcccagcactggaagtcgccggtgtttccattcggtgatcagcactgaacacagaggactcaccatggagtttgggctgaccttgggttttcctcgttgcttacttttaagaggtatccagtgtcaggttcaacgtggtggaggtccgggggagcggtggtcctggccgtgggaccgtcgcctggagacctctcgtgtgccngcctcgtggtactttccgtaccttacaacttacctattcgtactttgctacggtcggtccncacgctcgaggacgacgggcaggacgtcggctagtactagtttagttcatacgtagtacgtacgtaaacttactaacgtaagttacctaacgtcgtaagaccgttaccgggtacgggtaaaccggtcccgtattacccaacctacgtacccgtacccggaaggtaacccttaacgtaaccgaaacgggtaaccctaccggtacccttacggttaccttaacgtaaacgtaaacggtcggaaccacgttaccgaaggtaaccgtaacgtacgaaccggtaacctacggtacttagtacttaacgttgtacgtacggtacggtaacgtcggtaacgttaacggttagggttacttgggttacgtcgttaacggacgggtacacgttacggg

SEQ ID NO: 1327 - DNA, 693 bp, Homo sapiens
  misc_feature: GYAE6OF02G3O2X.18.16.B05.1.454.CMB.1.raw
  modified_base (259)..(259): a, c, t, g, unknown or other
  misc_feature (259)..(259): n is a, c, g, or t
  modified_base (305)..(305): a, c, t, g, unknown or other
  misc_feature (305)..(305): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaacgtggtggaggtccgggggagcgtggtcctgcctgggacgtcgctgagactctcctgtgcacgcctntggattccaccttcaatacctatgtctttcgctacgtcggggaccnccaggaccctccgaggaccgaaacggggccaaggacggtcgggctgtactaagtttactttacattatgaagttaggaaaaccttagtactaaagtacctaccgacgtaagtccgtacccggtaaggaaccggggcctaatttacccgaacccgtaagtccctaaccgaacggggtaactaaacgttaccgaaacggtaaaccgacgtacccttagttccttaacctaaactaaacgtacggtaccaacggtaccgttaggaacgactacggaaccggtaccgaaccgggttctacggttactagtttagttacggtcggtacgtaaggtacgtaacgtaaggttacgttacgttacgtgttacgttaggtacggtaggacgtaacgg

SEQ ID NO: 1328 - DNA, 794 bp, Homo sapiens
  misc_feature: GYAE6OF02FK9UY.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttggggctgaccgttgggttttcctcgttgcttcttttaagaggtatccagtgtcaggttcaacgtggtggaggtccgggggagtcgtggtcctgccgtgggacgtcgctggagacctcctcctgtcgcacgtccctgtggactttccgaccttcaaattaccctagtcgtctttgacctacgtcggggtcccaccacggacctaccggagggaccgaacgggggccaggacgttacgggctggtactagtttattacattataggtacgttagaaactaagtacctaaacgtactaacgaccgtaagtaacccgtcggtaaggggaaccggtcctaacttaccgaacctacgttacccgtaccggaaacggggtaacccttaaaccggttacccgaaacgggaaccccgtacgtacccgtttacggttacccgttacctaaaacggtaaccggtacgggtaacctaccggtaaccgtaaggtaaaccggtaacgtaccgggtaaccgggtaccgtaaccggttcgttacgttaacgtttaagtttaacggtttcggaacgggttaccgaaacggttaccggtaaaccgtttaaggttaccgggtttaacggttaggtttacggttaaacgttcgggaaggggttacctacggttacccggg

SEQ ID NO: 1329 - DNA, 673 bp, Homo sapiens
  misc_feature: GYAE6OF02G41O5.18.16.B05.1.454.CMB.1.raw
  modified_base (171)..(171): a, c, t, g, unknown or other
  misc_feature (171)..(171): n is a, c, g, or t
  modified_base (357)..(357): a, c, t, g, unknown or other
  misc_feature (357)..(357): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagnggtatccagtgtcaggttcaactggtggaggtccgggggagcggtggtcctgcctgggacgtcgctgagactctcctgtgcagcctctggattctaccttctaaataccctatcgtctttgctacgtggggtcccaccagacctccagggcgaacggggccaaggagtggcttgtctagtttattnatatgagtaggaaactaatcgtaatactacgctacgaccgtcgtaggaacgggcctattaccaccgtatcctaccgaacggtactaaacttccgaaggtaaacctaccgcttacggtacctacgttaaacaacgttacggaacctaacgtcccgtaaggaacgtaaaccgtcgggaaccgaccgtaaccgggccttacggttaacttagtttaacgtttgggtacggtacggtaacggacggttaaccgttacggtttacgggtttaacgtacggtttagtaacggtttacgggaacggggtattaaccggttcgg

SEQ ID NO: 1330 - DNA, 857 bp, Homo sapiens
  misc_feature: GYAE6OF02JN0E2.18.16.B05.1.454.CMB.1.raw
  modified_base (279)..(279): a, c, t, g, unknown or other
  misc_feature (279)..(279): n is a, c, g, or t
  modified_base (356)..(356): a, c, t, g, unknown or other
  misc_feature (356)..(356): n is a, c, g, or t
tcagtacgagtatgcacgaccggtgctcgatttagagctcacgtaagggcgtgggagaggagcccagcactggaagtcgccggtgttccattcggtgatcagcactgaacacagtacgactcacctagtggtagtttgggctgtaccttgggttttacctcgttgcttctttaaggacgtatccagtgtcaggttacaacgttgggtggacggtccgggggtgcggttcggtccctggacccgttagggccttcggctggaacgtctctccgtggtacncgtagtccctagtggtacttcctaaccttacaacttaaccttagtcgttccgtttagaccgacggtcggggtacccnccgttaacggtacctccggaaggtaccgaacggggcctacggggtacgttcggccttggtaacgtagtttagttacattaggtccgaacgtacggtaacttaaggtacctaacggttactaccgggactaacggtttaccccgtaacgggttacgggaacggggtaccctttacggttaacccgacccttaaccgttccgtaaaccccgggagggaaacccttaacgggttacccgaaaacggggttacccaagttccgttacggtttaacctccggttaaaaccaagggttaacccgggtaaccttacggaacttacggggaaaccctttacggacccggtttaaaccgtaaccggttccggttaccgtttaacggtaactttaacggttaaccggttggtaaccccggtaaggtaccgtaacggtttaaccggttaacgggttttcggtaaccggttaggtcccgttaaaggttggtacgggtaacgtaccgtttacgg

SEQ ID NO: 1331 - DNA, 828 bp, Homo sapiens
  misc_feature: GYAE6OF02FI5HM.18.16.B05.1.454.CMB.1.raw
  modified_base (174)..(174): a, c, t, g, unknown or other
  misc_feature (174)..(174): n is a, c, g, or t
  modified_base (208)..(208): a, c, t, g, unknown or other
  misc_feature (208)..(208): n is a, c, g, or t
  modified_base (243)..(243): a, c, t, g, unknown or other
  misc_feature (243)..(243): n is a, c, g, or t
  modified_base (258)..(258): a, c, t, g, unknown or other
  misc_feature (258)..(258): n is a, c, g, or t
  modified_base (266)..(266): a, c, t, g, unknown or other
  misc_feature (266)..(266): n is a, c, g, or t
tcagtacgagtatgcacgaccggtgctcgatttagagctcacgtaagggctgggagaggagcccagcactggaagtcgccggtgtttccattcggtgatcagcactgaacacagagactcaccatggagttgggctgaccgttgggttttcctcggttgctttacttttaaggnggtactccgagtgtcaggttcaacgtgggtaggnggtccgggggagcgtgtccgtgcgtagggcgtcgntgagtctctctgtcncacgcctntggtacttcacttcaagttacctagcttcgtacgctagttcgggaccgtacacgtacacccggtaggaccggaacgggtcaacggtagtccggcttgttaccgtagtttacttcgtaatacggttaggtacacggttaaactaaccgtcgtaaaacgttacccggttacgaacctaaacggttcccggtaacgggaccgggtaaaggggttacccctaagttaacccgtaacccgtgtaaccgttaccgggaaacgggtaaccttaaccgttaacccggaaacggtacctacgtcccgttaattacccgtaaagttaaccgtaaacggttacgtaaccgacgtaacccgttaggggaaaccgttaaaccgacgtaaaccgaacgggttaaccgttagttccgttttaacgttaaccgtttacggttacggtacgtaaaccgggttaaccggtaaacggtacccggtttttaacgggaacgggttttaacgttaacggggtttaacccttttaagggggttaaacgtacccggggggttaaaatttcccgggttaaacccggg

SEQ ID NO: 1332 - DNA, 850 bp, Homo sapiens
  misc_feature: GYAE6OF02HPUB6.18.16.B05.1.454.CMB.1.raw
tcagtacgagtatgcacgaccggtgctcgatttagagctcacgtaaggggcgtgggagaggagcccagcacctggaagtcgccggtgtttccattcggtgactcagcactgaacacagagtctcaccatggagtttggctgtaccgttggggttttcctcgttgcttacgttttaagacggtatccgagtcgtctaggttccgaagtggtggaggtccggggaggcgtggtcctggccgtgggacgtcgcgtggagaccgttcgtccgtggtgcgacgtccttcgtaggtacttacctaccttactaacttaccgtagttacgtcgtttacgacgtacgttcgggtcccgtaacctaccggtaccgtaccggtacgggaaccggaaccgggggaccctagggacggtcgggtccgttacggtcgttaaggtttcgtttacgagttacgtggtaacgtaacgggtaaacctaacgtacgtaaacgttaccgtaacggccgtaacgtacccggttacgggtaacggtaacccggtaccgtaccgttacccgactaccggttacgaaccgggtaacgtaccttacgtaacggaccggtaaccgtacgtcgttaccgtacgtaaacgtacggttaacgaccggtacgttaccggaacgtaacggtaaccgtaaaccggtcggtaaacccggaccgtttaacgttaccggttccgtttaaaccgtttaggtttacggttcggtaacgggttacccggttaacggaacggtttcccggttaaacggggtttacggttttcggtaagggccggtttaaacggttaccgggtaacgggttacgttacccgttacgggg

SEQ ID NO: 1333 - DNA, 943 bp, Homo sapiens
  misc_feature: GYAE6OF02GP3D2.18.16.B05.1.454.CMB.1.raw
  modified_base (217)..(217): a, c, t, g, unknown or other
  misc_feature (217)..(217): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagttgggctgaccttgggttttccctcgttgcttcttttaagaggtatccagtgtctaggttcaacgtggtggagggtccgggggggntcgggtccgtcgtccgtcgggtacggtccgtcgtagagaccgtcctccttcgtgtacgacgtccgtccgtggtacttcctaaccgttttaccctaaactaacccttaacgttacttccgttttacggtctaacccgttcggggtacccggtccccaacgttaacccgacccgagggaaccggacgggggacccggacgtagggtaggtccgtacgtgttaaccggttattttactaactaagttgtaacgttaacggtaaccgttaaaacttaccgtaaattaaaccgtacccggtaccgtaagggttaaccctacccgggttagggtaaaacgggggacccctttaaccgttaacccggtaacccctaacgtacccgtaccccggaaggggttaaacccctaaccgtttaaacccgaaccggttaaaacccaacgggttacccgttccggtttaaccgtacccgttaaaaccttaaaacgggtcccggttaaagccctaaaacggtcggtaaacgggtaaacccggtaccgaaaccgggtaacccggaaccccggttgttaacccgggttaacttttaaaccgttagggtttacggtcccgggtaacgttaaacgggtaaacccggttaagggttttaaacccgttacggggttttaccggaccgtttagggttaaccttaaccgggtaacggggggttaaacttaggttaacccggttacccgg

SEQ ID NO: 1334 - DNA, 769 bp, Homo sapiens
  misc_feature: GYAE6OF02JXSSI.18.16.B05.1.454.CMB.1.raw
  modified_base (192)..(192): a, c, t, g, unknown or other
  misc_feature (192)..(192): n is a, c, g, or t
  modified_base (306)..(306): a, c, t, g, unknown or other
  misc_feature (306)..(306): n is a, c, g, or t
  modified_base (469)..(469): a, c, t, g, unknown or other
  misc_feature (469)..(469): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccgtgggttttcctcgttgctcttttaaggaggtatccagtgtctaggttnaactgggtggaggtccggggggagcggtggtcctggcctggggacctcggcgtggaagccgttcctccgttcggtgaccacggtcccttagtaggtacctttcgaacccttttnaaaccttacccttaagttctccgtttagaccgtaccggtttcggggtccccgaccaccggtaaccccgttcccggaggtaccggaacgggggtcccagggtacgtcgggacttcgggtacgtaagttttactttcgaattgtagtagttacggtaaacttaanaacctaatacccgttacggactaacgtacccggttacggagggtaaccggtaaccgtcttaaccgaccctgtacctaccggaagtaactaaaccggttaacctacgaaacgtaccggcttaccggttcttaacgttaacgaaaccgttaggccgaagttccgtaacgaacggtacctacgggaaccggtaccgaaaccggttcctagtacgttacgtttacgtcggtggtaacccgtggttaacgtccgttaacgtaacgggtttctaggtcggtattacgggaacgttagtccgttagg

SEQ ID NO: 1335 - DNA, 765 bp, Homo sapiens
  misc_feature: GYAE6OF02ILHOT.18.16.B05.1.454.CMB.1.raw
  modified_base (757)..(757): a, c, t, g, unknown or other
  misc_feature (757)..(757): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcacatggatttgggctgaccttgggttttcctcgttgtcttcttttaagaggtactccagtgtctaggttcaaacgtgggtaggacggttccggggggacgtcggttcggtcctcggaccgtgggggtaccgtcgcgtggaacgtcttcctcgttggtacggccgtaggttcctcgttaggtactttcctaacctttacgaacttacctagttcgtcgtttgaccgtacgttcgggtaccctcgaacgcctacccggaggaccggtacggggaccaggtacgtggtaccttgtacttacggtttaactttctaagtaacgttacggagtacggtaaacttaaagtaccgtaaactttacgtaccggtataaccgtaccgtacccggttaagggaacgggtacccttaacgtttacccgaaccgttaacttcccggtaaccgtaacggggtaactaaaccggtttaaccggaaaccggtaaaccgtaccggtaaccttcggttaacctacgtaaacgaacgttacgacacgtctacgaacgtacgtacgaacgacgacgtctcggtacttattacgtgagtacaacgggtaactcgtaccggtaggttcgtaggttactcggttaataggtaccgtnttaccggg

SEQ ID NO: 1336 - DNA, 779 bp, Homo sapiens
  misc_feature: GYAE6OF02G5V2F.18.16.B05.1.454.CMB.1.raw
  modified_base (274)..(274): a, c, t, g, unknown or other
  misc_feature (274)..(274): n is a, c, g, or t
tcagtacgagtatgcacgaccggtgctcgatttagagctcacgtaaggggctgggagaggagcccagcactggaagtcgccggtgtttccattcgtgatcagcactgaacacagaggactcaccagtgggtagtttgggctgaccgttgggtttttccctcgttcgcttacttttaaggaggtactccaagtgtcaggttctaacgtggtggaggtccgggggagcgtcgtctgaccgtgggacgtcgctgacgtacctcgtccgttgtgaccncggtacccttcgtacggtacttacccttaaccttacctaaacgtaaccttacgttcgttccgttacgtcccgtacgtccggggtccaccgaccgtaccgtaccggacggaccggtaacgggacgtaacggtggacggttcgtcgttacgttagtttacctttacgaatttacgtacgtagttaacgtaaacttaacgtaactaaacctttacgtacctaacggtaaccgttacccgtacggtaacgggtaaccggtactacccgttaccaccgtaccgtcccgtaaccggaacggtaactaaccgtccgaacggtaccgacgttaccgttactaactacttaacgtacgtaacgctacgtaccgtagaccgtaacgcgtaacgccggtacgttccgtagttactttgtacggttcgtaggaaccgtggtaacctacggtttaaccggttacggtttacgttagttacgggttaacgttaccggaaggttaccggtacgttaccgg

SEQ ID NO: 1337 - DNA, 669 bp, Homo sapiens
  misc_feature: GYAE6OF02FO1F9.18.16.B05.1.454.CMB.1.raw
  modified_base (598)..(598): a, c, t, g, unknown or other
  misc_feature (598)..(598): n is a, c, g, or t
  modified_base (622)..(622): a, c, t, g, unknown or other
  misc_feature (622)..(622): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgcttcttttaagaggtatccagtgtcaggttcaactggtggaggtccgggggagtcgtggtcctgccgtgggacgtcgcgtgacgactcctccgtgtcgccaggcccttcgtggtacttccacctttcaaacttaccctattcgtctttcgcctacgttcggggtccccgaccacggtacctcccggaagggaccgtaaacgggggccaacgggacgggttggccgttagtactagttttactttccaattacgtgtagttaggaaacttaatacctaaagtacctaacggactacgaaccgtccggtaaggaaccgggtcctaacttaccgaacctacgtaccgtacgaacgggtaactaactaccgaacggaaccctacgccttacgtcctaactaacaaacgtgaccagacctagaagacgtagaccgacgacgtntacgttctagttgttgtcaggtanagtactacggttacggtactgtacgtagtaggtagggacgtatccgg

SEQ ID NO: 1338 - DNA, 699 bp, Homo sapiens
  misc_feature: GYAE6OF02HP70Y.18.16.B05.1.454.CMB.1.raw
  modified_base (306)..(306): a, c, t, g, unknown or other
  misc_feature (306)..(306): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttctttaagaggtatccagtgtcaggttcaactggtggaggtccgggggagtcgtggtcctgccgtgggactcgctgagtactctctgtcgcagcctcgtggtacttcaccgttcaacttaccatcgtctttgctacgtggtcccnccagcctcgaggcgacgggcagtagtcggctgtacagtttattcgtatagtacgagtacggaaccttaattacgaaattaccgtacgaccgaacggttaccgtccgggtaagaaacggggccctacttaaccgaacctacctaccgtaacccggtaaagggaaccctaaacggttaccgaaacgggtaacccgaacgtacccgttagttacccgtaacttaaacggtaaacgttcgggaacccacgtaccgttacggaaacgttacgacgaaacggtaccgtaacgggttaccttagtacgtttaacttagttaccggttagacggtaagacgttacgttaacggttcggttacgttaggtacgttagtaacgggaagttaccggtagtccgg

SEQ ID NO: 1339 - DNA, 657 bp, Homo sapiens
  misc_feature: GYAE6OF02F2NCC.18.16.B05.1.454.CMB.1.raw
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
  modified_base (302)..(302): a, c, t, g, unknown or other
  misc_feature (302)..(302): n is a, c, g, or t
  modified_base (339)..(339): a, c, t, g, unknown or other
  misc_feature (339)..(339): n is a, c, g, or t
  modified_base (386)..(386): a, c, t, g, unknown or other
  misc_feature (386)..(386): n is a, c, g, or t
  modified_base (568)..(568): a, c, t, g, unknown or other
  misc_feature (568)..(568): n is a, c, g, or t
tcagtacgagtatgcacgaccggtgctcgatttagagctcacgtaagggcgtgggagaggagcccagcactggaagtcgccggtgtttccagttcggtgatcagcactgaacacagaggactcaccatggagtttgggctgacttggtttccngttgcttcttttaagngtatccgagttcgtctaggttacaacgtgggtacggaggtccgggggagtcgtggtacctcggccgtagggtcgtcgtactggaagtcctccgtccgttgtacgctacgtcccttgttagcttaccaccttanaacgttaccgtatcttcttgactcgtcggtccactanccgtacgtggacgtaacggccgtagtcgtggcttcgtactgttactnactagtgtacgtacggtaactagtcaagtactacgctacgtaccgtggcggaacggtcctaagtccgacctacgtcgtaccgacggtactaacgtacgaacgacgaccgtgttactactacaacgtacgtacgacgtgacgtaacggtactaccggactacggacgtacggtacttacggtnttacggttctagggtaccgttagacggtaaccgttgttaaccggttaggttacgtgtaacggtccttaagggaccgtacggtatccggg

SEQ ID NO: 1340 - DNA, 636 bp, Homo sapiens
  misc_feature: GYAE6OF02H1CBK.18.16.B05.1.454.CMB.1.raw
  modified_base (271)..(271): a, c, t, g, unknown or other
  misc_feature (271)..(271): n is a, c, g, or t
  modified_base (285)..(285): a, c, t, g, unknown or other
  misc_feature (285)..(285): n is a, c, g, or t
  modified_base (316)..(316): a, c, t, g, unknown or other
  misc_feature (316)..(316): n is a, c, g, or t
  modified_base (362)..(362): a, c, t, g, unknown or other
  misc_feature (362)..(362): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggtttttcctcgttgcttcttttaaggaggtacttccagtgtcaggttcaacgtggtggaggtccggggaggcgtggtcctggccgtgggaccgtcgctagacgtactcgtcctgtgcagccctntggacttcaccttnaacttacctatagctttgctactcgggtccncagactccgacggcgaacggggccaggcgtaggcctgtacagtttnttacatactgactgggtaacttaatacgaataaccgtagacagtacctcggtgaacggacccgtattaccgaccgattccgtacgacggtaactacgttaccgaacggaccacggtacttcgtacctacgtaacgaaattcgggacaggtcccaggtaacgacgtccgaacgaccgacgtctaccgtgttacgtttacgtaggttacgcggaattacggacttacggttaggttaacctggttagtaccttacggacggttagtactacccggg

SEQ ID NO: 1341 - DNA, 797 bp, Homo sapiens
  misc_feature: GYAE6OF02FJ5VT.18.16.B05.1.454.CMB.1.raw
  modified_base (177)..(177): a, c, t, g, unknown or other
  misc_feature (177)..(177): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggtacgtttgggctggaccttgggttttaccctggttgcttcttttaagnggtatccagtgtcaggttacaacgtgggtggaggttccgggggagtcgtggtcctggccgtgggactccgctggacgtaccttctaccgtcggtgcctagtccctgtcggtaacttacccaaccgttactacttaaccctgtgtacctttacgcctacgtccgggggtcccacaggtaccctccgtagggtaccaacgggggtcccaaggtacggttcggtccgtagttccgttaaggtttaccttcaaagttcgaggttaaccttagggtaacttaaacggccttaaacgtaaccgtacggcctaacgggttacccttcccggggtaagggaaacccgggtcctaaacgttacccctaccgtaactaccgtttaccccgggaaggtaacccttaacgtacccgtaacgggaactccggtacgttaccgtttaccacgttaaaaccgaagtccgacctaacgtccgttaagtacgaacccgtaacggtaccgacggtaacccgttcttaggttccttaaggttagttacggacgtacccggtaagtaccgggttaaacccgtttcggtaaaggtttccgttaggacctttagggtaccggacgggtaacttaccgtcggg

SEQ ID NO: 1342 - DNA, 820 bp, Homo sapiens
  misc_feature: GYAE6OF02FLEEP.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaactggtggagtccgggggagcgtggtcctgccgtgggacgtcgctgacgtaccgtctccgtgtcgcacgcccttctggacttccaccttacaacttacctatcggtctttcgacctacgttcggggtaccccgtccaacgtaccctccgaggacgtaacggggccaaggtaggtcggtccgttggtactaacggttttactttaaccgaattaagttacggtaacgttacgggtaaaccttaaacgttaccgtaaaaccgttaacccgtaaccggaccgtaacggtaacccgtttacccggggtacgggaaaccgggggttaccctaacgttaccctaacccgtactaccgtaccccggaaacgggtaaccctaaaccgttacccgaaacgggtaacccaccggtacgttacgttacccgtacctaaacgtaaacgtcgggtaacctacggtaaccgtaacggaacgtaaccgtacggaacccggaaccgtaccgggtacttacggttaacttacgttaagttcgtacggtacgtaaacggtaccgttaaaccggttacgtttacgggttaacgttggttaacgttaaccggttacggaacggggttaaccttaaccggttaacccggg

SEQ ID NO: 1343 - DNA, 771 bp, Homo sapiens
  misc_feature: GYAE6OF02IIY0R.18.16.B05.1.454.CMB.1.raw
tcagtacgagtatgcacgaccggtgctcgatttagagctcacgtaaggggctgggagaggagcccagcactggaagtcgccggtgtttccagtttcggtgatcagcactgaacacagaggactcaccatggtagtttgggctgaccgttgggtttttcctcgttcgtctttacgtttttaaggaggttactcctaggttcgtactaacgggtttacaacggttgggtggtaacggggttaccgggggggaggtccgggtacgggttctcggtacccggttggggaccttcggccttaggacgtaccttccgttccgtgttacgccgtacgccgttacgtggtactttccctaaccgttactaaacgttaaccttagtcgttctttcgcgttaccgtaccgggtccgaccgttaacgccgtaccgagggaaccgaacgggcaaggacgtcgtacgttcgacgtttagtttacttacgtaattagtacgaagttacggtaaacttacggactaacgttaccctaggaccgtacgtaaccggtacgttacgggaccggttacaccgtttacaccgttactaccgtacgaacgtactaccgtacgaacgtaacctcgtactcgtactacgttaacacgttacgataccgtgacgtatacgaaccgacgaccgtacggctagtaccgtttatacggttagtaccggcgtaacgtacgttcggttaacggtttacgtgttacgtaagttccgttaagggaacgtgtaagttcccggg

SEQ ID NO: 1344 - DNA, 633 bp, Homo sapiens
  misc_feature: GYAE6OF02HPNAM.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaactgggtggaggtccgggggaggcgtggtcctgcctgggacgtcgctgagacttctcctgtcgcagtcctcgtaggacttccaccttacaaactaccttatcgtctttcgctacgtcgggtccaccagaccctccgaggacgaacggggcctaggaggtggcttgtactagtttattacaattatagactaggtaaactaatacaataactacgacataccgtacgtaggaacggactactacacctatccacgtacggaacctaacgtaccgaaggaccaccgtctcgtacctactaaacgaagtcgactacgtacgtagaacgaactcgaaccgaaccgcggtcttagtactttagttgtacgtacggcggaagtaccgtaaccgttaaggttacgggttacttggtacgttacgttacgggaacggtagtaaccgtcgg

SEQ ID NO: 1345 - DNA, 775 bp, Homo sapiens
  misc_feature: GYAE6OF02HQD1D.18.16.B05.1.454.CMB.1.raw
  modified_base (242)..(242): a, c, t, g, unknown or other
  misc_feature (242)..(242): n is a, c, g, or t
  modified_base (255)..(255): a, c, t, g, unknown or other
  misc_feature (255)..(255): n is a, c, g, or t
  modified_base (257)..(257): a, c, t, g, unknown or other
  misc_feature (257)..(257): n is a, c, g, or t
  modified_base (262)..(262): a, c, t, g, unknown or other
  misc_feature (262)..(262): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgtcttcttttaaggaggtatccagtgtcaggttcaacgtgggtggaggtccggggggaggcgtggtcctgccgtgggactcgntgagctctctgtncngcctntgattcaccttcaactaccatgtcttgctacgtcggtcccgccacgtcctcccgaggcggaacggggaccaggtacggtcggactggtacgtaggtttactttacaattacgtaggtaagtacgggtaacttaagtacctaaaattaaccgtaacggaccgtaaacggtaaccccgttaccgggtaagggtaaccgggtacccgttaacttaaccccgaccgtaacttacccgttaacccggaaacggtaacctaacgttaccgaacggtaaccaccggtccgttacgttaccgttaccaaacttaaacggtcggtaaaccgtacgtacccgtaacggaaacctaaccggtacggaaaccggtacccgtaccgggtaccgtttacggttacgttttaatttacggttacggtcggttaacggtaagggaaccgtttaaccgtttaacgggttaccgggtttaagttcgggttacgtaaccggtttacgggaacgggtacgggttaactccggg

SEQ ID NO: 1346 - DNA, 1010 bp, Homo sapiens
  misc_feature: GYAE6OF02HHZ1X.18.16.B05.1.454.CMB.1.raw
tcagtacgagtatgcacgaccggtgctcgatttagagctcacgtaagggctgggagaggagcccagcactggaagtcgccggtgtttccattcggtgatcagcactgaacacagagactcaccatggagtttgggctgacctgggttttcctcgttgcttcttttaagaggtatccagtgtcaggttcaactggtggagtccggggagcgtggtcctgccgtgggacgtgcgtggacgtacttcgtccttaggtcgacctacggcccttcgtgggtacttcctaaccctttacaaacgttacccttagttcgttccgttttacgccgtaacggttcggggtaccccgtaccgtaaggtaccccttaccggaacggggtaacccggttaaacggggggccctaagggtaccggtccgggttaccgttacggttacgttaacggtttttaaccgttttccgaagtttaacgttacggtaacgtttaaacgggtaaaacctttaaacgtaacccttaaagtttaaaccccgttacggaccgtaacgttaaacccggttcccgggttaaagggaaaccggggttcccgttttaaaccgttacccgtaaacccgtttaaccgggttccgtttaaaccccgggaaaggggttaaaccctttaaacccggtttaacccgggtaaaaccggggtaacccgttaaccggttacccgtttaacggttaacccctttaaccgttaaaccggtttaaaacgccgggtaaacctaaaccgggttccggttaaaccggtaaaccgtaaaccggttacgggtaaaccgtaacccgggtaacgggttacccggtttaaccgttaacgttttaacgttttacgggtttacggttaccgggtaccggttaaacgggttaaccgtttaaccggtttaaaccggggttttaccgggttaaccgttttacgggttaacggttaacgggtttaaccgggaaggggtttaacccgtaacggttttacccgggg

SEQ ID NO: 1347 - DNA, 837 bp, Homo sapiens
  misc_feature: GYAE6OF02JP77Q.18.16.B05.1.454.CMB.1.raw
  modified_base (158)..(158): a, c, t, g, unknown or other
  misc_feature (158)..(158): n is a, c, g, or t
  modified_base (171)..(171): a, c, t, g, unknown or other
  misc_feature (171)..(171): n is a, c, g, or t
tcagtacgagtatgcacgaccggtgctcgatttagagctcacgtaaggggctgggagaggagcccagcactggaagtcgccggtgtttccattcggtgatcagcactgaacacagagactcaccatggtgttggctgtaccgttgggttttcctgttncttctttaaaggngtatcctagtcgtctaggttacaacgtggtggacgggtccgggggagtcggtcggtcctggccggtagggtcgtcgacgtggaagtcctccgtcgtgagtccacggtcctcgtcgtacttactaccttactaacttaccgtagtcgtccgttttgcgtaacggttccgggtacccgtaccgtacgtacccgtaccgtacgggacggtaacgggtccgtaaggtacggtcggtcgtacggttacgtaacggtttattaccgtagttaacgtcgtaagtacggtaaacctaattaactaacgttactacgactaacgaccttaccggaggtaacggtccgtaacttacgaacctacgtaccgtacgaacggtaacgtaacgtacgtaaacgggtaacctaaccggtacgttcttaccgtaaacgttaaacgtaaaccggtacgtaccggtacggtaccgtaaacggtaacgtaaacccggtaaggtacccgggtaaaccgaacggttaccgttaagttaaaccgttacgttttacgggttaccgttaggtaacccgggtaaggtaaacggtttaccggtaaccgggttttaacgggttaaccggttacggttaaaccgggtttagggtaacccgtttaaacggggaccggtttaaccgttaaccgggg

SEQ ID NO: 1348 - DNA, 752 bp, Homo sapiens
  misc_feature: GYAE6OF02H6QZD.18.16.B05.1.454.CMB.1.raw
  modified_base (158)..(158): a, c, t, g, unknown or other
  misc_feature (158)..(158): n is a, c, g, or t
  modified_base (316)..(316): a, c, t, g, unknown or other
  misc_feature (316)..(316): n is a, c, g, or t
  modified_base (459)..(459): a, c, t, g, unknown or other
  misc_feature (459)..(459): n is a, c, g, or t
  modified_base (474)..(474): a, c, t, g, unknown or other
  misc_feature (474)..(474): n is a, c, g, or t
tcagtacgagtatgcacgaccggtgctcgatttagagctcacgtaaggggctgggagaggagcccagcactggaagtcgccggtgtttccattcggtgatcagcactgaaacacagaggactcaccatgggagtttgggctgaccttgggtttttccncgttgcttcttttaaaggaggtatccagtgtctaggttcaacgtgggtggaggtccgggggagtcggttgggtcctggaccgttggggaccgttcggcttggacgtaccttcgtccgtgtcgcgtacgtcctcgtaggtaactttcctaacccgtttnaaaaccttacctaagttcgtcctttcggaccgttaacggtccggggttacccaccgaacggtccctaccggaggtaccgaaacggggccaaggtcggtcggctgtaccgtagtttacttcgattagtagactacgaaacttanactaactactagacngtacctcggtaggacggcgtactaccacgactccgtacgaacggtaactaacgtacgaacggaacgacgtcgttacgtaccgttaactaacgtaaacgttacgacgtaccgtacgtaacgaaagtaccgtaacggaaccgaacggtaccgtaccgttacgtacgtttaagttactttacgggacggtaaccggtaggtaaccggttacgtaaccgggtttacgttaaccggttggtaaccggttaggttaaccgggtaagttaaccgtagttaccggg

SEQ ID NO: 1349 - DNA, 754 bp, Homo sapiens
  misc_feature: GYAE6OF02I3C2I.18.16.B05.1.454.CMB.1.raw
  modified_base (139)..(139): a, c, t, g, unknown or other
  misc_feature (139)..(139): n is a, c, g, or t
  modified_base (153)..(153): a, c, t, g, unknown or other
  misc_feature (153)..(153): n is a, c, g, or t
  modified_base (169)..(169): a, c, t, g, unknown or other
  misc_feature (169)..(169): n is a, c, g, or t
  modified_base (265)..(265): a, c, t, g, unknown or other
  misc_feature (265)..(265): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcacatggagtttgggctnaccgtggttttccncgttgctcttttaagngtatccagtgtcaggttcaacgtggtggaggtccgggggagtggtggtcctgccgtgggaccgttcgctagacgactcgtcctcgtgccagccctntaggtacttcctaccttacaaacgttaacctatcgtctttacgccaacgttgggtcccgacctaagaccctccgaaaggaccggaaaggggccttaaggacggtcggtacacgggttactaagttttacttacaacggtttaatccgggtaataccggtaaaatttaaaccgtacttaaaaaggttacctaccggaacgtaacgtacccgtttaaccggtaaggaaaccgggccctttaaattaaccaaccgtaacgttccgaccgtaaacgggaaacttaaccgtaccgaaacggtaaccaccgacgttacgtactaccgtaaactaaacgtacgaagacgtaccgaacgaacgacgtacgaaccgtacgaaccggttcgttaccgttacttaattacgttaggcgttaaacggagtaaacggtaacccgttaaggttacggttaacttggttaaccgttagtaccgggaaggttacggaacttacgg

SEQ ID NO: 1350 - DNA, 630 bp, Homo sapiens
  misc_feature: GYAE6OF02IHKXW.18.16.B05.1.454.CMB.1.raw
  modified_base (250)..(250): a, c, t, g, unknown or other
  misc_feature (250)..(250): n is a, c, g, or t
  modified_base (262)..(262): a, c, t, g, unknown or other
  misc_feature (262)..(262): n is a, c, g, or t
  modified_base (432)..(432): a, c, t, g, unknown or other
  misc_feature (432)..(432): n is a, c, g, or t
  modified_base (509)..(509): a, c, t, g, unknown or other
  misc_feature (509)..(509): n is a, c, g, or t
  modified_base (525)..(525): a, c, t, g, unknown or other
  misc_feature (525)..(525): n is a, c, g, or t
  modified_base (538)..(538): a, c, t, g, unknown or other
  misc_feature (538)..(538): n is a, c, g, or t
  modified_base (549)..(549): a, c, t, g, unknown or other
  misc_feature (549)..(549): n is a, c, g, or t
tcagtacgagtatgcacgaccggtgctcgatttagagctcacgtaaaggggctgggagaggagcccagcactgggaagtcgccggtgtttccattcggtgatcagcactgaacacagaggactcaccatggagtttgggctgaccttgggttttcctgttgcttcttttaaagaggtatccagtgtccaggttcaacgtgggtggacggtccgggggaggcggtggtccgtgccgtgggcgtcgcgtganaccttcctctgngcgagtcctctggtacttcctaccttcaaacttcctagtcgtctttgaccgtacgttccgggtcccacgtacgcccgtaccgaacgggtacggaacgggggcctaggacggtggggccttggttactagtttttacttacgagtagtagaagttacggtaaataacgtanaactaacctacgactacgacgttaccgggaggacggactacttaccactgtccgacgaggaactcgtacacggaccngctgtctactactaancgacagctgaacncgtagcgaacngctagtattatgtcgtagacgtaggtactacgttaggtaggttaccgtgtaccgtaggttacggtaaggtaccgtagtacg

SEQ ID NO: 1351 - DNA, 646 bp, Homo sapiens
  misc_feature: GYAE6OF02I3CT5.18.16.B05.1.454.CMB.1.raw
  modified_base (372)..(372): a, c, t, g, unknown or other
  misc_feature (372)..(372): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctgttgcttcttttaagaggtatccagtgtcagttcaactggtggacggtccggggaggcggtggtcctgccgtgggacgttgctgagacctctccgtgtcgcagcctcgtcggtattcctaccgttacaactacctattcgtctttcgccacggtcgggtccgacctacgacgtccgaggcgacggggccaggagtgacttgtactagttattatatanagtataggaaactaactacgtaaagtactacacgaactactccggtaaggtaccggactaacgttaccaccgtactacctacccggaaggtaactaactaccgagaaacctcgcgttacgtctacttaacgaagtacgacacgtacgtacggactaacgtacgacgaccgaccgtacctattaccttagtttacgtggtacgaacggtgtaacgtacgtacgtttacggttacgtaggtttacggtaggtttaaggaaaggttactccgtacgg

SEQ ID NO: 1352 - DNA, 845 bp, Homo sapiens
  misc_feature: GYAE6OF02HJ6QU.18.16.B05.1.454.CMB.1.raw
  modified_base (258)..(258): a, c, t, g, unknown or other
  misc_feature (258)..(258): n is a, c, g, or t
tcagtacgagtatgcacgaccggtgctcgatttagagctcacgtaaggggctggggagaggagcccagcactggaagtcgccggtgtttccattcggtgatcagcactgaacacagaggactcaccatggagtttgggctgaccttgggttttcctcgttgcttcttttaagaggtatccagtcgtcaggttcaacgtggtggacggtcgggggagcgtgggtcctgccgtgggacgtcgctgacgctctcctgtgcncgtcctgtaggacttcacctttacaactaccctagtgtcctttgctacgttcgggcccaccacgtacctccgaggaccggaacgggggccaaggacggtcgggcttcgggtactaggttttacttacaagttacgtagtaacgttacgggaaaacttaacgtactaaaagttaacccgttacgaccgtaacggtaaccttacccggggttaagggaaaccggggtacccgttaacgtttacccgtaaacccgttaaccgttaccccgttaaaccggaaacggggttaaacccgttaaaaccggttaacccggaaaaccgggaaaccgtaacccggtaccgttaccggttaacccttaacccgtaaaaccgttaaaaggttaccggtaaccgtaacggttacccgttaacggggtaaaccgttaaacggaccggtaaaccggaacccggtaaccgggttaccgttacgttaacgttaacgtttacgtttacgtacggtaccgggtaaagtccggttaaacgtttaccgggttaacgggttaacttggtacggttaacttacgggtaagggtaacgttaacgtaccggg

SEQ ID NO: 1353 - DNA, 861 bp, Homo sapiens
  misc_feature: GYAE6OF02G1JM6.18.16.B05.1.454.CMB.1.raw
tcagtacgagtatgcacgaccggtgctcgatttagagctcacgtaagggctgggagaggagcccagcactggaagtcgccggtgtttccagttcggtgatcagcactgaacacagaggactcaccatggacgtttgggctgaccttgggttttcctcgttgcttcttttaaggacggttatccgagtgtctaggttcaacgtgggtggacggtccgggggaggtcggtcggtcctggcccgtggggaccgtcgcgtgacgtacttccgtccgtgtcgacctacgtccgtcgttggtacttccgtaccttcgaacgttaaacctactaactagtcggtccgtaggaccttccccggccgaacggtccgtaccggagggggtaacggggcttaggggtacgttaccgtcctacacgtaacctagtaccgaacggtaaaccaacgttaacgggtaaaacctaccctaaagttaaccgttaaccgtaaccggacgtaacggtaccttacgggtacgggttagggggaaccgggggttacccctaacgtttacccgtaaacccgtaacgttaccccgggaacccggaaaccggggtaaaccccgtaaaccccggtaaccggtaaacggaaccggtacccttaacccgactttaaacctttacgtccgttacggaccgtagtaccgtaccggaccgttcggaacccgttaggaacggtaccggtaccggtaaccgggtaccggttcccggttaacccgtttaacgtaccgttggtacgacccggtaggtaaaccgtcccggttacccgggacgttaacgtcggttaaccggaccgggtcccgtaacgggttccgttaagtttacccg

SEQ ID NO: 1354 - DNA, 719 bp, Homo sapiens
  misc_feature: GYAE6OF02GEQLC.18.16.B05.1.454.CMB.1.raw
  modified_base (114)..(114): a, c, t, g, unknown or other
  misc_feature (114)..(114): n is a, c, g, or t
  modified_base (289)..(289): a, c, t, g, unknown or other
  misc_feature (289)..(289): n is a, c, g, or t
  modified_base (513)..(513): a, c, t, g, unknown or other
  misc_feature (513)..(513): n is a, c, g, or t
  modified_base (625)..(625): a, c, t, g, unknown or other
  misc_feature (625)..(625): n is a, c, g, or t
tcagtacgagtatgcacgaccggtgctcgatttagagctcacgtaaggggctgggagaggagcccagcactggaagtcgccggtgtttccatttcggtgatcagcactgaacanagaggactcaccatgggtagtttgggctcgtaccgttcgggttttcctcgttgtcttacttttaagaggttaatcgagttgtcaggttacaacgtggtcggtaggtccggggggagtcgggtcggtccgtaggtccgttcggggacgtcgcgtagacgtacttcgtccgttgtcnccgtacggcccttaggtcgtaacttcctaaccttaactaaacgttacctacgttacgtctttacgccgtacgttccggtccgacgacgtactcgaacggacggtacgggacctaggtacgtcgggtactagttactaggttttacttagtaattacggtgtaacgtagttaaactaataacttaagtactacgactaacgtcgtcgtaagaacggtcgtactanacctatcccgtaacgacgtaaccgtaacttacgaaacgacctacgtcttacgtccgttactaaacgaacgttacggactacgaacgtaggaactaccggaagaccggtaacncggtacttggtacttaagttcgtagtacggagtaacgattaacgtacgttacggttaagtagtacggtacggtacggtaaggacgtagttccgg

SEQ ID NO: 1355 - DNA, 709 bp, Homo sapiens
  misc_feature: GYAE6OF02INY01.18.16.B05.1.454.CMB.1.raw
  modified_base (303)..(303): a, c, t, g, unknown or other
  misc_feature (303)..(303): n is a, c, g, or t
  modified_base (314)..(314): a, c, t, g, unknown or other
  misc_feature (314)..(314): n is a, c, g, or t
  modified_base (335)..(335): a, c, t, g, unknown or other
  misc_feature (335)..(335): n is a, c, g, or t
  modified_base (396)..(396): a, c, t, g, unknown or other
  misc_feature (396)..(396): n is a, c, g, or t
tcagtacgagtatgcacgaccggtgctcgatttagagctcacgtaaggggctgggagaggagcccagcactggaagtccgccggtgtttccattcggtgatcagcactgaacacagaggactcaccatggagtttgggctgaccgttgggttttcctcgttgcttcttttaaggaggtactccgtagtgtcgtaggttctaacgtgggtggtacggtcggggggacgtcggtcggtcctggccgtgggtccgtcgcgtgagtccttctccgtgtcgcacgtcctgtggtactcgtacccttanaaccttacctntcgtcttgcctcgtcggtccncctagcctccgaggtacgaacggacaggtaggtcgtcgtgtcttagtttacttacagttangtacgttaaggaacttaatactaacgtacaaccggtactacgtacccgtacggtacgggacggtacctacgtttaccacctacgttaccgtaccgaacggtaacctaacgtaccgaacggtaacctacgtcgttaccgtccttaaacgtaactaaacgttcggaacgaccgttactaggaacgtaaccgtacggaaccacggtaccgtagttacggttactttaaggtttccgtaggtacgtagggactaacggtccgtttacggtttaggtcgttacgtacgtaccggtacgggtaggacgttatacccggg

SEQ ID NO: 1356 - DNA, 723 bp, Homo sapiens
  misc_feature: GYAE6OF02F8P7X.18.16.B05.1.454.CMB.1.raw
  modified_base (257)..(257): a, c, t, g, unknown or other
  misc_feature (257)..(257): n is a, c, g, or t
  modified_base (314)..(314): a, c, t, g, unknown or other
  misc_feature (314)..(314): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgacctgggttttcctcgttgcttcttttaagaggtatccgagtcgtcaggttcaacgtggtggacggtccgggggagcgtggtcctggccgtgggacgtcgctgagactctccgtgtncacgcctctggtacttccaccttacaatcctatcgtctttgcctacgtcgggtaccncacgtacctcggaggtcgaacggggccaggtagtcggcttggtcctaaggtttactttacacgttataggagttacggtaaacttaacgtaaccgtaaattaaccgtaacggactaacgtaaccgttaccggttaacgggaaacgggtaccgttaacttacccgtaaacccgtacgtttacccgtaacccgggtaaacgggtaacccttaaaccgttacccgaaacgggaaaccctaccggtccgttacgtaccttaccgtaaacgtaacgttcggaactaccggacctaggaaccgtaacgacgacgacgaccgtactacgttactagttacgtcgtacgaggtaacgtagtaaccgttacggttacggttaacttcggtactacgtacggtaggtacggtataccgg

SEQ ID NO: 1357 - DNA, 716 bp, Homo sapiens
  misc_feature: GYAE6OF02HGN78.18.16.B05.1.454.CMB.1.raw
  modified_base (255)..(255): a, c, t, g, unknown or other
  misc_feature (255)..(255): n is a, c, g, or t
  modified_base (373)..(373): a, c, t, g, unknown or other
  misc_feature (373)..(373): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccttgggttttcctcgttgctcttttaagaggtatccagtgtcaggttcaacgtgggtggaggtccgggggaggcgtggtcctgccgtgggacgtcgcgtagagctctcctgtncagtcctctggacttcctaccttcaaactacctatcgtctttagctaccgtcgggtcccgcctagaccctccgaggacgaacggggccaaggaggtcggctggtctagtttattcatntagagtagaaactaatacaaattacgacgacaacgtaccgttcggagggacggtaccgtacttccaaccgtattacccgtaccgaacgggtaacctaacgttccgaaacggaacctaccgtcttcgtacgttactaaaccgtaagttcggaacctacgtccgtaacgggaacgtaaccggtacgaaccgaaccgtacccggtacgtttacggttctttaacgtttacgttagggttacggtacggtaacggtaccgttaaccggttaccggtttacggggttttacttacgggttacgttaacggtttacccgggtaaaggggttacgtaaacggttcccggg

SEQ ID NO: 1358 - DNA, 789 bp, Homo sapiens
  misc_feature: GYAE6OF02JTR3F.18.16.B05.1.454.CMB.1.raw
  modified_base (164)..(164): a, c, t, g, unknown or other
  misc_feature (164)..(164): n is a, c, g, or t
  modified_base (187)..(187): a, c, t, g, unknown or other
  misc_feature (187)..(187): n is a, c, g, or t
  modified_base (531)..(531): a, c, t, g, unknown or other
  misc_feature (531)..(531): n is a, c, g, or t
tcagtacgagtatgcacgaccggtgctcgatttagagctcacgtaagggctgggagaggacgcccagctactggaagtcgccggtgtttccattcggtgatcgagcacgtagaacacagtaggactcaccagtggacgtttgggctagaccgttgggttttccncgttgccttcgtttaagaggttntccgagtcgtacgtacggttacaacgtgggtgggacggttccgggggagtcggttcggtccgtcggcccggttagggtaccgtcgcgttacgacggtaccttcgtccttggccacggcgtcctcgtcggtacttccgtaccttataacgtcctatcgttacgttcgacgttcggtccgggtacccactacgcccgtcgacggtacggaacgggcctagggtcgttaggcctttagtaccgttagttacttacgatacgtgtaacggtcggtaaaactacgtcgaatttacgactgtacgaccgttgacgggacctcgcttactacatccgacgtcggaactacncgaacgtatactgtcctcgttaacacgtaccacgacgtacgaccgttaagaacggtaccgtacgaaccgtacggttacggtacgtttacgttaacgtttaacggtttaccgttacgggtaccggtacggttaaaccgggttaacggttaacggtttacccgggttttaaggggttttaccggttaacggtttaccggtttaaaccgggtttaaccgggttaaccgggtttaaccgggtaacccgggttttaaaccggg

SEQ ID NO: 1359 - DNA, 765 bp, Homo sapiens
  misc_feature: GYAE6OF02GSSZA.18.16.B05.1.454.CMB.1.raw
tcagtacgagtatgcacgaccggtgctcgatttagagctcacgtaagggggctgggagaggagcccagcactggaagtcgccggtgtttccattcggtgatcagcactgaacacagaggactcaccatggagtttgggctagtaccgttgggtttttcctcgttgtctttacgttttaaggaggttactccgtaggttcgtcgtaggttcctaacgtggggtagggacgggtccgggggaggtcggtcggtccgtcggccgtgggaccggtcgacgttagacgtacttccgtcgttgtcgcgtacgtcccttcgtaggtacttaccgtaacccttactaaacttaccttattcgttacgtttcgccgttacgtccggggtccctaccggaacgtacccgtaccggaacgggtaccgggaaccggggaccgaacgggtacggttcggtacgtttcggttacgttaacgtttttacgtttactaagttacgtaggtaagttaaggtaaaaccttaagtaacgtaacgtactaacgactacgtaccgtccggtacggtaacggtccctactaccgacctacgtccgtaccgggaagaaccttaacgtccggaagaccgtacggtcttacgttacactaaagactacgggtacacggtacgtagaaccggtacacggtcaacgtcgaacttgtaactttgttacgtgacgcggtaagtactacgttaggtcgtttaacgtggttacgtagtcggtaaggtacctagtcg

SEQ ID NO: 1360 - DNA, 798 bp, Homo sapiens
  misc_feature: GYAE6OF02JSEFO.18.16.B05.1.454.CMB.1.raw
  modified_base (62)..(62): a, c, t, g, unknown or other
  misc_feature (62)..(62): n is a, c, g, or t
  modified_base (143)..(143): a, c, t, g, unknown or other
  misc_feature (143)..(143): n is a, c, g, or t
  modified_base (166)..(166): a, c, t, g, unknown or other
  misc_feature (166)..(166): n is a, c, g, or t
  modified_base (289)..(289): a, c, t, g, unknown or other
  misc_feature (289)..(289): n is a, c, g, or t
tcagtacgagtatgcacgaccggtgctcgatttagagctcacgtaaggggcgtgggagaggngcccagcactggaagtcgccggtgtttcattcggtgatccagcactgaacacagaggactcaccatggagtttgggcgttnaccgttgggttttccctcggttntacttactttaagtaggtatccagtgtcaggtcacgttgggtggtaggtcgggggtcgacggttcggtccgtcggccgtgggtaccgtcgtccgtagggacaccttcgtcccgtcgtcgaacncggtccctgtcggtaacttccaccttagaacttccagttcgtcttagacctgtacccgggtcgccctaaggtcctacggacgaccggaaggtccgagggtctacggtccgttgcgttaacggttttactctaattacgggacttaaccgtagggtaaactagtaacctacttacccggataacgtacggtacgtccggacgggtacgggtaccctacgttaacccgtaaccgtcgtaacccggtaaccgggtaacgggtaaacctaaccggttaaaccgaaccgggttaaccgggaaccttaccggtaccgttaccgtaaacgtaacccgtaaggtaacggtaccgtaaccggtaagtacccggtacgttaccggaacgtaaacccggaccggttaacgttacgactttaaccgtagttcctacgggtcctaacgggtaacggtacgttacggttacgttacgggttacgttacgtaaggtaacgttggtaaccgggtagtagtacggg

SEQ ID NO: 1361 - DNA, 762 bp, Homo sapiens
  misc_feature: GYAE6OF02FKJ5S.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccagtggtagtttgggctgaccgttggttttcctcgttgcttcttttaagaggtatccagtgtcgtaggttcaacgtgggtggaggtccgggggagtcgtcggtccgtggccggtagggtactcgctgacgtccttctcgtagtcgctacgcctcgtacgtctttaccactttacaacgttacccttgttcgttaccgtttgaccgttaacggttccgggtacgcctaacgtacccgttcgaacgggaccgtacggggacctaagggtacggtcggtacgttagtaccgttttaaggtttatttaaccgaagttagtacgtaaggtacggtaaacttaagtacctaaagtaccgacggtactaacgtcccggttacggtaaggtacccgggttaccaacggttacccgtaaccgttacggttaacccaaccggtaaccgggtaaccttaacggttaaccggaacctaaccggtacgttcgtacgttacctaacgtaacgtacgtacgtacacgtacgtacgaaccgtacgacgacgacgtacgttactacgttattacgttagttcgagtacgtaagaccgttacgttaccggtacgttaagttcgttaacggttagacggtaggtaacgcggttaccg

SEQ ID NO: 1362 - DNA, 790 bp, Homo sapiens
  misc_feature: GYAE6OF02I280L.18.16.B05.1.454.CMB.1.raw
  modified_base (273)..(273): a, c, t, g, unknown or other
  misc_feature (273)..(273): n is a, c, g, or t
tcagtacgagtatgcacgaccggtgctcgatttagagctcacgtaaggggctgggagaggagcccagcactggaagtcgccggtgtttccattcggtgatcagcactgaacacagaggactcaccatgggtagtttgggctagacccgttgggttttccctcgttgcttcttttaagaggtatccagtgtcaggttacacgtggtggaggtccgggggacggtcggtggtccgtggccgtgggacgtcgctgacgtactctccgtgtacgcgngccttcgtggtacttcgtacccttactaaactacctagtgttcttcgcgtacgtccgggtcccaccgacgacctccgaagggaccggaacggggacctagggacggtggtccgtggtaccgttagtttacttactatagtggtaaacgttacgggtaaacttaacgtaacctaaagttaacctacgtaacgtacgtaccgtaccggaaggggtaaccggtacgtacctacctaccgtacgtcccgtaccggaacgtactaacgtacccaaaggaacctacggtcttaccggtactaccgtaaataaacggtcgaaacgtccgtaacgtacggtaaaccgtaccgaaaccggtccggtaaaccgtccggtacgtttaccgttaagtttaacggtttaagttccggggtaccggacgttaaacgggaccgtttaaaccggtttacgggtttacggttaacggtttacggtaccggttaaggtaccggggtaaacgggtacggtttaacgttacccgggg

SEQ ID NO: 1363 - DNA, 701 bp, Homo sapiens
  misc_feature: GYAE6OF02HMQEI.18.16.B05.1.454.CMB.1.raw
  modified_base (97)..(97): a, c, t, g, unknown or other
  misc_feature (97)..(97): n is a, c, g, or t
  modified_base (104)..(104): a, c, t, g, unknown or other
  misc_feature (104)..(104): n is a, c, g, or t
  modified_base (266)..(266): a, c, t, g, unknown or other
  misc_feature (266)..(266): n is a, c, g, or t
  modified_base (294)..(294): a, c, t, g, unknown or other
  misc_feature (294)..(294): n is a, c, g, or t
tcagtacgagtatgcacgaccggtgctcgatttagagctcacgtaaggggctgggagaggagcccagcactggaagtcgccggtgtttccattcggngttttancagcactgaacacagaggactcaccatgggagtttgggctgaccttcgggttttcctcgttgtcttcgttttaagaggtatccagtcgtctaggttcaacgtggtggaggtccggggagcgtcggtcctggccgtgggacgtcgctgagtcctactctgtcncgagtcctgtcggtacttccaccgttanaactcctagtcgtcttcgctaccggtgggtcccaccgtagccctaccgaggacgggaaccgggactaggaggtcggtacttcggtattacgtttatttccaagttttaagtcggaacgttaacggtaaacttaacgtaacttaaactacggtaaccgacgtacgtaaccgtccggtaaggtaccgggtacctaacttccgtacctacgtaccgtaccgtaacggtacgtaacgtaccgtaacggtaaccgacgtaccgttacgtaccttaacgtaacgtaacgtagactacgactacgaacgtacgacgacgaccccgagtcgtctaacgttgttacgtcgtagtacgtaagtacgtacgttcgttacggttgtacggttacgtagttacggagtacgtacgtacgg

SEQ ID NO: 1364 - DNA, 825 bp, Homo sapiens
  misc_feature: GYAE6OF02JZQYV.18.16.B05.1.454.CMB.1.raw
  modified_base (276)..(276): a, c, t, g, unknown or other
  misc_feature (276)..(276): n is a, c, g, or t
tcagtacgagtatgcacgaccggtgctcgatttagagctcacgtaaggggctgggagaggagcccagcactggaagtcgccggtgtttccagttcggtgatcagcactgaacacagagactcaccatggagtttgggctcgaccgttgggttttccctcgttgctactttaaggaggtactcgaggtctcaggttcaccgtggtgggacggtcgggggagtcgtcggtcctggtccgtgggctcggctgagacctctcgtgtcgcagtctcgagtntaccgaccttacaacgtacctattctccttacgctaccggtcggtacccgccaacgtccgtccggacggacggaacggggtaccaggtacgtcgggtacgtcggtaccggttaacgttttacgttacgacgttagtacgtaggtacggttaaactagtaactaacgtaacctacgtactacggtaccggtacccggtaagggtaccgggtacctttaacgtccgttaaacgtcccgtaacctttaccgtaacccgggaacgtaaaccggttacttaaccccgggaacggtaaactcccggtaccttcgtaaccgtttaacttaaccgggaaaactccggaaccggaaccgttcctaaacggacgtttaaaccgaccggtaaccggtaaacccggttccggtaaagttacccgtttaacggtttaaacttcccgtttagggggaaacccggtaggttaacggttaaccttaacgggttttacggtttaccggtttacggttaagtttaacggttcccggtaaacccggggtaggtttacccggttaaagg

SEQ ID NO: 1365 - DNA, 801 bp, Homo sapiens
  misc_feature: GYAE6OF02HATL0.18.16.B05.1.454.CMB.1.raw
tcagtacgagtatgcacgaccggtgctcgatttagagctcacgtaaggggctgggagaggagcccagcactggaagtcgccggtgtttccattcggtgatcagcactgaacacagaggactcaccatggagtttgggctgaccgttgggttttcctcgttgcttcttttaagaggttactccgagtgtctaggttacaacgtggtggaggtccgggggaggcggttcggtcctggcccgtaggggaccgtcgcgtgacgactctcctggtcgcacgctcgtggtattccaccttacaattacctatcgttcgtttagccgtaccggttcgggtcccgaccgtaacgtaccctaccggagggaccggaaaccggggccgtaaggtacggttccggttacgttggttaaccgtttagtttaacttttcgtaagttacgtacgtaacggtacggttaaaacctaacgttacctaaaacgttaccgtacggacctaacgttacccgttacggtaaggtaaacccgggggttacctaacgtttacccaaccgtaccgttcccgaaccggtaacgggtaaacctaacgtacccggaaacggtaaccgtaccgttcgttaccgttaaccgttactaaactaaggtacgaaccgtacgtaccgtaacgaacggtaccgtacggaccgtacgacgttacgtcgttaacttacgttagttacggtacgtacggtaaggtacgtaacgtttacggttacgggtttactacgggttgttaacgttacggggaacggttacgtacgttaccggg

SEQ ID NO: 1366 - DNA, 560 bp, Homo sapiens
  misc_feature: GYAE6OF01BERPH.38.30.C08.1.454.CMB.1.raw
  modified_base (155)..(155): a, c, t, g, unknown or other
  misc_feature (155)..(155): n is a, c, g, or t
  modified_base (205)..(205): a, c, t, g, unknown or other
  misc_feature (205)..(205): n is a, c, g, or t
  modified_base (296)..(296): a, c, t, g, unknown or other
  misc_feature (296)..(296): n is a, c, g, or t
  modified_base (303)..(303): a, c, t, g, unknown or other
  misc_feature (303)..(303): n is a, c, g, or t
  modified_base (315)..(315): a, c, t, g, unknown or other
  misc_feature (315)..(315): n is a, c, g, or t
  modified_base (391)..(391): a, c, t, g, unknown or other
  misc_feature (391)..(391): n is a, c, g, or t
  modified_base (410)..(410): a, c, t, g, unknown or other
  misc_feature (410)..(410): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgngtttcagtggctatttaaaggtgtccatgtgaggtgcagttgttggagtntgggggaggcttggtacagcctggggggtccctgagactctcctgtgcagcctctggattcacctttgcagctatgccatgagctgggccnccaggcnccagggccggtntggagtgggtctcacttatcagtaatagtggttggaccacattcgacgcagactccgtgaaggccggttcaacctntcacagacactaatacaanaacactactactacagaacaagtaagaacgaccgacgacgacgacgacgacgacgacatatatagtagtagtaggaacgggacggagggtacggtacgtaccggtacgggaccggtaccgggtaccggtacggtaccgtccgtccgtccg

SEQ ID NO: 1367 - DNA, 548 bp, Homo sapiens
  misc_feature: GYAE6OF01CSL1L.38.30.C08.1.454.CMB.1.raw
  modified_base (187)..(187): a, c, t, g, unknown or other
  misc_feature (187)..(187): n is a, c, g, or t
  modified_base (395)..(395): a, c, t, g, unknown or other
  misc_feature (395)..(395): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttggggctgagcggtgtcgtttctaaggtcggctaattttaaaaggngtcactgtgaggtgcagttgttggagtctgggggaggcttggtacagcctggggggtccctgagctctcctgtgcagcctctggattcacctttagcagctatgccatgagctgggtccgccaggctccgagggcggtctggagtgggtctcacttatcagtaatgtggtggtaccactattcgacgcagactccgtgagggccgttnaccatctccagagacaattccaagaacacactatacctgacaatgaacaccctgagagccgaggacacggaccatatattacgtgtagtggaaaggggcaggggtgaccgtccgtgggcccgaacgggaaccctgggtccaccgtcgtacccg

SEQ ID NO: 1368 - DNA, 608 bp, Homo sapiens
  misc_feature: GYAE6OF01C523K.38.30.C08.1.454.CMB.1.raw
  modified_base (180)..(180): a, c, t, g, unknown or other
  misc_feature (180)..(180): n is a, c, g, or t
  modified_base (259)..(259): a, c, t, g, unknown or other
  misc_feature (259)..(259): n is a, c, g, or t
  modified_base (276)..(276): a, c, t, g, unknown or other
  misc_feature (276)..(276): n is a, c, g, or t
  modified_base (278)..(278): a, c, t, g, unknown or other
  misc_feature (278)..(278): n is a, c, g, or t
  modified_base (281)..(281): a, c, t, g, unknown or other
  misc_feature (281)..(281): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcggtgtgttcaaggtcggctatttaaaggntcatgtgagtgcagttgtggagtgtggggagcttggtacagccgtgggggtccctgaagctctcctgtgcagctctgtntctacttgcagtctatncntgngcgtcggtccgcgcgcgtcgacggacgggtcgtggtcggtggtcgtacgtacttacgtacgtaagtaagtaggtaggtacggtaaccgtacgtacgtacgtacgacgacgtaccgtacggtacggtacgggtaccggtaccgtacctactaccgtaccgacgaacgtaactaactaaccgaacgaacaactactaactactacgaactaagtaacgaacgacgacgaacgacgacggacgacgacgactactatatagtagtagtaggaagggacggaggtacgtcgacggtcggacggtacggtaccgtacgtacgtccgtcgtcg

SEQ ID NO: 1369 - DNA, 683 bp, Homo sapiens
  misc_feature: GYAE6OF01CNDE5.38.30.C08.1.454.CMB.1.raw
  modified_base (364)..(364): a, c, t, g, unknown or other
  misc_feature (364)..(364): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctatttaaaggtgtccactgtgaggtgcagttgttggagtcgtgggggagcttggtacagccgtggggggtccctgagactctcctgtgcagcctctggattcacctttagcagctatgccatgagctgggtccgccaggctccgaggaccgggtctggagtgggtctcacttatcagtaactgtggtggtaccacnttcgacgcagactcgtgaaggccgttcaccatctcagagacaattccaagaaccacaactactacctagaccaaatcgaaacgacccctaggaacgacggacccggaagggacccgaaccgggaccctaagttacgttaaaccgttttaccgtaggttacgggttaacggggaaaaacgggggggtcccggtaaacgggggggttaccgggaaaccccggtttccccggggtaccggggggaaccccggtaaccggggggttaaaccccccgttcgggggtaccccgtaaaccccgggtttccccgtttaccccccggg

SEQ ID NO: 1370 - DNA, 572 bp, Homo sapiens
  misc_feature: GYAE6OF01EEH3G.38.30.C08.1.454.CMB.1.raw
  modified_base (346)..(346): a, c, t, g, unknown or other
  misc_feature (346)..(346): n is a, c, g, or t
  modified_base (526)..(526): a, c, t, g, unknown or other
  misc_feature (526)..(526): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgcgttttctagtggctattttaaaaggtgtccactgtgaggtgcagttgttggagtctgggggaggcttgggtacagcctggggggtccctgagactctcctgtgcagcctctggattcacctttagcagctatgccatgagctgggtccgccaggctccaggggacgggtctgggagtgggtctcgacttancagtaatagtggtggtaccacatttcgacgcagtacctccgtgaagggccggttcaccgatcctccagtagacaagttccaagacacactataccctgacaaatcgaagaccctaggaacgacggacccgaggacaaccggcaagtatattactgtcgtaggaacggggcgtacggggtnaccgttccggaggggacccaggggaccctggccaccggtctacccg

SEQ ID NO: 1371 - DNA, 593 bp, Homo sapiens
  misc_feature: GYAE6OF01C76TF.38.30.C08.1.454.CMB.1.raw
  modified_base (457)..(457): a, c, t, g, unknown or other
  misc_feature (457)..(457): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggaggcttggtacagccgtggggggtccctgagactctcctgtgcagcctctggattcacctttagcagctatgccatgagctgggtcccgccgaggctccgagggaccgggtctgggagtgggtctcgacttatcaagtaagtagtggtacggtaccactattcgacgcaacgactccgaggaacgggtccgttacaccactcctccagacgacaattaccaagaacacactaatacctanacaatacgaacgacccgtagaacgacgaccggaaggaccgacggaccaatataattactgtacgtaggaacggggcgagggtcgtaccgtccggtcggggaccgacgggaacccgtggtcccgccgtccgtacccg

SEQ ID NO: 1372 - DNA, 241 bp, Homo sapiens
  misc_feature: GYAE6OF01CBQGF.38.30.C08.1.454.CMB.1.raw
  modified_base (238)..(241): a, c, t, g, unknown or other
  misc_feature (238)..(241): n is a, c, g, or t
tcagtcgatcacgtcacgaccggtgctcgatttagtctgacgtcaaagggaaaggggcacggggtgactcctggggccagggaaccctggtcaccgtctcctcagcctccaccaagggcccatcggtcttccccctggcaccctcctccaagagcacctctggggcacagcggccctgggctgcctggtcaaggactacttccacgtgatcgactgagcggctggcaaggcgcatagnnnn

SEQ ID NO: 1373 - DNA, 239 bp, Homo sapiens
  misc_feature: GYAE6OF01DL6EI.38.30.C08.1.454.CMB.1.raw
  modified_base (236)..(239): a, c, t, g, unknown or other
  misc_feature (236)..(239): n is a, c, g, or t
tcagtcgatcacgtcacgaccggtgctcgatttagtctgacgtcaaagggaaagggcacgggtgactcctgggccagggaaccctggtcaccgtctcctcagcctccaccaagggcccatcggtcttccccctggcaccctcctccaagagcacctctggggcacagcggccctgggctgcctggtcaaggactacttccacgtgatcgactgagcgggctggcaaggcgcatagnnnn

SEQ ID NO: 1374 - DNA, 593 bp, Homo sapiens
  misc_feature: GYAE6OF01DP1TF.38.30.C08.1.454.CMB.1.raw
  modified_base (466)..(466): a, c, t, g, unknown or other
  misc_feature (466)..(466): n is a, c, g, or t
  modified_base (472)..(472): a, c, t, g, unknown or other
  misc_feature (472)..(472): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcggtgtgtttcaaggtcggctaatttaaaaggtgtccatgtgaggtgcagttgttggagtctgggggaggcttggtacagccgtggggggtccctgagactctcctgtgcagcctctggattcaacctttgcagctatgccatgagctgggccgccaggctccgagggacgggtctgggagttcgggtctacacttatcagtaatcggtggtcggtaaccatattcgacgcaagctccgtagaacgggtccggttacaccattcaccagacaacaattccaaagaacactactatacctgacaagtgaacgtaccngaacgngaccgagacacggtccaatatagttaactgtagttaggaaacgggggtctacgggggtacaccgtaccggttggggacccggtaacgggaaacccgttggtaccctaccggtcccttcccg

SEQ ID NO: 1375 - DNA, 557 bp, Homo sapiens
  misc_feature: GYAE6OF01D09KY.38.30.C08.1.454.CMB.1.raw
  modified_base (155)..(155): a, c, t, g, unknown or other
  misc_feature (155)..(155): n is a, c, g, or t
  modified_base (299)..(299): a, c, t, g, unknown or other
  misc_feature (299)..(299): n is a, c, g, or t
  modified_base (302)..(302): a, c, t, g, unknown or other
  misc_feature (302)..(302): n is a, c, g, or t
  modified_base (334)..(334): a, c, t, g, unknown or other
  misc_feature (334)..(334): n is a, c, g, or t
  modified_base (451)..(451): a, c, t, g, unknown or other
  misc_feature (451)..(451): n is a, c, g, or t
  modified_base (547)..(547): a, c, t, g, unknown or other
  misc_feature (547)..(547): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgngtttctagtggctatttaaaggtgtcactgtgaggtgcagttgttggagtctgggggaggcttggtacagccgtggggggtccctgagactctcctgtgcagcctctggattcacctttagcagctatgccatgagctgggccnccnggctccgaggggcgggtctgggagtgggtctnacttatcagtaatagtggtggtaccactattcgacgcagactccgtaggaacgggccggttacaccatctaccagagacaataccaaagaacacactaataccctgacaaatcgaanaccctgaacgagccgagacacgccagtatattactgtagtaggaaagggcgtaggggtcgacgtccgtggggaccgtacgggaacccgtggttccnccgtctcccg

SEQ ID NO: 1376 - DNA, 707 bp, Homo sapiens
  misc_feature: GYAE6OF01C09QD.38.30.C08.1.454.CMB.1.raw
  modified_base (181)..(181): a, c, t, g, unknown or other
  misc_feature (181)..(181): n is a, c, g, or t
  modified_base (288)..(288): a, c, t, g, unknown or other
  misc_feature (288)..(288): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcggtgtgttcaaggtcggctatttaaaaggngtcatgtgaggtgcagttgttggagtctgggggaggcttgggtacagcctggggggtccctggagactctcctgtgcagctctgattcaccttgcagctatgcatgngcgtcggtccgcgacgcgcgacggacggtcggtggtaggtggtcgtcgtactactactagtaagtagtaggtacgtacgtactacgtacgacgacgacgtacgtaccggtacggtacgggtaccggtaccgtacctactaccgtaccgaagaacgtaacgtaaactaaccgaaacgaaaccaactaacctaactaacctacgtaactaacgtaacgaaccgtaaccgtacggaacggaacggaaccggaacggaaccgaaccgtaaccgtaacgttaacgttaacgtttaacgttacggtacggtaagggtaacggggtaacgggtacggggtaccgggtaccggttaccgggtaccggggtacccgggtaacccgggtaacccggttaccgggtacccggtacccgttcccgtacccg

SEQ ID NO: 1377 - DNA, 589 bp, Homo sapiens
  misc_feature: GYAE6OF01D8T3L.38.30.C08.1.454.CMB.1.raw
  modified_base (155)..(155): a, c, t, g, unknown or other
  misc_feature (155)..(155): n is a, c, g, or t
  modified_base (182)..(182): a, c, t, g, unknown or other
  misc_feature (182)..(182): n is a, c, g, or t
  modified_base (303)..(303): a, c, t, g, unknown or other
  misc_feature (303)..(303): n is a, c, g, or t
  modified_base (343)..(343): a, c, t, g, unknown or other
  misc_feature (343)..(343): n is a, c, g, or t
  modified_base (501)..(501): a, c, t, g, unknown or other
  misc_feature (501)..(501): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgngttttcaaggtggctattttaaaaggngtccatgtgaggtgcagttgttggagtcgtgggggaggcttggtacagcctggggggtccctgagctctcctgtgcagcctctggattcacctttagcagctatgccatgagctgggtccnccaggctccaggggacgggtctggagtgggtctcacttancagtaatagtggtggtaccacgattcgacgcagactccgtggaagggccgttacgaccagtctcccaagacgaactaattaccaaacgaacacgaactataacccgtgacaaatgaacgaccctgaagcgaccgaggacacggaccagtatagttacngtggtagaaacgggggtcacgggggtagaccctcgggtaggggaccctaacggggtaaccccgtgggtaccctaccggtccctacccg

SEQ ID NO: 1378 - DNA, 243 bp, Homo sapiens
  misc_feature: GYAE6OF01A8VFK.38.30.C08.1.454.CMB.1.raw
  modified_base (179)..(181): a, c, t, g, unknown or other
  misc_feature (179)..(181): n is a, c, g, or t
  modified_base (184)..(243): a, c, t, g, unknown or other
  misc_feature (184)..(243): n is a, c, g, or t
tcagtcgatcacgtcacgaccggtgctcgatttagtctgacgtcaaagggaaagggggtctgagagaggagccccagccctgggattttcaggtgtttttcatttggtgatcgaggactgaacagagagaactcaccatggagtttgggctggagccgggctggcaagggtcgcatagnnncannnnnnnnnnnnnnnnnnnnnnnnnnnnnnnnnnnnnnnnnnnnnnnnnnnnnnnnnnnn

SEQ ID NO: 1379 - DNA, 552 bp, Homo sapiens
  misc_feature: GYAE6OF01AYNI1.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggaggcttggtacagccgtggggggtccctgagactctcctgtgcagcctctggattcacctttagcagctatgccatgagctgggtccgccgaggctccgaggggacgggtctgggagtgggtctcgagctaaagttaagtgggtaagggtgattcacatattacgcagacgtccggtggggggcccgttcgaccatcaccagacgacaactccaggacgcacactatactactaacaatgacacagcctgacgagtcggaggacgacggccgtgtattagtgtgacgagagcgtacccgaacggcaccgtacgttggtagtcgttttgtgtttcg

SEQ ID NO: 1380 - DNA, 597 bp, Homo sapiens
  misc_feature: GYAE6OF01D6OI2.38.30.C08.1.454.CMB.1.raw
  modified_base (175)..(175): a, c, t, g, unknown or other
  misc_feature (175)..(175): n is a, c, g, or t
  modified_base (284)..(284): a, c, t, g, unknown or other
  misc_feature (284)..(284): n is a, c, g, or t
  modified_base (315)..(315): a, c, t, g, unknown or other
  misc_feature (315)..(315): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (463)..(463): a, c, t, g, unknown or other
  misc_feature (463)..(463): n is a, c, g, or t
  modified_base (541)..(541): a, c, t, g, unknown or other
  misc_feature (541)..(541): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtgtttcagtgctatttaaagntcatgtgagtgcagttgttggagtcgtggggagcttggtacagccgtgggggtccctgagactctcctgtgcagcctgtggtattctacctttagcagctatgccatgncgtggtccgcaggctccgagggcggtctggngtggtctnacttancagtataggtggtagtaccactagttcgacgtcagtacctccggtagaacgggtcccggttacaacctacttccgtaccgaagacgaaactacgtaccaaagtaacacctactactacctagacaaatgaaacncctagacgacggaccgaggtaccacggtacaagttatacttacgtggtcggtaagaaacggggtcggaacggggttanccgtacggtcgggaacccgacgggtaccccgtaggtccccgtaccgtcgtaccccg

SEQ ID NO: 1381 - DNA, 600 bp, Homo sapiens
  misc_feature: GYAE6OF01EJ739.38.30.C08.1.454.CMB.1.raw
  modified_base (178)..(178): a, c, t, g, unknown or other
  misc_feature (178)..(178): n is a, c, g, or t
  modified_base (257)..(257): a, c, t, g, unknown or other
  misc_feature (257)..(257): n is a, c, g, or t
  modified_base (296)..(296): a, c, t, g, unknown or other
  misc_feature (296)..(296): n is a, c, g, or t
  modified_base (319)..(319): a, c, t, g, unknown or other
  misc_feature (319)..(319): n is a, c, g, or t
  modified_base (332)..(333): a, c, t, g, unknown or other
  misc_feature (332)..(333): n is a, c, g, or t
  modified_base (396)..(396): a, c, t, g, unknown or other
  misc_feature (396)..(396): n is a, c, g, or t
  modified_base (516)..(516): a, c, t, g, unknown or other
  misc_feature (516)..(516): n is a, c, g, or t
  modified_base (546)..(546): a, c, t, g, unknown or other
  misc_feature (546)..(546): n is a, c, g, or t
  modified_base (579)..(579): a, c, t, g, unknown or other
  misc_feature (579)..(579): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtgtttcaggtggctatttaaaggngtcatgtgaggtgcagttgttggagtcgtggggagcgtggtacagcctgggggtccctgagactctcctgtgcagcctntggattcacctttagcagctatcgcatgagcgtgggtcncgaggctccgagggcggtctggngtggtctcactannagtatgtgtgtacactattcgacgtcgagaccgtcggtagacgggtccggttacaccattccnccgagacgactaacgtacaagtaacacctaactataccctagaactaaacgtacgaaaccgaccgtacggaagacgtaaccgggacgtaaccgaaccgggtccaaagtattacttaacgngttacgggaagtaaggggccgtacggggtntaccgtcggtccggggacgaaccggggttaccngggttccaccgttcccgtccc

SEQ ID NO: 1382 - DNA, 613 bp, Homo sapiens
  misc_feature: GYAE6OF01D5EZC.38.30.C08.1.454.CMB.1.raw
  modified_base (156)..(156): a, c, t, g, unknown or other
  misc_feature (156)..(156): n is a, c, g, or t
  modified_base (184)..(184): a, c, t, g, unknown or other
  misc_feature (184)..(184): n is a, c, g, or t
  modified_base (197)..(197): a, c, t, g, unknown or other
  misc_feature (197)..(197): n is a, c, g, or t
  modified_base (241)..(241): a, c, t, g, unknown or other
  misc_feature (241)..(241): n is a, c, g, or t
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
  modified_base (276)..(277): a, c, t, g, unknown or other
  misc_feature (276)..(277): n is a, c, g, or t
  modified_base (280)..(280): a, c, t, g, unknown or other
  misc_feature (280)..(280): n is a, c, g, or t
  modified_base (283)..(283): a, c, t, g, unknown or other
  misc_feature (283)..(283): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatgggagttttgggctgagcggngtgtttcaaggtcggctaatttaaaggntcatgtgagtgcngttgttgagtctggggagcttggacagcctgggggtccctgganctctctgtgcagcctntggaattcaccgtttancnnctntcncagtgagtcgtcggtccgcgcgcgtcggacgggtacggtcggtggtggtcggtcgtactacttactacgtagtaagtaggtcggtacgtacgtacgtacgtacgacgacgacgtacgtacggtacggtacggtccgtaccgtactactaccgtacgacgacactactaacaacgaacactactactactacgacaatacgacgacgacgacgacgacgacgacgacgactactactagttacgtagtaggtacggaacgggacggtacgggtacggtccggtccggtacgggtaccggtaccggtacggtaccgtaccgtccgtcgtccg

SEQ ID NO: 1383 - DNA, 712 bp, Homo sapiens
  misc_feature: GYAE6OF01C9TGK.38.30.C08.1.454.CMB.1.raw
  modified_base (306)..(306): a, c, t, g, unknown or other
  misc_feature (306)..(306): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtcgttttctaggtggctatttaaaaggtgtccactgtgaggtgcagttgttggagtctgggggaggcttggtacagccgtggggggtccctgagactctcctgtgcagcctctggattcacctttagcagctatgccatgagctggggtccnccgaggcctcgagggaccgggtctgggaggtcgggtctcgtacttatctagtaaatagtgggtcggtaaccaccgtatttacggaacgccgaagaccgttaccggtagggaaaccggggttcccgggtttacaacccgtacttacccgtcccgaaacgtaacggaacctaaacctttacccgaaaacgaaaccaccaaccttaataccctagacctaaagttacgaaaccgtaccctaggaacgaacggacccggaggaaccctacggacccgtaattacgttaacttacgttaggtaggttagggaaaacgggggtccggtaacgggggtacgtaccgttcccgggtcgggggaaccccgtaacggggaaccccgttgggttaccccacccggttccgtaccccg

SEQ ID NO: 1384 - DNA, 655 bp, Homo sapiens
  misc_feature: GYAE6OF01C1JF0.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttggggctgagctggtctttttctagtggcttattttaaaaggtgtccactgtgaggtgcagttgttggagtcgtgggggagcgttggtacagccgtcggggggtccctggagactctcctgtgcagcctcgtggattcacctttagcagctatgccatgagcgtgggtcccgccgaggcctccgagggacggtcgtggagtgggtctcacttatcagtaatagtggtcgtaccatacttcgacgcgacgacctccggtaggaacgggtcccgttcacctactccctcgaagacgaactaacttaccaaagaaccacaacctaactacccttagaactaaagtacgaaccgacccgtggaacgacgacccggaaggaccgaccggacccaattacttaacttacgtaggtggtaacgggaaacgggggtcggtacggggtcgtaacccgttcccgggtacggggacccgtaaaccggggaaccccttgggtaccccgaccggttcccgtaccccg

SEQ ID NO: 1385 - DNA, 683 bp, Homo sapiens
  misc_feature: GYAE6OF01CHA8D.38.30.C08.1.454.CMB.1.raw
  modified_base (512)..(512): a, c, t, g, unknown or other
  misc_feature (512)..(512): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggcttaattttaaaaggtgtccactgtgaggtgctagttgttggagtcgtgggggagtcgttggtacaggccgtcgggggtccctgagactctcctgtgcacgcctctggtacttcctacctttagcagctagtgccagtgagtcgtcgggtcccgcgtacggcctccggagggtaccgggtcgtgggaggttcgggtccttctacttatacgagttaagtggtggtacgtaccatagtcgacgcacgccgtcgtaggaacgggtcccgttacaccagtcctacaacgtacgaactaactacgaagacgtcactctacgactatcgacgactaaacgtcgtaaacncggtaccgtaacggaaggaccggtacccggaacgggtacccaacccgggttaccgtttaagtttacgttttcgggacgtaccgggtaaaggtaacggttaaagggttttcggggtacttaagggtccgggttacttaaccgggtacccttaccccgttagggtaaccccgg

SEQ ID NO: 1386 - DNA, 764 bp, Homo sapiens
  misc_feature: GYAE6OF01CFTFL.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgctagttgtggagtcgtgggggagcgttggtacagccgtgggggtccctgacgactctcctgtgcacgcctcgtggtacttctacctttagctagtctatcgacctagtcgagtcgtcgggtccacgacggcctccggacgggacggtcgtgggtaggtcgggttacctctacttacgtacgtaaggttaacgttaggtacgggttacgtaaccctaacgtacgtttaccggaaccgtacgtaacggtacccgtccgggtaaggtaacccgggtacccggttaccaacccgtactccgtaccgaacggtaacgaaacttaaaccttaaccgaaacgaacctaacgtaaccctaatacccgtaagaacctaaacgtacgaacgtacccgtaggaacggaccgaccggaaccggtaccgaccgtacctaatacgttaacgttacggtcggtaggtaacgggaacggggtccgtaacgggggtaccgtacccgggtaccggggtaccggggaacccggtaaccggggtaaccccgttaccgggtacccggtacccggtcccgttaaccccgg

SEQ ID NO: 1387 - DNA, 645 bp, Homo sapiens
  misc_feature: GYAE6OF01B1YXW.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggaggcttggtacagccgtggggggtccctgagactctcctgtgcagcctctggattcacctttagcagctatcgccatgagcgtgggtccgccgaggcctccgaggggacgggtctgggagtgggtctcacttatctaagtaagtggtggtggtaccatagttcgacgcagtacctccggtaggaacgggtcccgttaccgacctacgttcctacccaaggacaactaacttaccgaaagaaccaacactactacctagacctaaagtacgaacgaccctaggaacgacgcccggaaggtaccacggaccattactaacgttacgtaggtggtaagggaaacggggcgtaacgggggtactacccgtccgggtcggggacccgtaccggggtaacccgtcgggtacccgtacccggttcccgtaccccg

SEQ ID NO: 1388 - DNA, 877 bp, Homo sapiens
  misc_feature: GYAE6OF01ETWS3.38.30.C08.1.454.CMB.1.raw
  modified_base (305)..(305): a, c, t, g, unknown or other
  misc_feature (305)..(305): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggcttttctagtggctaattttaaaaggtgtccactgtgaggtgcagttgttggagtctgggggaggcttggtacagcctggggggtccctgagactctcctgtgcagcctcgtggattcacctttagcagctatgcatcgagctgggtccncgaggctccgaggtacggtcgtggaggtggtctcgtacttatccgagtaataggtggtacggtacccaatacgtttccgacgcaacggtacccgtcccggttaggaaaccggggtcccggtttaccgaacccgtacgttaccgttaccgaacggtaacgaaacctaaaccgtttaaccccgaaaaacgggtaaacccaaacccgtaaaccctttaaaacgttaaaccccccttaacggggtaaaccctaaaaaccggtttaaaccgggaaaaaccccgggtttaaccccccgaagggttaaaccgggaaacccgggtaccccgggaaaccggggtaaaacccggaacccgggggtaccctaaaccgttaaactttaaaccgttttaacccggtttaaggtttaccgggtaacggggtaaaaacgggggggtacccggtaaaccggggggggttaaccggaccccgggtttacccgggttacccggggggaaacccccggtaaaccggggggttaaccccccgttaccggggtttacccccggtaaacccccgggttcccgttaaccccccgg

SEQ ID NO: 1389 - DNA, 682 bp, Homo sapiens
  misc_feature: GYAE6OF01EH3GT.38.30.C08.1.454.CMB.1.raw
  modified_base (155)..(155): a, c, t, g, unknown or other
  misc_feature (155)..(155): n is a, c, g, or t
  modified_base (497)..(497): a, c, t, g, unknown or other
  misc_feature (497)..(497): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcacatggtagttggctgagtcgtgtntttctagtgctattaaagtgtcatgtgagtgcgtagtgttggaggtcgtggggaggtctggtacgaggtccgtgggggtccctagacgactctcctgtgcagtcctcgtggtacttacctacctttagctagtacctatcgctacgtggacgtccgttcgggtacccgccgaggaccgttaccggaaggggtcggtcgtggggacgtcgggttacttctacgttatcgaaggtaacgtagtggtacgtacctaagtacgtttcgacgtctacggtaccgtaccggtaggaacgggtcccgttacaacctactcctacgagactaactaactcaaacgaaacncaacttactaccgtgaactaacgtagaaaccgccgtagtaagacggacccggtaaggaacccaccggtataactattaacgttagtaggtaggtaacggggaacggtcggtaagggtttacgacccgttcgggtaccggggtaactaccgggtaaccccgtaggtacccgtcccgtctaacccgg

SEQ ID NO: 1390 - DNA, 716 bp, Homo sapiens
  misc_feature: GYAE6OF01A6GUQ.38.30.C08.1.454.CMB.1.raw
tcagtcgatcacgtcacgaccggtgctcgatttagtctgacgtcaaagggaaaggggtcgtgagagaggagcccagccctgggattttcgaggtgttttcagtttcggtgatcaggactggaacagagagaactcaccatggagtttgggctgagctggcttttcagtggcttattttaaaaggtgtccactgtgaggtgctagttgttggaggtcgtgggggagtcttggtacagtccgtgggggtccctggagactctcctgtcgcacgtcctcgtggtattcgtaccttagcagtctatcgacatcgagtcgtcgggtccgccgacggccgtaccggacggggtacgggtccgtgggtaacgggttcgggtcctcgtaacgttataccgtaagttaagtaggtcgggtacgtaaccacgtacgttacggacgtactacgtaccgtaccggtaggaaccgggtccgttacacctactccgtaccgaagaacgtaactaacttacgaaacgaacctactaactaactaccgagaaactaaagtcgtaaacctcccgtaaggaaccgacggaaccggaacggacctaaccggacctaaagttactaacttacggtgtacgggaacgggtaaacggggcggtaacggggtcgtacccgtacgggtacggggaccccgtacgggtaaccccttacgggtaccctccggtacctcccgg

SEQ ID NO: 1391 - DNA, 679 bp, Homo sapiens
  misc_feature: GYAE6OF01CG7TG.38.30.C08.1.454.CMB.1.raw
  modified_base (310)..(310): a, c, t, g, unknown or other
  misc_feature (310)..(310): n is a, c, g, or t
  modified_base (352)..(352): a, c, t, g, unknown or other
  misc_feature (352)..(352): n is a, c, g, or t
  modified_base (375)..(375): a, c, t, g, unknown or other
  misc_feature (375)..(375): n is a, c, g, or t
  modified_base (382)..(382): a, c, t, g, unknown or other
  misc_feature (382)..(382): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctaattttaaaaggtgtccactgtgaggtgcagttgtggagtcgtgggggagcttggtacagccgtgggggtccctggagactcgtcctgtgcagcctcgtggacttccacctttgcagctatcgccatgagcgtcgggtccncgaggcctccgagggaccggtcgtggagtgggtctcacgttncaagtagtagtggtcgtaccatntcgacgnacgactccgaggaacggccgttaccacctatcctaccgagaacgaactaacttaacccaaagaaccaacgtaacctaacgtaaccctagaaacctaaaattacggaaacgtaaccccgttaaggaaccggaacggaccccggaagggaacccaacccgggacttaacgtaacttaacgttaaccgtggtaaggtacgggaaaacgggggtcgaacgggggttcgacccggttccgggaccgggacccggtaaccgggtaaaccccgttcgggtacccctcccggtccttacccccgg

SEQ ID NO: 1392 - DNA, 658 bp, Homo sapiens
  misc_feature: GYAE6OF01DCBWL.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagttgggctgagcgtgtcttttctagtggctattttaaaaggtgtccactgtgagtgcagttgttggagtctgggggagcttggtacagccgtggggggtccctgagctctcctgtgcagcctctggattcacctttagcagctatgccatgagctgggtccacgaggcctccgagggacgggtctggagtgggtctacactatcgaagtaagtagttggtacggtaccacgtagttacgacgcagaccgtccggtaggaacgggtcccggttacaccgaatcctccaagacgtaacaaacttaccgaaacgaaacctacctaactaacttaacccgtagaacctaaagttacgaaacgtaccccgtagacggtaacgacccggaacggacgtacccggactaactagttaattaccgtaggtcggtaagggaacgggtcggaaggggttcgcccgttaccgggcgggggtaacccgaacgggtaaccccgtgggtaacccctcccggttccttaccccgg

SEQ ID NO: 1393 - DNA, 719 bp, Homo sapiens
  misc_feature: GYAE6OF01CEE27.38.30.C08.1.454.CMB.1.raw
  modified_base (336)..(336): a, c, t, g, unknown or other
  misc_feature (336)..(336): n is a, c, g, or t
  modified_base (396)..(396): a, c, t, g, unknown or other
  misc_feature (396)..(396): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatgggagtttgggctgagcgtggtctttttcgtaggtggcttaagttttaaaaggtgtccactgtgaggtgcgtagttgttggagtcgtgggggagtcgttggtacgaggccggtgggggtccctggagacttcctcctgtcgcacgcctcgtggtacttccacctttagcagtctagtcgccagtgagtcgttcgggtcccncgacggccgtccggaggggtaccgggtcgtagggtacggtcgggttctacgtacctttanaccgtaagttaagttaggttagggtacggttaacccacgttacgttacggacgaccgtacggtacccgttccgggtagggaaccgggtcccggttccaaccgtacgttcctaccgaaggtacgtaacctaaactaacccgaaagaacctaaccaacttaactacctacgaactaaagtacgaacgacccgtaggaccgacgaccggacgtacgaccgactaatacgttacttacgtggtaggagggtaacgggcgtaggggtcgtccgtacccgggtgggacccgtaacgggtacccgtacgtacccgtccgtccgttacccg

SEQ ID NO: 1394 - DNA, 740 bp, Homo sapiens
  misc_feature: GYAE6OF01CJ65N.38.30.C08.1.454.CMB.1.raw
  modified_base (233)..(233): a, c, t, g, unknown or other
  misc_feature (233)..(233): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagttgggctgagctggtctttttctagtggacttaattttaaaaggtgtccatgtgaggtgctagttgttggagtcgtgggggagtcgttggtacnggccgtggggggtccctggagtactctcctggtgcgagcctgtggtacttccacctttagcaagtctaactcgcctagtggacggtcgtccggggtcccgccgaggccctaccggaggggtaccgggtgtgggtacggtcgggtcctactaccttagtacgtaaggttaagtaggtacggtacggtaacccaactacgttacgacgtctaacgtaccgtacccgggtaggaaccgggtccgttaccgaacctaacttcccgtaaccgacgggaactaaacctaaacttaacccgaaagtaaaccactaaacctaactaacccgtagaactaaagacgaacgaacccgtagaacgaccggaaccggtaccggaacaccgggtactaagtacttaacgttacgtacgggtaggtaacgggaaaggggccggtaacgggggtaccgtacgtcccggggtacgggaccgtaaccgggtaaccctagggtaccctaccccggttctaccccg

SEQ ID NO: 1395 - DNA, 241 bp, Homo sapiens
  misc_feature: GYAE6OF01E321P.38.30.C08.1.454.CMB.1.raw
  modified_base (240)..(241): a, c, t, g, unknown or other
  misc_feature (240)..(241): n is a, c, g, or t
tcagtcgatcacgtcacgaccggtgctcgatttagtctgacgtcaaagggaaaggggcacggggtgactcctggggccagggaaccctggtcaccgtctcctcagcctccaccaagggcccatcggtcttccccctggcaccctcctccaagagcacctctgggggcacagcggccctgggctgcctggtcaaggactacttccacgtgatcgactgagcgggctggcaaggcgcatagnn

SEQ ID NO: 1396 - DNA, 664 bp, Homo sapiens
  misc_feature: GYAE6OF01BEZG6.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggaggcttggtacagccgtggggggtccctgagactctcctgtgcagcctctggattcacctttagcagctatgccatgagctgggtccgccgaggcctccgaggggacgggtctgggagtgggtctcacttatcagtaataggtggtcgtaccacagttcgacgcacgtactccggtaggaacgggcccgttacaccactctaccagacacaactaccaagaaccacactactacctgacaatacgaacgaccctagacgacgacccggaacggaaccgaccgggacctaagtaacttaacttaccgttaggttacggtaaggggaaaacggggggtccggaaccggggggttacggtacccggttacccgggtacggggggacccccgtaaacggggggtaacccccgttacggggttacccgtaccccgggttccccgttaccccg

SEQ ID NO: 1397 - DNA, 711 bp, Homo sapiens
  misc_feature: GYAE6OF01BBUTA.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgcgttttctaaggtcggctaattttaaaaggtgtccactgtgaggtgcagttgttggagtctgggggaggcttggtacagccgtggggggtccctgagactctcctgtgcagcctctggacttcacctttagcagctatgccatgagcgtgggtcccgaccgtaggcctcccgaggggtaccggtcgtagggaggtcgggtctacgacttatcaagtataggtggtcggtacccactagtttaccgacgtacgacgaccttccggtaggtaacggggtcccgttaccaccgtaactcctacccagacgaaccacttaaccaacgaacctaacgaactaactaacccgtagaccgaaatcgaaacgtaccccgttagaaccggaacggaccccggaacggaaccgtaccggaaccctaagtaacttaacgtttaacgttaggtaggttaacgggaaaacgggggtccggtaaccggggggtacgtacccgttacccgggtcggggtaacccgtaaccgggggtaaccccgttggtaccccgtaccgtcccgttaccccg

SEQ ID NO: 1398 - DNA, 694 bp, Homo sapiens
  misc_feature: GYAE6OF01EJV0O.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggaggcttggtacagccgtggggggtccctgagactctcctgtgcagcctctggattcacctttagcagctatgccatgagctcgggtccgccgagggcctccggaggggaccgggtcgtgggaggttgggtcctctacttatctaaggtaataggtgggtcggtaacccacgtatttccggaacgcaacgtaccgtccgggtaggaaccggggtcccggttaccacctactcctacccgaagacgaacctaaacttaccaaacgaaaccaaccaacctaactacctacgacaaacgtacgaacgacccgtagaacgacgaccggaacgggaaccgaccggaccaataacttaacgttaccgtaggttaggtaacgggaaacgggggtcggtaacgggggtcggtaccgttacccggtacgggggacccggtaacggggtaaccccgttcgggtacccgtacccggttcccgtaccccg

SEQ ID NO: 1399 - DNA, 893 bp, Homo sapiens
  misc_feature: GYAE6OF01BSVPM.38.30.C08.1.454.CMB.1.raw
  modified_base (424)..(424): a, c, t, g, unknown or other
  misc_feature (424)..(424): n is a, c, g, or t
tcagtcgatcacgtcacgaccggtgctcgattttagtctgacgtcaaagggaaagggtctagagagaggaagccccagcccgttgggtactttttccaggttggttttcgatttggtgactcgaggacgtcgaacgacgagagaactcacctatggagtttcgggcctggagcggtggtacgttttcctaaggtcggaccttaacgttttaaacggtcgttccactgtgtaggtgtcgtagttcgttggagtcgtgggggacgtcgttacggtacaggccggttcgggggttccctaggaccggaccttccgtccccggttaggtcggtaacggtcccgttcggtagggtactttaccgtacccggttttaggcctaacgtccttaagtacggcctaagtaacgcggtccgttccgggtccccnccccgtacggtccgttaccggacggggtacccgggttctacgggtaacgtttccgggttccttaaccgtaaccgtttacgtaccgtaaagttaaacgttacggttcggttacggttaaccccacgtaagttccggacgtactaacggtcccgttaccggtagggaacccgggtacccgttcccgaaccgtaccgttcccggtacgtacgtaacgtacctaacgttaccgaaacggaaccgtaaccggtaccggttaacttacccgtagaaccgtaaacgttcgaaacgtacccgtagggacggaccggtaccggacgggtaccctaaccggtccttaacgttacttaccgttacgtacggtccgggttaaacggaccggggtccgtacggggttccctaacccggttccgggtaccgggaccccgtaaccggtacccgttccggaccgtccccgttcgcccggtacccg

SEQ ID NO: 1400 - DNA, 767 bp, Homo sapiens
  misc_feature: GYAE6OF01CEOFZ.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggcttaattttaaaaggtgtccactgtgaggtgcagttgttggagtcgtgggggagcgttggtacagccgtcggggggtccctgacgtactctccgtgtgcagcctcgtggtacttctaacctttgccagctatcgccatgagtcgtcgggtccgccgaggcctccgaggggacggtcgtgggaggtcgggtcctacgtacttagtactaagttaagtacggttgggtacgtaaccctactacgtttcggaacgcgtacggtaccttccggtaggaaaccggggtcccggtttaccaacccgtacgttaccctacccgaaggtaacgtaaacctaaacgtttaacccgaaaacgtaaaccctaacgtaacccttaacttaaccccgtagaaacctaaacgtacgaaaccggtaaccccgtaggaaacggaccgacccgggaaacgggaacccgaaccgggacctaagtacgttaacgtttaggtacggttagggtaaagggaaacgggggtccggtacgggggtactacccggttcccgggtaccggggacccgtaaccggggtaaccccgtgggtaacccctcccgggttcttaccccgg

SEQ ID NO: 1401 - DNA, 833 bp, Homo sapiens
  misc_feature: GYAE6OF01BOU7K.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggctattttaaaaggtgtccactgtgaggtgcagttgtggagtcgtggggagtcttggtacagccgtgggggtccctgacgactctccgtgtcgcacgtcctcgtcggtattcctaccgttttagctagtacctatcgcctagtggacgtcgtcgggtccgaccgacggccgtccggaacggggtccgggtcgtgggtacggtggtctactaacgttactacgtaacgtaagttacggtcggttacgtaacccaacgtacgtttacggaaccgacgtaacggtaccgttacccggtaggggtaacccggggtaccccgggttaccaaccccgtacgttaccccgtacccggaagtaaccggtaaacctaaaccgttaacccgaaaacggtaaaacccctaacgtaaccttaaaccgtaaacccgttacggaaacctaaacggtacggaaaaccggtaccccgttaagggaaccgggaaccggaacccgggaaccggtaaacccgacccgggtaacctaatttaacgtttaacggttaccgtgggttaaaggtaacgggggaaaccggggtcgggtaaccggggtacgtacccggtccgggtacccgggggaacccggtaaccggggaccccgttagggtacccccgtaccggttccccgtaacccgg

SEQ ID NO: 1402 - DNA, 632 bp, Homo sapiens
  misc_feature: GYAE6OF01EL9L5.38.30.C08.1.454.CMB.1.raw
  modified_base (351)..(351): a, c, t, g, unknown or other
  misc_feature (351)..(351): n is a, c, g, or t
  modified_base (426)..(426): a, c, t, g, unknown or other
  misc_feature (426)..(426): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggctttttcagtggctattttaaaaggtgtccactgtgaggtgcagttgttggagtctgggggaggcttggtacagccgtggggggtccctgagactctcctgtgcagcctctggattcacctttagcagctatgccatgagcgtcgggtccgccaggcctccggaggggtacgggtctgggagtgggtctcacttancagtaatagtggtacggtaccacagttcgacgcagactccggtgaagggtccggttacacgtatcctaccagaanaccgaaattaccgaaagaaccaacgtataacctacctagaccgtaaatgtaaaccgacccgtagaacgacgaccggaacgggaccacgggaccctaagtaattaacgttaccgtgtaggagggaaaccggggtcgtaacgggggtctaccggtaccgtggggaccccaacggggtaacccgttccggtcgtaacccgtctacccgg

SEQ ID NO: 1403 - DNA, 656 bp, Homo sapiens
  misc_feature: GYAE6OF01DNLRS.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggcttattttaaaaggtgtccactgtgaggtgcagttgttggagtcgtgggggagcttggtacagccgtggggggtccctgagactctcctgtgcagcctctggtattcacctttagcagctatgccatgagcgtggtccgccaggctcgagggacgggtctgggagtggtctacgacttatcaagtaaattggtggtcggttaaccactagtttccgacgtcagtacctccggtagaacgggtccggtttacaccgtatccttaccgagacgaaccaattaccaaagtaaacacaacctagtacctagacaatacgaacgaccctgacgagacccggaggaccgaccggtacaactattaagttacgtaggtaggttaacgggaaacggggtaccggtaacgggggttcgtaaacccgttcccggtacgggggaacccgtaaccggggtaaaccccgttagggtaacccctcccgttaccgtacccccgg

SEQ ID NO: 1404 - DNA, 790 bp, Homo sapiens
  misc_feature: GYAE6OF01B9LYI.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggcttaattttaaaggtgtccactgtgaggtgctagttgtggagtcgtgggggagtcttggtacagccggtggggggtccctggagacctctccgtgtgcagcctcgtgattccacctttagcagtctatcgccatgagtcgtgggtcccgaccgacggcctaccggaggggtacgggtcgtggggtacgttcgggtactactacttacgtacgaaggttaagtggtacggttacgtaacccacgtacgttaccggacgacgtaagtacccgttccggaggaaaccgggtcccggttaccaacccgtaacttcccgtaccgaacggtaacgaaccgttaaacgttaacccaaaacggtaaacctaccgtaaaccttacttaaccccgtgaaacctaaagtaccgaaacgtaccccgtaggaaacgaccggtacccgggaacgggacccgaaccgggtaccctaaagttaccgtttaagttaccggttaggggtaacggtaaacgggggaaaacgggggtccggttaaccgggggtacggttaaccccggtaccggggtaaccgggggcccgtaaaccggggtaccccttccggggtaacccgtaccccgggtttctaacccccg

SEQ ID NO: 1405 - DNA, 722 bp, Homo sapiens
  misc_feature: GYAE6OF01A3BNG.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtggggggaggtcgttgggtacacggccggttggggggggttcccctggaagaccttcctcccgtggtgccaggccctcgttggacttcctaccttttagcagctatcgcctatgagcgtgggtcccgccaggcctccgaggggtcgggtcgtgggaggtggtcctctacttatcgaagttaagtacggtggtcgtaaccactagtttccggacgcacgacctccggtggaacgggtcccgttaccaacctactcctaccgagaacgaactaacttaccaaagaaccactaacccttaactaccgtagaacaaagtcgtaaaccgacccgttaaggacgtacgacccgggaacggaaccgaccggacctaattacttaacgtttacgttaggtacggtaaggggaaacgggggtccggtaacgggggtcgtacccgttccggggtacccggggtaccggtaaacccggggtaaccccgttacgggtaccccgtacccggttccgttaccccg

SEQ ID NO: 1406 - DNA, 827 bp, Homo sapiens
  misc_feature: GYAE6OF01DQQ6Y.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggcttaattttaaaaggtgtccactgtgaggtgcgtagttggttggagtcggtgggggaggtcgttggtacaggccgtcgggggtccctgacgactcctccgtgtcgcacgtcctcgtaggtactttcctaacccgttttacgacctacggtaccttaattccggaccctaagtacggtacggccggttcgggggtccccggaccgtacgggtcccgtacccgggaacggggggtaccggggttcggttaggggtcggttcggggttcctaccgttacgtttatacgtaagttaagttaggttcgggtaccggtaacctacgtacgttaccgaccgtacgaacggtacccgtccgggtacggtaaccggggtcccggtttacccaacccgtactacccttaccgaaacgaccgtaaactaaaccttacgaaaacgaaaccctaaccgtaacgttaacctaacccgtacgtaactaaacgtcgaaaccgtacccgtaggaacgaccggacggtaacggaccgaccggactaacttacgttaacgttacgtaggtacgggtaaggggaaccggggtcggtacggggtactcccggttaccggggtaccgggaacccggtaccgggaacccggttcggtaccccgtcccggttcgtacccccgg

SEQ ID NO: 1407 - DNA, 732 bp, Homo sapiens
  misc_feature: GYAE6OF01DLTPK.38.30.C08.1.454.CMB.1.raw
  modified_base (349)..(349): a, c, t, g, unknown or other
  misc_feature (349)..(349): n is a, c, g, or t
  modified_base (354)..(354): a, c, t, g, unknown or other
  misc_feature (354)..(354): n is a, c, g, or t
  modified_base (375)..(375): a, c, t, g, unknown or other
  misc_feature (375)..(375): n is a, c, g, or t
  modified_base (392)..(392): a, c, t, g, unknown or other
  misc_feature (392)..(392): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggcttattttaaaaggtgtccactgtgaggtgctagttgttggagtcgtgggggaggcttggtacaggccgtggggggtccctgagactctcctgtgcagcctctggattcacctttagcagctatgccatgagcgtgggtcccgccaggcctccgaggggacgggtctgggaggtgggtctcncttanctagtaatgtggtcgtacacnttcgacgcacgctccgnggaacgggtccggttacacctatcctccgaagacgaactaacttccgaaagtaaccaacctaacttacgtaaccctggaacctaaagtacgaaacgtaccccgtaggaaaccggacggtaaccccggaacggggaacccaaacccgggtaccctaacgttaacgtttaacgttttaacctttacgggtagggttaacggggaaaaccggggggttcccgggaaccggggggttaccggaaaccggtttcccccggggtaagggggggaaccccccgtaacggggggtaaacccccccttgggggttaacccccgtcccccggtttcccgttaccccccgg

SEQ ID NO: 1408 - DNA, 727 bp, Homo sapiens
  misc_feature: GYAE6OF01B1P3O.38.30.C08.1.454.CMB.1.raw
  modified_base (189)..(189): a, c, t, g, unknown or other
  misc_feature (189)..(189): n is a, c, g, or t
  modified_base (221)..(221): a, c, t, g, unknown or other
  misc_feature (221)..(221): n is a, c, g, or t
  modified_base (250)..(250): a, c, t, g, unknown or other
  misc_feature (250)..(250): n is a, c, g, or t
tcagtcgatcacgtcacgaccggtgctcgatttagtctgacgtcaaaagggaaaggggtcgtgagagacggagcccaggccctgggattttcaggtgttttcatttggtcgatcaaggactgaacgagagagaactcaccatgggagtttgggctgagcgtgtctttcaggtggacttaatttaaaggngtacctactgtgtaggtgctagtttggtaggnggtggtgggggaggtccgttggtaaccgngtccggtacgggggtccctggacgtactctccgtgttgccgtagcgtcgtagtacttcctaaccgttaggcagtcctatccgctagtgaccgcgtccggacgcgcggtacgccggacggggtcggtcgtaggtcggtcggttcctacgttacgtactacgtaggtaagtaccggtgttacgaaacctacgacgttcggacgtacgtaccgacggttcccggtaaggtaccccggtacggttccaacgttaccgaccgttaccgtaggtaaccaccgttaaaccgttaaccgaaactaaccgaaccttacgtaaccttaaccgtcgttaaaccgtaacgtaacgtaaccgaccgtaggacgaaccggtacggaacgtaccgacgtacgaatacttacgtacgtagaccggtaaggacgggtcgagggtcctcggtacccgcgggaaccgtaccggactacggaccctcgttcgacccg

SEQ ID NO: 1409 - DNA, 604 bp, Homo sapiens
  misc_feature: GYAE6OF01B0EY1.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtctgggggagcttggtacagccgtggggggtccctgagactctcctgtgcagcctctggattcaccttttagcagctatgccatgagctgggtccgccaggctccgaggggaccgggtctgggagtgggtctcgactttatacagttaaataggtgggttaggtacccactatttcggacgacagacgtccgtaggaacgggtcccgttacaccatcctaccagagacaattaccaagaacacactatacctgactaatgaacgaccctgacgagaccgacggacacggccatataacttacgtgttagaggtaaacggggcgtaacggggtcgaccgtccgtacggggacccgtaacggggaccccgttgggtaccgtaccccggtccgtacccg

SEQ ID NO: 1410 - DNA, 733 bp, Homo sapiens
  misc_feature: GYAE6OF01ETDIU.38.30.C08.1.454.CMB.1.raw
  modified_base (123)..(123): a, c, t, g, unknown or other
  misc_feature (123)..(123): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacaganagaactcaccatggagtttgggctgagcgtgtcgtttctaagtggctatttaaaaggtgtcactgtgaggtgctaggttgttggagtcgtgggggaggtcttgggtaccaggtccgtggggggtccctggacgtactctcctgtcgcagcctcgtggtacttcgtacctttaaggccagctatgacctagtgagtcgtcgggtccgaccgaggtccgtaccgacggggtacgggtaccgtgggtaagttcgggtccttcgtacttacgtactaaggtaactacggtcggtacggtaacccactagttaccggacgtaccgacgtacccgtacggtacggtaacgggtcccgtttaccgaacccgtctaccgtaccaacggtaacacctaacgttaccaaaagaaccaaccgtaactacctaaccacgtaactaaacgtacgaaccgtacctagacgaacggaccggtacggaaccgaaccggaccctaattactaagttacgtggtaggaacggtaaacgggggacggtaaacgggggttcaccggtttccggaccgggggaacccggtaacggggaaccctcggggtaccctcccggttccgtaccccg

SEQ ID NO: 1411 - DNA, 666 bp, Homo sapiens
  misc_feature: GYAE6OF01AV4XA.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagttttgggctgagctggctttttctagtggctattttaaaaggtgtccactgtgaggtgcagttgttggagtcgtgggggaggcttggtacagccgtggggggtccctgagactctcctgtgcagcctctggattcacctttagcagctatgccatgagcgtggggtcccgccgaggcctccgaggggaccgggttcgtgggaggttcggggtctcgtacgtttatcgtaagttaagtaggttgggttcggtaacccacgtacgtttcgaccgtcaacgtaccgtccggtaggaacggggtcccgtttaccgaccctatcccgtaccaggacgaactaacttacccaaagaaccactactaactacctagactaaagtcgaacgaccctagacgacgaccgtaggaccacggaccagttacttaacttacgtgttagtagggaaacggggtcgtaacggggtcgaccgttcccggacggggacccgtaaccggggtaaccctgggtaccctacccgttccttaccccg

SEQ ID NO: 1412 - DNA, 890 bp, Homo sapiens
  misc_feature: GYAE6OF01CD6YJ.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtcttttctagtggacttaattttaaaaggtgtccactgtgaggtgctagttgttggagttcgtggggggacggtcgttgggtacacggtccggttcgggggggtccccttggaacggtaccttccgtcccgttggttcgccgacgtcccgttccgttggtactttacctacccgtttttaaggccgtaagtccgttaattcggaccctaagtcggacggtccggttcggggtccccggcccgtaacgggtcccgtaccgggaacggggggtaccggggttcgttcggggtacggttcggggttactacccgtaacggtttaactacgtaaggttaaacgtttagggttagggtaccgttaacccgtaacgtagtttacccggaacgacgtaaccgtaccgttccggtagggtaacgggtcccggtttacctacggaacttccgtaccgaaggtaaacgtaccttaaactaccggaaaacaaaccgtaacctaaccttaacgttaccctaggtaaacctaaagtaacgaaaccgtaaccccgtgggaaacctaccggggaacccggacggtaacccggtaacccggtacctaaaggtttacttaacgttaacccggttggttagggtaacggggtaaaggggtcccggttacgggggtactaacccgggtcccgggtaggggaaccccggttaacggggaccccgttcgggttaacccgtccccgtcgttacccccg

SEQ ID NO: 1413 - DNA, 762 bp, Homo sapiens
  misc_feature: GYAE6OF01C85F8.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggtagtttgggctgagcgtggtctttttctagtggacttattttaaaggtgtccactgtgaggtgctagttgtggagtcgtggggagtcttggtacagccgtgggggtccctggagactctcctgtcgcacgtcctcgtgacttcctacctttagctagctatcgccatcggagtccggtcgggtcccgaccgacggtccgtaccggacggggacggttcgtagggtaggttcgggtctacgtacttactacgtaagtaagtcggtaggtacgtaaccagtacgttcgaccgtacgtacgtaccgtaccggtaggaccgggttacccgttacctaccgtacgtcctaaccgaacgtaacgtaaacttaaccgttaacccaaacgtaaacccgactaaccgttaactacctacgaactaaagtaaccgtaaaccgacccgtaaggacggaaccgacccggtaaacggacccaaccggtacttaattacgttaacgtttaccgtaggttacgggtaaaccgggtaaacggggtccggtaacggggttcgaccggttacccggggtaaccgggacccggtaacccgggttaacccgtccgggttaacccctccggttcccgttaccccgg

SEQ ID NO: 1414 - DNA, 694 bp, Homo sapiens
  misc_feature: GYAE6OF01ADGSJ.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctggagctggtctttttctagtggtctattttaaaggtgtccactgtgaggtgcagttgtggagtcgtgggggagtcgttggtacgagccggtggggggtccctggacgactcgtcctgtgcagcctcgtggacttctacctttagcagtctatcgccatggagtccgtcgggtccgccgaggtccgtaccggacggggaccgggtcgtcgggtaggttgggtcctacgtacttagtactaagttaagtaggtcggtacgtaccaactacgttacgacgtcacggtcctaccggaggaacgggtccgttacaccgtactaccgtaccagacgactaacttaccgaacgtaaccgaactactaactaccgtacgaactaagtacgaacgtaccctaggacgacggtacggacgaccgaccggactaagtactaagttacgtaggtacgggtagggaaacgggtcggtaacggggtcgtaccggttaccgggaccgggtaacccgggtaccgggaacccggttccggacccgttccggttccgtaccccgg

SEQ ID NO: 1415 - DNA, 816 bp, Homo sapiens
  misc_feature: GYAE6OF01BX0JE.38.30.C08.1.454.CMB.1.raw
  modified_base (743)..(743): a, c, t, g, unknown or other
  misc_feature (743)..(743): n is a, c, g, or t
tcagtcgatcacgtcacgaccggtgctcgatttagtctgacgtcaaagggaaaggggtctgagagaggagcccagccctgggattttcaggttgttttcatttggtgatcaggactgaacagagagaactcacatggagtttgggctgagcgtggtctttttctagtggtacttaagttttaaaaggtcgtcctactgtggtaggtgcgtagtttgttggacgtcggtgggggagtcgttggtacacggtccggtcggggggtccctggacgtacgttcctccgtgtcgcacgtcctgtcggtacttctaaccgtttacgcacggtacttaagtcgaccagtcgacggtcggtaccggggttccccgaccgacgggtcccgtaccggtaacggggggtaccggggtttcggtacggggtagggttccggggttaccttaccgttaacctttaagttccgtaaaggttaaaaggttacgggtttcgggtaaccgggttaacccctaacgttaacgtttaccggaacccggtactaaacgggttacccgtacccggttaagggtaaacccgggggttccccgtttaaccgaacccgttacgttacccgtaaccgaaggtaacgtaacccttaaacttacccgaaaagaacctaaacctacgttaaactaacccgtagaaacctaagacgtaaaccgaccgtagaacggacgaccggaacgaccgacggtctaatatacgtgtagngtaagggacggtcgtacgggtagccggtaccggacgggaccgtacggacccgtaggtcccaccgttcctaccg

SEQ ID NO: 1416 - DNA, 646 bp, Homo sapiens
  misc_feature: GYAE6OF01BLDXM.38.30.C08.1.454.CMB.1.raw
  modified_base (181)..(181): a, c, t, g, unknown or other
  misc_feature (181)..(181): n is a, c, g, or t
  modified_base (210)..(210): a, c, t, g, unknown or other
  misc_feature (210)..(210): n is a, c, g, or t
  modified_base (218)..(218): a, c, t, g, unknown or other
  misc_feature (218)..(218): n is a, c, g, or t
  modified_base (231)..(231): a, c, t, g, unknown or other
  misc_feature (231)..(231): n is a, c, g, or t
  modified_base (239)..(239): a, c, t, g, unknown or other
  misc_feature (239)..(239): n is a, c, g, or t
  modified_base (251)..(251): a, c, t, g, unknown or other
  misc_feature (251)..(251): n is a, c, g, or t
  modified_base (284)..(284): a, c, t, g, unknown or other
  misc_feature (284)..(284): n is a, c, g, or t
  modified_base (310)..(310): a, c, t, g, unknown or other
  misc_feature (310)..(310): n is a, c, g, or t
  modified_base (324)..(324): a, c, t, g, unknown or other
  misc_feature (324)..(324): n is a, c, g, or t
  modified_base (585)..(585): a, c, t, g, unknown or other
  misc_feature (585)..(585): n is a, c, g, or t
  modified_base (639)..(639): a, c, t, g, unknown or other
  misc_feature (639)..(639): n is a, c, g, or t
tcagtcgatcacgtcacgaccggtgctcgatttagtctgacgtcaaagggaaaggggtctgagagaggagcccagccctgggattttcaggttgttttcatttggtgatcaggactgaacagagagaactcaccatggagtttgggctgagcgtgtgtttcaggtcgctaagtttaaaggntcatgtgagtgctgtgtgcgtcgtggggngtcttgcngccgtggggtccngagcctcnctgtgcacgccntagcttccgtacttagacacgtctaagtcgccntgcgcgtccggccacgtagcctcggngggtacgtcgtggngtcgtcacgtacttaacgcaagtatcggtggtacctacgacgttagtccggacgcgtaaccgccgttaggtaccggaacgggttccttaaccgaccttaacgcctaccgaaggacctaacgaacgttaccaagtaaccactactactacgtacaaagtaacacgtaacgtaccgagccgaaccggaacgccggtaaccgtacgaactattaccggtaatcgggtagtaacgggtacggaagggttcccgtaacgggttccncggtaacggttcccggaaacggttcgggtaacccctaccgggccttaacccgtntacccgg

SEQ ID NO: 1417 - DNA, 659 bp, Homo sapiens
  misc_feature: GYAE6OF01EILEY.38.30.C08.1.454.CMB.1.raw
  modified_base (201)..(201): a, c, t, g, unknown or other
  misc_feature (201)..(201): n is a, c, g, or t
  modified_base (214)..(214): a, c, t, g, unknown or other
  misc_feature (214)..(214): n is a, c, g, or t
  modified_base (230)..(230): a, c, t, g, unknown or other
  misc_feature (230)..(230): n is a, c, g, or t
  modified_base (269)..(269): a, c, t, g, unknown or other
  misc_feature (269)..(269): n is a, c, g, or t
  modified_base (293)..(293): a, c, t, g, unknown or other
  misc_feature (293)..(293): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagttttgggctgagcgtggtcgttttcaagtcggctattttaaaaggtgtccactgtgaggtgnagttgttggagtntgggggagcttggtanagccgtgggggtccctagagactctcctgtgcagtcctntggatcgacctttagcgagctatnaccatgagtcgttggccgccaggctaccgagggtacggtcgtggacgtgggtctcgacttatacgtagtaacttaggtggtggtacccacgactttcgacgactagtaaccgtccggtaggaaacgggtccggttacaacctatacctaccaacgagtaaccaaacttaccgaaacgaaactaaccgaactaactacctagacctaaagtagaacacctagacgacgacccgtaagaacgaccgacgtaacttataacgttactagttaggacggtaaaggggtacctacgggggtacgaacgttcccgggtacggggtcccgaaacggggtaccccgtaggtacccgtccggtacccttccccgg

SEQ ID NO: 1418 - DNA, 837 bp, Homo sapiens
  misc_feature: GYAE6OF01BEL6L.38.30.C08.1.454.CMB.1.raw
  modified_base (189)..(189): a, c, t, g, unknown or other
  misc_feature (189)..(189): n is a, c, g, or t
tcagtcgatcacgtcacgaccggtgctcgatttagtctgacgtcaaaaggggaaaggggtctgagagaggagcccagccctgggtatttttcaggttgtttttcattttggtgatcaggactgaacagagagaactcacatggagtttgggctgagcggtcgtgttcaaggtggactaatttaaaggtntcatgtgaggtgctagttgtaggcgtcggtggggaagtccttgggtactacggccggttaggggggttccctaggtacgtacgttccctcgttaggtacggccgtaagttcccgtaacggtcgggttaattttacccgaacctttttaaaggcctagtaaccctttagtaccggccaagttaggtaccgtacgggtccgggtacccggtaaccgtacggacccgggttccgggaaaggggtttaccgggctttaaaccgggggacgttacggttaacctaccgtacttaaggttacgtaaaggttacggtaacggttcgtaaccgtaacccgaaagttacggtaccgaaccgttaacaacggttacggtaccgggtaaacggtaccggtccttaacgaaccttacgtaccgtaaccgtacgtaaacgtaaccgtaactaacgaacgaactaactaactaacggtaactaaccgtaagtaaacgtacgtaaacgtaccggtaagacggtaacgacggtaaacgccgtaacgtacgtaagtaacgtacgttagaggtaacgggtaagggtacgggtacggtacggtaacggtacccgtcgggaaccggtaccggtaacgggtaactaccggtacctacccggtcccaccg

SEQ ID NO: 1419 - DNA, 854 bp, Homo sapiens
  misc_feature: GYAE6OF01BZUFX.38.30.C08.1.454.CMB.1.raw
  modified_base (217)..(217): a, c, t, g, unknown or other
  misc_feature (217)..(217): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtctttcaggtcgctaagtttaaaggtgtccatgtgaggtgctagttgtggagtcgtggggagnttggtacagccgtgggggtcctggagactctcctggtcgcgacgtcctcgtggtattcctacctttagcagtcctatcgaccagtgacgtcgtcgggtccgccgacggtcctacggacgggtacgggttaccgtggggtacgttcggggtacctcttaaaccgttacgtaacggtaacgttaaaggttcgggttaacggttaaccgggttaaaccctacgttaaaccggtttccggaaaccgtccaacgggtaacccgttcccgggtaaggtaacccgggggtacccgttaccgtaacccggtacttaccccgttaacggaaccgtaacggtaaaccctaaacggttaaacccaaacggtaaacccctacgggtacctttcggttaaccttaccggtttaaatttaacgttaaacggaactaacccggttacgttaaagggaaccggttacggaaccgggtaaaccgggaacccgaaccgggaacccttaattaacgtttacgtttaacgttcggtaaaccggtaaaggtaaggaagggtttcggggttacgggtccgggttaccggttaccccgggttaccgttaaccgggttcccggtaacccgggtccccgggggtacggtaaaacccccgggg

SEQ ID NO: 1420 - DNA, 838 bp, Homo sapiens
  misc_feature: GYAE6OF01DIS7L.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcacatggtagtttgggctgagctggtctttttctagtggtcttagttttaaaaggtctaccatgtgaggtgcgtagttgttggagttcgtgggggagtcgttggtacgtacgtccggtcggggggtccctggacgtacgtcctccgttgtcgacgcgtccttacgtggtacttccgtaccgtttgcagtctagtcgctaagtgacggtcgtccgggtccgccgacggtccgtacgggacggggtacgggttcgtagggtacggttcgggtactacctacgttactaacgtagttaacggttacggttcggttaacggtaaccacgttaacgttaccggaccgacgtaacgtccggttacccgggtaagggtacccgggtaccgtttaccgaccgtaacgttcccgacgaagtaaccgtaaaccgtaacgttaaacccgtaaaacggaacccaaaccgttaaccgttaaccttaacccgttaacaaacgttaaaacgtaccggtaaacccgtaccgggtaacggaaacgaccgggaacccggaacgggaaccccgtaaccggaacttaacggttactttaacggttaccgttaagggttcgggtaaaacggaacgggggttaccggacggggttacgttaccgggtacccgggtacggggaccccggttaaccggtaccggttcggacccctacccggttccgtaacccg

SEQ ID NO: 1421 - DNA, 800 bp, Homo sapiens
  misc_feature: GYAE6OF01AZ69T.38.30.C08.1.454.CMB.1.raw
tcagtcgatcacgtcacgaccggtgctcgatttagtctgacgtcaaagggtaaaggggttcgtgagagaggaggcccagccctgggtattttcctaggtgttttcatttggtgatccaggactgaacagtagaggaactcaccatggagttgggcgtgagctggtctttttgtagtggtcttagttttaaaaggtgtcctagtgtgagtgctaggtgtccggagtccgtgggggagtcgttcggttcacgtccgttcgggggtccctggagtacgttctccgttgtacgccgtagtcctcgtaggtactttaaccgtttagtacgtaccttagtcgtacctaagttggtaactccgtacggggtcccggaccgtacgggccgtaccggaaggggaacgggtcgtagggacggttacgggttactacgtaaggtaccgtaaagtttacgtggggttacgggtctaacgttaccgaaccgtaagttacgttacggacgtacggtacggttccgggggtacgggggtacccgttacgtaaaccgtagttacccgaaccgtaacgaacggtaaaccctaaacgtcccggaagggaacgaccggtaactaaccggttaaattacgtaaacgttaacgaaaacgtttcggaaccttaaccgaggtacccgtaggaacggtagtacggaacggtaccgtacgggtcgttagttaacttgtcgggtataccggtaggtaacgtaccgtaccggaacgggtccgaaccgttcggttagttcggttattttgaacgttttcgaggtacgg

SEQ ID NO: 1422 - DNA, 751 bp, Homo sapiens
  misc_feature: GYAE6OF01EJDID.38.30.C08.1.454.CMB.1.raw
  modified_base (692)..(692): a, c, t, g, unknown or other
  misc_feature (692)..(692): n is a, c, g, or t
tcagtcgatcacgtcacgaccggtgctcgatttagtctgacgtcaaagggaaagggtctgagagaggagcccagccctggattttcaggtgttttccatttggtgatcaggactgaacagagagaactcaaccatggaagttttgggctgagcgtggtctttttctagtggcttaattttaaaaggtgtccagtgtagaggtgctagttcgttggacgtgtgggggtagtcttaggtacgaggtccgtacggggggtccctggacgaccttccgtccgtgtcgactacgtccgtcgtgggtattcccgtaactttacgacacgtacttatcgacccattggacgtcgttaccggggtccgccgacggtccgtccggacggggtacggtcgtgggtaggtcggtctacgtaacgttatcgtaagttaagttggtggttacggtaaccctaacgtcgtttacggaacccgacgtaacgtacccgtacggtacggaaacgggtcccgtttaccaacccgtactacccgtccaagtacggaacctaacttaccgaaactaacaaccctaacttaactaacccggtataacctaagtaacgttaaacgaccccgttaggaaccggaacacccgggtaagacccgacgtaaccaagttactacgtatcggtagtaccggaaaagggccgttaacgggntcccggaccggtgggtacccggacggtaaccgtccggtaccgcccgttcccgtaacccg

SEQ ID NO: 1423 - DNA, 184 bp, Homo sapiens
  misc_feature: GYAE6OF01DEOC1.38.30.C08.1.454.CMB.1.raw
  modified_base (168)..(168): a, c, t, g, unknown or other
  misc_feature (168)..(168): n is a, c, g, or t
  modified_base (171)..(171): a, c, t, g, unknown or other
  misc_feature (171)..(171): n is a, c, g, or t
  modified_base (174)..(184): a, c, t, g, unknown or other
  misc_feature (174)..(184): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatgggagtttgggctgagcgggctggacaaggcgntanagnnnnnnnnnnn

SEQ ID NO: 1424 - DNA, 715 bp, Homo sapiens
  misc_feature: GYAE6OF01BTMYI.38.30.C08.1.454.CMB.1.raw
  modified_base (310)..(310): a, c, t, g, unknown or other
  misc_feature (310)..(310): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtcttttcagtggctaattttaaaaggtgtccactgtgaggtgcagttgttggagtcgtgggggagcgttgtacagccgtgggggtccctgagactctccgtgtgcagcctctggattctaccgtttaagctagctatgaccatgagcgtgggaccnccgaggcctccgagggtacggtctgggtacgtggtacctctacgttatacgtaagttaagtaggtaggtacggtacccaacgtaagttcgaaccgcaacgtaccgttcccggtaaggaacgggtacccggttcaaccgtactacctacccgaagtaacgaactaaacttaaccaaacggaacctaaccgtaactaaccttaacctacgaactaaacgtacgaaaccgtacccgaaggaacgaccggaaccggaacggtaacccgaacgggtaccctaaagttacttaaacgttaccgtaacggttagtaaacggggtaaaacgggtcggtaacggggtactaacggtcgtaccccggggaccgtaaccggggacccttacgggtacctacccgttccgtaccccg

SEQ ID NO: 1425 - DNA, 803 bp, Homo sapiens
  misc_feature: GYAE6OF01BNLUA.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggtcttaagttttaaaaggtgtccactgtgaggtgctagttggttggagtcgtgggggaggcgttggtacaggccgtggggggtccctgagactctcctgtcgcagtcctcgtggtacttcctacctttagcagtactatcgaccagtcgaggtccgtcgggtcccgccgacggtccgtaccggtacggggtacgggtcgtgggtaggtcgggtctctacttactacgtaagttaagttggttaggtacggtacccactacgttcggacgtccgtaacgtccgtaccggtacgggtaacgggtcccgttaccaccgtactcctaccgaagaacgtaaacgtaaccgtaaccgaaacgtaaacctaaccgaaccttaactaacccgtacgtaaactaaacgtaacggaacccgtaacccgttaggaaaccggaccggaacccggtaacgggaacccgaaaccgggtacctaacgttaacgttaacgtttacggtacgggttacggtaaacgggggtaaaccgggggtaccgggttaacgggggttaaccggtacccggttacccgggggtacgggggtaaccccggtaacggggttacccccgttacggtaccccggtaccccgttcccgttaccccg

SEQ ID NO: 1426 - DNA, 736 bp, Homo sapiens
  misc_feature: GYAE6OF01CUQXE.38.30.C08.1.454.CMB.1.raw
  modified_base (626)..(626): a, c, t, g, unknown or other
  misc_feature (626)..(626): n is a, c, g, or t
  modified_base (721)..(721): a, c, t, g, unknown or other
  misc_feature (721)..(721): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcacatggtagtttgggctgagcgtgtcttttcgagtggtacttaagtttaaaaggtgtccatgtgaggtgctagttgttggagtcgtgggggacgtcttaggtacgagccggtgggggtcctggacgactcgtcctgtcgcacgcctgtggacttctaaccttggacagcttagcaccagtggtacgcgttcgggcccgcgaacggcctcggaacgggccggtgtggtacggtcggtctactaacgttaagtacgaagttaagaggttcggtaacgttaacccagtacgttaccggaccgtacgaacgtaccgtccggttaaggaaccgggtccgttaccaacgtacttaccgaccgaagacgaacaacgttaccgaaaacgaaactaactaccgtaacgttaaccacgaactaaacgtacgaaaccgcccgtaagaaacgaccgggaacccgagggttaacccacccggattaaacttaacggacttttaaccggnggttaccggtaaaagggaaccggggtaacggacccggggttacaccggttaccgggacccggtaaccggaaccggtaaccctgggttaacccccncgttcccgtaacccg

SEQ ID NO: 1427 - DNA, 747 bp, Homo sapiens
  misc_feature: GYAE6OF01CJYQ2.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggcttaattttaaaaggtgtccactgtgaggtgctagttgtggagtcgtgggggagtcgttggtacaggccgtggggggtccctgagctctccgtgtcgcagcctgtggacttctaacctttagcagtctatcgacctagtcgacgtcggtcggtccgccgaggtcctccggaggggtaccggtcgtgggtacggttcggtacttacgtacgttaacgtacgtaagttaacgttaggttcggttaccggtaacctacgttacgttccgaacggtcctaacgccgttaccggtacggaaccgggttccggttaccaccgtattcccgtaccgaagtaacgaaaccttaacgttaaccgaaacgtaacctaactaccttaacggtaccctagaaaccttaaagtcggaaaccgtacccgtaaggaaccggacgaccccggtaaagggaccgtaccggaaccttaattacttaacgttacggtggtaacggtaagggaaaccgggggtccgtaaggggtctaacccggtcgggtaccgggaaccgtaccgggttaccctcggtaccctccggttccctacccgg

SEQ ID NO: 1428 - DNA, 890 bp, Homo sapiens
  misc_feature: GYAE6OF01DNC53.38.30.C08.1.454.CMB.1.raw
  modified_base (393)..(393): a, c, t, g, unknown or other
  misc_feature (393)..(393): n is a, c, g, or t
tcagtcgatcacgtcacgaccggtgctcgatttagtctgacgtcaaagggaaaggggtctgagagaggagcccagcccgtgggtatttttcgaggttgtttttctagtttgggtgatcgaggactgaacagagagaacctcaccagtggtaggtttgggctgagtcgttggttcgttttcgtaggttggtacgtttaaagttttaaaacggtcgtcctagttggtaggaggttgtacggttaggtttggtttaggggtacggttcggggttggggggtacggttcggtttacgggtacggtacggggttccgggggttcggggggttccctggacgtcctccttcgtgtcgacgtccgtccgttcgtcggttacttacctaccgtttagcgtntactacgtccgagtaggtacggtccggtcggtccggggtccgaccggtaccggtccggtaaccggtacgggggttcgggtcggttacgggtcgggtttccggttaccctacgttaacctttaggacggttaaggtaaggtaggtaccggtaccgtactaccgttaccggtacacccggtaacggtcgtaaccggttacgggaccgggtaccggttaccgtaccctacgtccgaccgtacgaacgtaacgtaacgttaactaaaccgaaacgaccgtaactaccgttaaccaacgtaaccgtaagtaaaccgtcggttaacccgccgttaaggacccgttacggaccggtacgaaccgttaccgaactttacgttaacgttcgttagtacggagggtaacggggtacggtcgggtaccgggtcggttaccccggggagggaccccggtaaccggtaccgggttaccccgtacggttcccgtacggtcccgttacccgg

SEQ ID NO: 1429 - DNA, 754 bp, Homo sapiens
  misc_feature: GYAE6OF01CPDZN.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggcttttctagtggctatttaaagtgtccactgtgagtgcagttgtggagtctgggggagcttggtacagccgtgggggtcctgagactctcctgtgcagcctctggacttctacctttagcagtctatcgccatgagcgtcgggtcccgccacggcctccggagggacgggtcgtggaggtcgggtctcacttatcgtaagttaacgtaggttggtacgggttacccaactacgtttccggaccgctaaggtacccttccggtaggaacgggtcccggttccaaccctagtcccttaccgacggaacgaacctaaacttaccgaaacggaaaccaactaacccttaactaaccccgttacgaacctaaagtaacggaaacgttacccccgaggaacgggaacggacccggaaacggacccgtaaccgaacccgtaattacgttaactttacgttagggtacgttaacggggaaaacgggggccggttaacggggggtaccgtacccgggtttcccgggtaaccggggggtacccccggtaaaccgggggttaaacccccggttggggtaacccgttacccccgggttcccgttacccccgg

SEQ ID NO: 1430 - DNA, 813 bp, Homo sapiens
  misc_feature: GYAE6OF01CL9HX.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggtcttttctagtggctaattttaaaaggtgtccactgtgaggtgcagttgttggagtcgtgggggagcgttggtacagccgtgggggtccctggagactctcctgtgcacgcctctggtattcactttagcagtctatgcctagtgagtccgtcgggtcccgccgaggtcctccggacggggtaccggttcgtgggtcggttcgggtccttacgtacttagtccgtaaggttaacgttaggttcgggttacgggttaacccaacgttacggtttaccggaaccggtaccgaacggtacccgttacccgggttaacggggaaacccgggggttccccggttttaccacccgttaaccggttcccttaacccgaacggtaacggtaaacccgttaaactttacccgaaaaacggttaaaacccaacccgtaaccttaaaccgttaacccttacggaaactaaaagtaccggaaacgttaaccccgaggaaaccgacgggacccggaaacggaccgaaccggtactaacgttattaacgttacgtacggtaggtacgggaaacggggtccggtaacggggttaccgacccggttccggggtaccggggtacccggtaacgggtaacccgttcgggtaaccccgtaccgttcccgtaccccgg

SEQ ID NO: 1431 - DNA, 835 bp, Homo sapiens
  misc_feature: GYAE6OF01EKZ9N.38.30.C08.1.454.CMB.1.raw
tcagtcgatcacgtcacgaccggtgctcgatttagtctgacgtcaaagggaaaggggtctgagagaggagcccagccctgggattttcaggttgttttcatttggtgatcaggactgaacagagagaactcaccatggagtttggctgagctggtctttttcgtagtggtacttaagttttaaaaggtcgtacctacgtggtgtaggtgcgtagttggttggagttcggtgggggagtcgttggtacgacgtccggtcgggggtcccctaggacgtaccttccgttccgttggtcgaccgtacgtcccgttcggttcggtactttacccgtaccgttttacgacgacgtacttagtcgacccgtagtacggacggtccggttaccggggtcccgaccggtacggtacccgtacccgggaagggggttacccgggttcggtacggggtcggttcgggttcccttacgttaaccgttacgtaacgtaagttaacgtacggtcggttaccggtaacctacgtacgttccggacgtacgtacgtaccgttccggtaacggtaaccggggttcccgttacccgaccgtaccgttacccgtaccgtaacgaaccgtaaacgttaaccctaaccgaaaacgtaacctaacctaaccttaaccgtacctaacgtaaaccgtaacgtacgaacccgtaccgtaggacgacggtaccggacgaccgaccgtacgtaatacttagttacggtagtacggaagggtaacgggtcggtacgggtccgtacgtaccggggacggacggtaacccgggtacctcgggttaccccgtccgtcccgtacccg

SEQ ID NO: 1432 - DNA, 707 bp, Homo sapiens
  misc_feature: GYAE6OF01BY8ON.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtcttttctagtggctaattttaaaggtgtccactgtgaggtgctagtttgtggagtcgtgggggagtcttggtacagccggtgggggtccctgagtactcctcctgtcgactacgcctcgtggtacttacctaccgttttagctagtctatcgctagtcggagtccgtcgggtcccgcgacggtccgtaccggacggggtaccgggttcgtagggtacggtttcgggtccttaccgtaactttagtccgtaaggttaagttacgggttggttacgtaaccacgtacgttccggacgtacacggtaccgtaccggttagggaaccgggttccgtacgaccctaccgttcctaaccgaacgtaaccgtaacttaaccgtaaccaaagaaccctaactaacctaacgtaccgtagaacctaaagtacgaaccgtaccgtagacgtacgaccggagtaccacgactacgtataacgtcgtagtacgaagggaacgggtgtacgggtacgcgtaccggtcgggacccgtaacggacccgtgccctaccgtccgtaccg

SEQ ID NO: 1433 - DNA, 978 bp, Homo sapiens
  misc_feature: GYAE6OF01DN3ZH.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgaactggtctttttctcgtggtcttaattttaaaaggtgtccagtgtgaggtgcagctgttggagtcgtggggggagtcgttggtacaggtccggtcggggggtccctggacgacttcctcctgtcgcacgtcctcgtggtactttaccgtaaccttttaaaggaaatttaagtcgtaccctaagtacggaaaccggttcggggtccccgaccggacgggtccgtaccgggaaggggggaacgggggtcgttcggggaagggttcggggttaccttccgtaatttcgtaaagtcggaacggtccgtcggttaagggttggggttaggggtaacggggtacctaacggtaacccttaacgtacgaaccggtacccgttcccgggtaacgggaaccggggttaccccggtttaccaacccggttacttttacccggaaagtaaccggtaaaaccttaaccgtttaaacccggaaaaacgtaaccgtaaacccggttcgtttaccggttacccgtttacggtttaaacgtttaaacgtaccggtaaaccgtacgggtccgtaaagggtacgggttaaaccggtaccggggaaaacgggtaacccgtaccggggtaaaccttaactttaaaggtttaaccgtttaaccggtaacgggtttaacgggaaaccgggtaaaaagggttcgggttttaggggggttacccgggggggtttacggtacccgggttacccgggggtttccccgtttaaacgggtaccccgggtttaccccgggggtacccgggggggtaacccgtaaaccccggggggttaccccctttaaccccgggggg

SEQ ID NO: 1434 - DNA, 919 bp, Homo sapiens
  misc_feature: GYAE6OF01B4F4P.38.30.C08.1.454.CMB.1.raw
  modified_base (231)..(231): a, c, t, g, unknown or other
  misc_feature (231)..(231): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggcttattttaaaaggtgtccactgtgaggtgcagttggtggagtcgtgggggagtcttggtacngccgtgggggtccctggacgactctccgtgtcgcacgcctgtggattctacctttagctagtcctatcgccagtcgagtccgtcgggtcccgccgacggccgtccggacggggtacgggtcgtgggacggttcgggttctaccgttacgttactaccgtaaggttaaacgttaggttacgggttacggtaaccctacgtaacgtttaccgacgtaccgaacggtacccgttacccgggttacgggtaaaccgggggttccccggttaccgtaacccgtacgttacccctaccggtaacggaaccgtaaacccgttaaactttaaccccgaaaagtaaacccctaacccgttaaacccttaaacctttaaccccggtaacgtaaaccgtaaaaccggttaacggaaaacccggttaaccccgggttaacggaaccggggtaacccgggaccccggtaaaacggggaacccggaaaccccgggtaacccttaacgtttaaaccgtttaacgtttaacggtttacggttaacgggggttaaacggggggaaacccggggtaccgggggttaaccggggggtacccggttaaacccggttcccggggggtaaccgggggtacccgggtaaacccggggttaccccgttacccggggttaccccgtaccccgggtttccccgtaccccccggg

SEQ ID NO: 1435 - DNA, 833 bp, Homo sapiens
  misc_feature: GYAE6OF01DI3OC.38.30.C08.1.454.CMB.1.raw
tcagtcgatcacgtcacgaccggtgctcgatttagtctgacgtcaaagggaaagggtctgagagaggagcccagccctgggattttcaggtgttttcatttggtgatcaggactagaacgagagagactcacagtggtagttgggctgacgtcggtgttcgtttacgtaggtcggtactttaagtttaaaggtctacgtacgtggtgtaggtcgtacgttgtttgtgggtaggtcgggtaggggagttcgttaggtacgacggtccgggtcggggtacctaggtacgtccgttcgtccgtgtagaccgtacgtccgttgtagttacttaccgttaacgttacgacgtacgtacgttacgcgtacgtaggtacggtacggtccggtaccgggtacccgaccgtaccggtccggtacggggtacgggttcggtacggtacgggttcggttaccgtacctacgttacgttaacgtacggttaagtacggttaggttacggtaccgtaacgtcgttacggtacgaccgtacgtacgtccggttacggtacggtaccggtccgtacaccgttacgtaccgacgtaagtaacgtacttaacgaacgaaaccgtactaccgttaactaaccgtaacgtaacgtaaacgtaccggtaaccgaaccgttacgaacggtaaccggaccggaacggtaccgacccgtaaccgtacttaagttacttaaccggttaggtacggtaacgggtaacggggacgggtaccgggtacggtccggtacccgggtaccggaccgggaaccggtaccggttaccgttacggtaacccctcgttcccggtacg

SEQ ID NO: 1436 - DNA, 850 bp, Homo sapiens
  misc_feature: GYAE6OF01CJ4PJ.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggtagtttgggctgagctggtctttttctaggtggtacttaagttttaaaaggtcgttaccacttggttggagggtgtcgtaggtttggttgggagttcggtggggggaggtcgtttaggacgacggtccgggtcggggggttccctggacgtaccttccgtccgttggtacggccgacggtcccttcggttaggtactttcccgtaaccttttacggctacgtccttagtcgtacctagttacggacgtccggtccggggtcccgaccgacggtccgtaccggacgggggtaccggttggtagggtagggttcggtctactacttacgtacgtaagtaagtacggttggtacgtaaccactacgttacgacgtcgtacgtaccgtcggaggtaccgggtccgtactaccgtacttaccgtaccgaagaacgtaaccgttaactaacccgaaaacgtaaaccctacctaacttaacctaaccgtaacgaaactaaaccggtaacgaaaccgtaacccgtaaggaaaccggtaccggaaccgggtaaaccggacccgaccgggtaacttaagttacgtttaaacttaccggttgggttaggtaaacgggggtaacggggaccgggttacggggacggttaaccccggtccggggtaacgggaacccgggtaccgggtaaaccccggtcggttaccctacccggttcgtaaccccgg

SEQ ID NO: 1437 - DNA, 905 bp, Homo sapiens
  misc_feature: GYAE6OF01APLDE.38.30.C08.1.454.CMB.1.raw
tcagtcgatcacgtcacgaccggtgctcgatttagtctgacgtcaaagggaaaggggtctgagagaggacgcccagccctgggtattttcaggttgttttcatttggtgatcaggactgaacagagagaactcactgtggtaggtttggctgagtcgtggttctttttccgtaggtggtactttaagttttaaaaggcgttacccagttggtggtagggttcgacgttaggtttggttggggtacggttcgggtagggggggtagtccggtttagggtaccgacggttcccggggttcggggggttacccctggtacggtccttccgtccgttcggtacgtaccgtaccgttccggtacgttaggtaccttacccttaaccgttggaccctaggtacttgtaccgtacgtagtacggaccggtccggttaccggccccggtaccggtacggtcccggtacggggtacggggtccggtttacggtacgggtcgtccggttacctaacgttacgttacgtaacgtaagtttaccgggttaggttacggtaaccgtacgttacgtacgttaccccggagtaccggtacgtaccggtcgggtacgggtaaccgtccgttacccgacttaccgtaccgtaacgtaacgtaactaaccttaacgtaaaccgtaaacgtaaccctaacgtaacgttaaccctacgtaaacgtaacaaggttaccggaaccgtacgtacggaacgtaccggaccgaacggggtaccctagaacttacgttaagtaccggtttacggaggttaacggggtacgggaacgggttaccgggtacgggttaccggccgggttaccggggaaccggtcccgggttaaaccggtcccggtacggtcccgttaacccggtcccgtcccgg

SEQ ID NO: 1438 - DNA, 787 bp, Homo sapiens
  misc_feature: GYAE6OF01AO26U.38.30.C08.1.454.CMB.1.raw
  modified_base (691)..(691): a, c, t, g, unknown or other
  misc_feature (691)..(691): n is a, c, g, or t
tcagtcgatcacgtcacgaccggtgctcgatttagtctgacgtcaaagggaaagggtctgagagaggagcccagccctgggattttcaggtgttttcatttggtgatcaggactgaacagagagaactcaccatcggagtttgggctgagctggtctttttctagtggcttaattttaaaggtgtaccacgtgtgaggtgctagtttgttggaggtcgtgggggagtcgttggtacaggcccggttggggggtacccctggacgtactcctcctgtcgccacgtccctgttggtaactttccctaaccttttaacggctaacggtccttaagtcgacccgtaagtggacggtcgtttcgggggaccccgccgaagggcctaccggaagggggcccggtgttggggacgttcggggtcttaccgtacgttactacgtaacttaaggttaacggtttcgggtaccggttaaaccctacgttaacgttaaccgggtaccggaccgtaaccgtaaccgttccgggtacggtaaacggggtccccggttacaaccggtacttaccctaccggaagtacaaccgtaaacttaaccgaaacgaactaccgaacttaacaccgtgaaactaagtacgaaactcccgtaaggacgtaacgaccggacggtacaacccgggtactaataacgtattacggngtaggtaaaggggaacgggtccggagggtttacggaccgttccggggacgggaccgggtaccccggacgttaccgggcctacccggttcgtacccg

SEQ ID NO: 1439 - DNA, 882 bp, Homo sapiens
  misc_feature: GYAE6OF01D3GTU.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggtctttttcgtagtggtcttaattttaaaaggtgtccactgtgaggtgctagttgttggagtcgtgggggagcgttggtacagccgtgggggtccctgagacctcgtcctgtcgcgagcctgtggtacttcctacctttagcagcttagtcgcctagtgtacgccgttcggggtacccgccgacggtcccgtaccgggaggggtaccgggtcgtagggtacggttcgggtacctcgtaactttagtaccgtaaggttaacgtaggttcgggtacgtttaacccgacgttaacgttccggaaccgtacgtaaccggtaacccgttacccggtaaggggaaacccgggttcccggtttacccgaacccgttacgttacccgttaacccgaaggaacgtaaaccttaaaaccctttaaacccgggaaaacaaaccctaaccgtaaacccgtttaacgttaacccgtacggtaaaccctaaaaggtttaccggaaaacccgtccccgtaagggaaagggacccgggtacccgggaaaccggtaaccggacccggaaaccttacggttaacttaaccgtttagttcggtaaacggggttaaaggggaaacccgggggttacgggtaaccgggggttaaccttcccgggttaaacccggggtccggggtaaacccccgttacccggggaaccccgtttaagggtccccctaaaccggggtttccctaacccccg

SEQ ID NO: 1440 - DNA, 859 bp, Homo sapiens
  misc_feature: GYAE6OF01EMI6A.38.30.C08.1.454.CMB.1.raw
tcagtcgatcacgtcacgaccggtgctcgatttagtctgacgtcaaagggaaaggggtctgagagaggagcccagccctgggtattttcaggttgttttctatttggtgatcaggactgaacagagagaactcaccatggagtttgggctggagctggtctttttctagtggtcttaattttaaaaggtgtccagtgtgaggtgcgtaggttggttggagtcgtgggggaggtcgttggtacgcggtccggtggggggtcccctggacgtacctcctccgtgtcgcgacgtccctcgtggtacttcctaacctttagcctagtctactcgacctagtggacggccgttccggggccccgaccgtacggccgtaccgggaaggggtccgggtcggtggggtaggttcgggttccttcgtaacgttactaagtaaggttaaagttacggtacgggttaacgtaccgtaacgtacgtaccggaccgcgtaaccgtaccgtaccgggtaggtaaccgggtacccggttacctaacccgtacgttaccctaacccgaagtaaccgtaaaccgtaaacttaaacccggaaaaccgtaacctaaaccctacgttaaccctaacccggtacgtaaaccgtaaacggtacggaaacccggtaccgtaacgggaaccggtaacccgggacccggaaacgggtaaccccgaaccgggtacctaagtttaaccttagttaaacggtggttaaacgggtaagggaaacccggggggtcggtaaccggggttacgtacccggtaccgggtaccggggacccggtaacccggggtaacccgttccgggtacccttaccccggtcccgtacccgg

SEQ ID NO: 1441 - DNA, 792 bp, Homo sapiens
  misc_feature: GYAE6OF01DO7YY.38.30.C08.1.454.CMB.1.raw
  modified_base (631)..(631): a, c, t, g, unknown or other
  misc_feature (631)..(631): n is a, c, g, or t
  modified_base (642)..(642): a, c, t, g, unknown or other
  misc_feature (642)..(642): n is a, c, g, or t
tcagtcgatcacgtcacgaccggtgctcgatttagtctgacgtcaaaagggaaaggggtctgagagaggagcccagccctgggattttcaggtgttttcatttggtgatcaggactgaacagagagaactcaccatgggtaggtttgggctgagctggtctttttctaggtggtacttaagttttaaaaggtgtccaactggtgaggtgcgtaggttggttgggaggtcgggtgggggtacggtcgttgggtacgtcggtaccggtcggggggtccctaggacgtaccttccgtccgtgtcgtcgacgtcctcgtggtaccttcctaccgtttaggctacgtcttagtcgacgtagtggacggtcggttcgggcccgtaccggacgggttccgtaccccggggtaggggtacccggggttagtacggggtacgggttcgggttacctaccgttaacgttacggttaacggttaaaggttaacggtacgggttacgggtaacgttaacccgtaacgttacgttacccgaacgacgtacgtaccggttacggtaacggtaaccgggtccgtaccacgtctacgacgtagaacgtaacaaccttaacaactaaccactaacctactaccagaanaaacgtcgaanaccgtagacggaccgacggaaccgtacgaacctcttaaatcgtaacgttaaggtcggtaaggttaacgggacgggtacggtagggtccgtaaccggtccgggacggtaacccgtaccgggaccctccgggtaccctccgtccgtacccgg

SEQ ID NO: 1442 - DNA, 736 bp, Homo sapiens
  misc_feature: GYAE6OF01A6K0M.38.30.C08.1.454.CMB.1.raw
  modified_base (264)..(264): a, c, t, g, unknown or other
  misc_feature (264)..(264): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggagcgttggtacagtccgtggggggtccctgagtactctcctgtcgcncgcctgtggacttcctacctttagcagctatcgccagtgacgtcgtcggggtacccgccgaggtcctccggaaggggtccggtcgtgggtaggtcgggtcctacgtacttacgtctaagtaagtacggtggtacgtaacccacgtacttccggacgtacaacggtaccgttccggtagggtaaccgggtcccggtttacacccgtacttcccgtaccgaacggtaacgaaccttaaacgttacccgaaagtaaccctaactaccgtaactaccgtacgaacctaaacgtacggaacccaccggtaaggaacggacggtacccggacgaacccgaccgtactaagttactaacgttagtcggttacggaggggaaacggggtccggtaacggggtcggtaccgtcccggggacggggtaccccggtaaccggggtaaccccgttcgggtacccgtacccggttccgtccccgg

SEQ ID NO: 1443 - DNA, 711 bp, Homo sapiens
  misc_feature: GYAE6OF01BM5WC.38.30.C08.1.454.CMB.1.raw
tcagtcgatcacgtcacgaccggtgctcgatttagtctgacgtcaaagggaaaggggtctgagagaggagcccagccctgggattttcaggttgttttcgatttggtgatcaggactgaacagagagaactcaccatggagtttgggctgagctggtctttttctagtggcttattttaaaggtgtccactgtgaggtgcgtagttgttggagtcgtgggggtaggtcgttggtacaggccgtcggggggtccctggagacctcctccgtgtcgcacgtcctcgtggtacttccgtacctttacgctagtctagtcgaccagtggacgtccggttcgggtaccccgccgacgggtcccgtaccggaacgggggtaccggggtcgtaggggtacggttcgggtaccttacgtactttacgtacgtaagtaacgtaggtcggtacgtaccgactagtaccgacgcgagtaccgtaccgtacggtaacgggtcccggttacaccgtacgtcctacccggaagtacgaacctaacttaaccgaaacgaacctaactaacctaactacctacgtaacaaactacgtaaccgaccgtagaacgacggccggacgacgaccgactatattactgtacgtggtaacggaagggccgtaggggtactccggtcggtaccggggaccgacgggtaccgtcggtactcccggtcctacccgg

SEQ ID NO: 1444 - DNA, 759 bp, Homo sapiens
  misc_feature: GYAE6OF01E12FX.38.30.C08.1.454.CMB.1.raw
  modified_base (205)..(205): a, c, t, g, unknown or other
  misc_feature (205)..(205): n is a, c, g, or t
  modified_base (333)..(333): a, c, t, g, unknown or other
  misc_feature (333)..(333): n is a, c, g, or t
  modified_base (493)..(493): a, c, t, g, unknown or other
  misc_feature (493)..(493): n is a, c, g, or t
  modified_base (577)..(577): a, c, t, g, unknown or other
  misc_feature (577)..(577): n is a, c, g, or t
  modified_base (612)..(612): a, c, t, g, unknown or other
  misc_feature (612)..(612): n is a, c, g, or t
  modified_base (730)..(730): a, c, t, g, unknown or other
  misc_feature (730)..(730): n is a, c, g, or t
tcagtcgatcacgtcacgaccggtgctcgatttagtctgacgtcaaaagggaaaggggtctgagagaggagcccagcccctgggattttcaggtgttttcatttggtgatcaggactgaacagagagaactcaccatggtagtttgggctggagcgtgtcgttttctaggtggtctaattttaaaggtcgtcctactgtgaggtncgtagttgttggagtcgtgggggacggtcgttggtactcggtccggttcggggggtcccctaggtacgacctcctccgtggtacgcctacgcccttcgtcgtacgttcctaaccgtttacgccgtacncttactcgtacccgtagttaggacgtccggtacggggtcccgaccggtacggtccgtaccgggtaaggggtaccgggtacggtcggggtaacgggttcggtaccgttactacttacgtactaagtagtaggttacggtcgtaacctgtacgtacgcgacncgtaccgtcggtacggacggtccgtacgaaccttgccctacgagactacctaagtaaccaacgacaactactacgtctacgaanaacgtcgaaccgccagacggtaacgacccgggtanaaccggttcgaaccttagtaacgtccgttaacggtcggtaagggtaaggacccgggtacgggtacgggttccgaacggttacccggggaccgggaacccgttaccggggtaaaccccnccggttacccgtacccggtactcccccgg

SEQ ID NO: 1445 - DNA, 833 bp, Homo sapiens
  misc_feature: GYAE6OF01E0XQZ.38.30.C08.1.454.CMB.1.raw
tcagtcgatcacgtcacgaccggtgctcgatttagtctgacgtcaaagggaaaggggtcgtgagagaggagcccagccctgggattttcaggtgttttcatttggtgatcaggactgaacagagagactcgaccatggagttgggctgagctggtctttttcgagtggcttaatttaaaaggtgtccactgtagaggtgctagttgttggagttcgtcgggggtaggtccgttagggtaccaggtccggtcggggggtcccttggacgtacctccgtccgtggtgcgacgccgtacgtcggtacttcctaacctttacgcgtaacgtcgttaacgtcggtaccgtaacgtcggaacggttccggtaccggggttaccccgaccgtacggtccgttaacccgggaagggggttacccggggttacgttacggggttaacggttcgggttccttaccgtaacgtttaccgtacgtaaggttaaccgttagggtacggttacgtacccgtaacgtacgtttaccggaccgtactacggtaacccgttccggtagggtaaaccggggcccgttacgaaccgtacgtacccgtaaccgtaagacgtaaccttaacgtaccgtaaacgaacccgacgtaacctaacgtaaccccgttgaaccaaacgtcgtaacccgccgtagacggaaccgacggccggtaacgtaccggaccttacgttacgtcgttaaccgtgggttagtaccgggaaacgggtccggtaacggggtcgtacccggttaccggacggggcccgaaaccgggtacccgtacgggtcccgtacccgttcggtaccccg

SEQ ID NO: 1446 - DNA, 776 bp, Homo sapiens
  misc_feature: GYAE6OF01C9L8I.38.30.C08.1.454.CMB.1.raw
  modified_base (205)..(205): a, c, t, g, unknown or other
  misc_feature (205)..(205): n is a, c, g, or t
  modified_base (343)..(343): a, c, t, g, unknown or other
  misc_feature (343)..(343): n is a, c, g, or t
  modified_base (421)..(421): a, c, t, g, unknown or other
  misc_feature (421)..(421): n is a, c, g, or t
  modified_base (475)..(475): a, c, t, g, unknown or other
  misc_feature (475)..(475): n is a, c, g, or t
  modified_base (683)..(683): a, c, t, g, unknown or other
  misc_feature (683)..(683): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaacctacaccatggattgggctgagcttggtcttttcgtagtggacttagttttaaaaggtcgttccactgtgaggtganggtttgttgggcgttcggtagggggaggtcgttggtacgacgccggttcggggggtcccttgacgtacctctccgtgtacgcaggccctgtggtaacttcctaacccgtttaggctaggtccttgtgccctagtacgngtccggttccgggtcccggaccgacggccgttaccgggaaggggtccgggttccgtgggtacggttggttctaccgtnttaatacgtaagtaaggttcgttcgggacggttaacccagttactacgggtacnccgaacgtaccggttcgaacggggacgggtttccccgtacgaaccgtaccgttccgttaaccgaacggtaacgaaacccgtaacgtttaaccggaaacgaaaaccctaccggtaacccttaccgtaaaccttacgaaacctaaagtacgtaacgaacccgtacggaacgaaccgacgaacggtcacggacctagttacctagttacgnggtaacgtagggaacgggtaacggtcgggtacgtccgtacccgggtaggggtacccgaccgggtaccggaccgttcccgccgttctaccccgg

SEQ ID NO: 1447 - DNA, 591 bp, Homo sapiens
  misc_feature: GYAE6OF02HQFCL.38.30.C08.1.454.CMB.1.raw
  modified_base (179)..(179): a, c, t, g, unknown or other
  misc_feature (179)..(179): n is a, c, g, or t
  modified_base (184)..(184): a, c, t, g, unknown or other
  misc_feature (184)..(184): n is a, c, g, or t
  modified_base (466)..(466): a, c, t, g, unknown or other
  misc_feature (466)..(466): n is a, c, g, or t
tcagtcgatcacgtcacgaccggtgctcgatttagtctgacgtcaaagggaaagggtctgaaggagaggagcccagccctgggattttcaggtgttttcatttggtgatcaggactgaacagagagaactcgaccatggagtttgggctgagcggtgtgttcaaggcgcatttaaaggntcatngagtgccagttgtgagtctgggtgcttggacagcctgggggtccctgagactctcctagtgccagtcctcgtggatttcacctttagctagctatgctatgagtgtggtccgccgacggaacgaccgacggacggccgtacgacgtggtcgtcacttatctagtaatacgtgttaggtacgacgtacttacgacgacgtagaacgtcgtaggacggtcggtcgtaccgacgtcgtactacgttacgtacaacttacaacgaacacactactactacgacaanagaagaccgtacgacgacgacgacgacgacgacactatatatagtagtagtaacggtacgtacggtacggtacgtaccggtacgggacggacgggaaccggtacggtacgtaccgtaccgtaccg

SEQ ID NO: 1448 - DNA, 540 bp, Homo sapiens
  misc_feature: GYAE6OF02HV28D.38.30.C08.1.454.CMB.1.raw
  modified_base (303)..(303): a, c, t, g, unknown or other
  misc_feature (303)..(303): n is a, c, g, or t
  modified_base (445)..(445): a, c, t, g, unknown or other
  misc_feature (445)..(445): n is a, c, g, or t
  modified_base (478)..(478): a, c, t, g, unknown or other
  misc_feature (478)..(478): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtctgggggaggcttggtacagcctggggggtccctgagactctcctgtgcagcctctggattcacctttagcagctatgccatgagctgggtccnccaggctccaggggacgggtctgggagtgggtctcacttatcagtaatagtggtggtaccacattcgacgcagactccgtgaagggccggttcaccatctccagagacaattccaagaacacactatacctgacaaatgaanaccctgagagccgagacacggccatatattacngtgtagaaggggcacggggtgacgtccgtggggccacgggaccctggtaccaccgtctcccg

SEQ ID NO: 1449 - DNA, 554 bp, Homo sapiens
  misc_feature: GYAE6OF02I4S8C.38.30.C08.1.454.CMB.1.raw
  modified_base (442)..(442): a, c, t, g, unknown or other
  misc_feature (442)..(442): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgcgtttctaggtggctattttaaaggtgtccatgtgaggtgcagttgttggagtctgggggaggcttggtacagcctggggggtccctgagactctcctgtgcagcctctggattcacctttagcagctatgccatgagctgggtccgccaggctccgagggacgggtctggagtgggtctcactttagcagtaatagtggtgtaccacattcgacgcagactccgtgaagggtccgttcaccatctccagagacaattccaagaacacactatacctgacaaatgaanaccctgagagccgaggacacggccatagtattactgtgtagaacggggcacggggtgacgttaccgtgggggaccaacggggaacccctgggtaccgacccgtcgtaccccg

SEQ ID NO: 1450 - DNA, 546 bp, Homo sapiens
  misc_feature: GYAE6OF02HRTJ1.38.30.C08.1.454.CMB.1.raw
  modified_base (177)..(177): a, c, t, g, unknown or other
  misc_feature (177)..(177): n is a, c, g, or t
  modified_base (316)..(316): a, c, t, g, unknown or other
  misc_feature (316)..(316): n is a, c, g, or t
  modified_base (329)..(329): a, c, t, g, unknown or other
  misc_feature (329)..(329): n is a, c, g, or t
  modified_base (425)..(425): a, c, t, g, unknown or other
  misc_feature (425)..(425): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgcgtttcagtggctatttaaaggngtcatgtgaggtgcagttgttggagtctgggggaggcttggtacagcctggggggtccctgagactctcctgtgcagcctctggattcacctttagcagctatgccatgagcctgggccgcaggctccgagggccggtntgggagtgggtcncacttatcagtaatagtggtggtacacattcgacgcagactccgtgaagggccgttcacatctcagagactattccaagaacacactattaacccnacaatagacaccacgagagacgacgacgacgacatatatactagtgtaggagggacggacgggtacggtacgtacgtacgggaccggacgggaaccgtaccggtaccgtaccgtccgtccg

SEQ ID NO: 1451 - DNA, 604 bp, Homo sapiens
  misc_feature: GYAE6OF02JAWXO.38.30.C08.1.454.CMB.1.raw
  modified_base (353)..(353): a, c, t, g, unknown or other
  misc_feature (353)..(353): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggtctttttctagtggctaattttaaaaggtgtccactgtgaggtgcagttgtggagtcgtgggggaggcttggtacagccgtggggggtccctgagactctcctgtgcagcctctggacttcacctttagcagcctatcgcccatgagctgggtccgccaggcctccgagggacggtctgggagtgggtctcgacttancagtaatggtggtcggtaaccatagtttcgacgtcgaagaccgtccggtagaacggggtcccgttcacctatcctcagagacaacttaccaaagaacacaactattacctgactaaatgaaacgcctagacgacgacgagaccacggccaatactattacgtgtaggtaggaacgggcgtaacggggtagaaccgttccggtacggggaccctaacggggtacccctgggtaccctacccggtcctacccg

SEQ ID NO: 1452 - DNA, 756 bp, Homo sapiens
  misc_feature: GYAE6OF02I8BV8.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatgggagtttgggctgagcgtggtcttttctagtggctaattttaaaaggtgtccactgtgaggtgcagttgttggagtcgtggggacggcttggtacagccgtgggggtccctgagactctcctgtgcacgcctctggattcacctttagcagcctatcgcccatcgagcgtgggtcccgccaggcctaccggacggggaccggtcgtagggacggtcgggtcctacgtacttactcgtaagttaagtaggttgggtaggtacccacgtagtttacggacgcgaacgtacctccggttaggaaacggggtcccgtttaccacctagtcctaccgagacgactaacttaccgaaagaacacgtactaacgttacctagaactaaagtagaaccgacccgtagaacggtaacggacccggaaagggtaccgaccgggtacctaactaaacgtttaactttaaccgttacgggttacggtaacgggtaaaacgggggtcccgggtaaacgggggttaccggtaacccgttaccccggggttaaccggggggtacccggtaaacccggggggttaacccccttcgggggtaaccccgttaccccccgggttaccgtttacccccgg

SEQ ID NO: 1453 - DNA, 612 bp, Homo sapiens
  misc_feature: GYAE6OF02FJ45I.38.30.C08.1.454.CMB.1.raw
  modified_base (154)..(154): a, c, t, g, unknown or other
  misc_feature (154)..(154): n is a, c, g, or t
  modified_base (327)..(327): a, c, t, g, unknown or other
  misc_feature (327)..(327): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcggngtgtttcaaggtggctattttaaaaggtgtcactgtgaggtgcagttgttggagtctgggggaggcttggtacagcctggggggtccctgagactctcctgtgcagcctctggattcacctttgcagctatgccatgagctgggtccgccaggctccagggacgggtctgggnggtggtcgtctacttatactagtaagtagtggtgtacactatcgacgcacgacgtcgtacggacgggaccggtcgaccgactctaccgacgacgactaactaccaacgaacaacaactaactaacctacgacaaactacgaacgaaccgtacgacgacggaccgacggaacgaccgaccgaactaacttaattacgtagtagtaggaacgggacggacgggtacggtacgtaccggtacgggaccggaccgggtaacccggtacggtaccgtaccgtaccgtccg

SEQ ID NO: 1454 - DNA, 633 bp, Homo sapiens
  misc_feature: GYAE6OF02IG3IO.38.30.C08.1.454.CMB.1.raw
  modified_base (235)..(235): a, c, t, g, unknown or other
  misc_feature (235)..(235): n is a, c, g, or t
  modified_base (324)..(324): a, c, t, g, unknown or other
  misc_feature (324)..(324): n is a, c, g, or t
  modified_base (370)..(370): a, c, t, g, unknown or other
  misc_feature (370)..(370): n is a, c, g, or t
tcagtcgatcacgtcacgaccggtgctcgatttagtctgacgtcaaagggaaaggggtctgagagaggagcccagccctgggattttcaggtgttttccatttggtgatcaggactgaacagagagaactcaccatgggagtttgggctgagcgtggtcttttctaggtggctaagttttaaaggtgtccactgtgaggtgcagttgttggagtcgtgggggagtcgttggtacnggccgtgggggtccctgagctcgtcctgtgcagcctcgtggattcgacctttagaccgagtcctagtcgccaatcgagtcgtggtcccncaggctccgaagggcggtctgggacggttcgggtctcaacgtttanccgaagttaatgtggtcggtaccacgtagttcgacgcgacgtacgtccggtaggaacgggtccgttcgaaccgtatcctaccgagacgactattaccgaaagtaaccactacgtaattaccgtgaactaaacgtagaaacgtaccctagacgaagccggaagaccgacggcaagtatacttacgtagcggttaaggaacgggcgacgggtcgaaccgtccggtagggccgtaacgggaccgtacggtccgaccgttactcccg

SEQ ID NO: 1455 - DNA, 251 bp, Homo sapiens
  misc_feature: GYAE6OF02JZ4WX.38.30.C08.1.454.CMB.1.raw
  modified_base (237)..(251): a, c, t, g, unknown or other
  misc_feature (237)..(251): n is a, c, g, or t
tcagtcgatcacgtcacgaccggtgctcgattagtctgacgtcaaggtaaggtcacgggttgactcctgggccaggaaccctggtcaccgtctccctcagcctccaccaaggcccatcggtctccccctggccaccctcctccaagagccacctctgggtcacagccggccctgggcctgcctggtcaaggctacttccacgtgatcgactgacgcggctaggcaaggtcgcatagnnnnnnnnnnnnnnn

SEQ ID NO: 1456 - DNA, 534 bp, Homo sapiens
  misc_feature: GYAE6OF02HYKT0.38.30.C08.1.454.CMB.1.raw
  modified_base (303)..(303): a, c, t, g, unknown or other
  misc_feature (303)..(303): n is a, c, g, or t
  modified_base (349)..(349): a, c, t, g, unknown or other
  misc_feature (349)..(349): n is a, c, g, or t
  modified_base (439)..(439): a, c, t, g, unknown or other
  misc_feature (439)..(439): n is a, c, g, or t
  modified_base (475)..(475): a, c, t, g, unknown or other
  misc_feature (475)..(475): n is a, c, g, or t
  modified_base (496)..(496): a, c, t, g, unknown or other
  misc_feature (496)..(496): n is a, c, g, or t
  modified_base (524)..(524): a, c, t, g, unknown or other
  misc_feature (524)..(524): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggtcttttctagtggctaatttaaaggtgtccactgtgaggtgcagttgtggagtcgtgggggagcttggtacagccgtgggggtccctgagactctcctgtgcagcctctggattcacctttagcagctatgccatgagctgggtcccncaggctccgagggacggtctggagtgggtctcgacttatcagtaanaggtgtggtaccatattcgacgcagactccgtggacggcgttcacatctcagagacatacaagaacacactatacctagataaactgaanaccctagacgagaccgagaccacggcatatattacngtgtaggaagggcgacgggtnaccgtcgcgggcgacgggaccctggacnccgtctaccg

SEQ ID NO: 1457 - DNA, 542 bp, Homo sapiens
  misc_feature: GYAE6OF02GNQ35.38.30.C08.1.454.CMB.1.raw
  modified_base (511)..(511): a, c, t, g, unknown or other
  misc_feature (511)..(511): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtctgggggaggcttggtacagcctggggggtccctgagactctcctgtgcagcctctggattcacctttagcagctatgccatgagctgggtccgccaggctccgagggacgggtctgggagtgggtctcacttatcagtaatagtggtggtaccacattcgacgcagactccgtgaacgggccggttcaccatctccagagacaattccaagaacacactatacctgacaaatgaacgaccctgagagccgagacacggaccatatattactgtagtaggaacgggcacggggtgacctcgngggccagggacccgtggtaccaccgtctccg

SEQ ID NO: 1458 - DNA, 640 bp, Homo sapiens
  misc_feature: GYAE6OF02I7AAK.38.30.C08.1.454.CMB.1.raw
  modified_base (155)..(155): a, c, t, g, unknown or other
  misc_feature (155)..(155): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgngtttctagtggctatttaaaggtgtccatgtgaggtgcagttgttggagtctgggggaggcttggtacagcctggggggtccctgagactctcctgtgcagcctctggattcacctttagcagctatgccatgagctgggtccgccaggcctccgaggggacgggtctgggagtgggtctcgtacttatcagtaatgtggtgtaccacatttcgacgcagtactccgtagaacgggcccggtttcaccgtatccctaccaaggacgaactaaacgttccaaaacgaacaaccctacttaactacccttagacctaaattcgaaacgtacccgtaggacgacgcccggtaaggaccgacgggaccctaataactacgttaacctggtacgttaggaaacggggtcgtacgggggtacgtaccggttcccgttagggggacccgtaacggggtaacccgttcgggtacctacccggtccttaccccg

SEQ ID NO: 1459 - DNA, 622 bp, Homo sapiens
  misc_feature: GYAE6OF02FI6IO.38.30.C08.1.454.CMB.1.raw
  modified_base (362)..(362): a, c, t, g, unknown or other
  misc_feature (362)..(362): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtcgtttcaaggtggctattttaaaaggtgtccactgtgaggtgcagttgttggagtctgggggaggcttggtacagcctggggggtccctgagactctcctgtgcagcctctggattcacctttagcagctatgccatgagctgggtccgccaggctccagggacggtctgggagtgggtctcacttatcagtatagtggtgtaccanattcgacgcaagactccgtgaacgggtccggttcaccactctccagacgacaattccaaagaacacaactataacctgacaaagtgaaacgtaccccaggacgaacggaccgaacggaacgaccgggaccaataacttaattaccgtagttagtaggtaaacggggaccgacggggggtacggtaccgttacccggtacgggggtacccgaagggggtaaacccccgttacgggtacccgtacccggttcccgttacccg

SEQ ID NO: 1460 - DNA, 649 bp, Homo sapiens
  misc_feature: GYAE6OF02GCJJR.38.30.C08.1.454.CMB.1.raw
  modified_base (255)..(255): a, c, t, g, unknown or other
  misc_feature (255)..(255): n is a, c, g, or t
  modified_base (604)..(604): a, c, t, g, unknown or other
  misc_feature (604)..(604): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtcgtttcagtggctatttaaaggtgtcatgtgagtgcagttgttggagtcgtgggggagcgttggtacagccgtggggggtccctgagactctcctgtgcncgcctctggattctacctttagcagctatgccatgagcgtcgggtccgccgaggccgtccgagggcgggtctgggacgttgggtctcgtacgttatacagtaaagtggttggtacggttaccaacgtacgtttaccggacgacgaacgtacgtcccggttagggaaccgggggtcccgggttttacacccggtaacttcctccgtaacgaacggtaactaacgttaccaaagtaaaccaacaccttaacacccgtagactaaacgtgaaaccacccgtagaacgaggacccgaaggaacgccgtaccgaattaataccttagtcgtagtacggaaggggtcgtacgggntaacccgtcgtacgggacacggtacctggccgttaccgcctcccg

SEQ ID NO: 1461 - DNA, 557 bp, Homo sapiens
  misc_feature: GYAE6OF02HTQZB.38.30.C08.1.454.CMB.1.raw
  modified_base (362)..(362): a, c, t, g, unknown or other
  misc_feature (362)..(362): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (502)..(502): a, c, t, g, unknown or other
  misc_feature (502)..(502): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggcttttctagtggctatttaaaaggtgtccactgtgaggtgcagttgttggagtctgggggagcttggtacagccgtggggggtccctggagactctcctgtgcagcctctggattcacctttagcagctatgccatgagcgtgggtcccgccaggctccgagggcggtctggagtgggtctcgacttatcagtaatagtggtgtacanttcgacgcagacctcgtgaacgggccgttcaccatctcacgagacaattccaagaacacactatacctagacaaatgaacgacctgagagccgagacacggccaagtanattacngtagtaggtaaggggcgacggggtnaaccgttccgcggggacctacggggaaccccgttggaccgacccgttcgtacccg

SEQ ID NO: 1462 - DNA, 569 bp, Homo sapiens
  misc_feature: GYAE6OF02HJLT0.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggaggcttggtacagcctggggggtccctgagactctcctgtgcagcctctggattcacctttagcagctatgccatgagctggggtcccgccaggctccgaggggacgggtctgggagtggggtctcacttatcagtaatagtgggtgtaccactattcgacgcagactcccgtgaagggccgttcaccatctcagagacattaccaagacacactatacctgacaaatagaacgaccctagagacgaccgagacgacgaccatatatactgtgtagaaggggcgacggggtagaccgtccgtacggggaccgacggggaaccccgttggtacccgtacccggtccgtacccg

SEQ ID NO: 1463 - DNA, 798 bp, Homo sapiens
  misc_feature: GYAE6OF02G2ZYX.38.30.C08.1.454.CMB.1.raw
  modified_base (316)..(316): a, c, t, g, unknown or other
  misc_feature (316)..(316): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcggtgtcgtttcaaggtcggctaagtttaaaggtgtccatgtgaggtgcagttgttggagtcgtgggggaggcttggtacagccgtggggggtccctgagctctcctgtgcagcctctggattcacttagcagctatgcatgacgctaggtccgcgaggctaccgngggtacggtcgtgggagtcgggctcgtacttatctagtaattaggtagggtacggtacctacgtaacgtttcgaccgacgacgaaccgtttccggaacggaacggggtacccgtttacgaacctaacgttccctacccgaaaggaacgaaaccgtaaactttacccgaaaacgaaaccaaccgtaacctaaaccttaccgttaacgaactaaaacgttacgtaaaccgaaccccgttaggaaacggaccgaccgggttaaacggaaccgtaaaccccggggaaccctaaatttaaaacccggtttaattaaaccggtttcgggttaacgggtttaaggggtaaaaccggggggaaccggtaaccgggggggtttaacggtaaccccggttaaccccggggtttggggggaaccccgttaaaccggggggtaaaccccgttaccggggtttacccgtacccccgggtttaccctaaccccggg

SEQ ID NO: 1464 - DNA, 570 bp, Homo sapiens
  misc_feature: GYAE6OF02IT9JI.38.30.C08.1.454.CMB.1.raw
  modified_base (340)..(340): a, c, t, g, unknown or other
  misc_feature (340)..(340): n is a, c, g, or t
  modified_base (347)..(347): a, c, t, g, unknown or other
  misc_feature (347)..(347): n is a, c, g, or t
  modified_base (361)..(361): a, c, t, g, unknown or other
  misc_feature (361)..(361): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggcttttctagtggctatttaaaaggtgtcactgtgaggtgcagttgttggagtctgggggaggcttggtacagcctggggggtccctgagactctcctgtgcagcctctggattcacctttagcagctatgccatgagctgggtccgccaggctccagggaccggtctggagtgggtctcgacttancagtaanagtggtggtaccanattcgacgcagactccgtgaacggccggttcacctatctccagacgacaattccaaagtaaccacactatacctgacaaatcgaaagaccctagacgtacgaccgagaaccacgggacaatatactacgtgtgtaaggaacgggcgaacgggtgaaccgtccgtaggggacccaacgggtaacccgtggtaccgtaccgtccgtacccg

SEQ ID NO: 1465 - DNA, 654 bp, Homo sapiens
  misc_feature: GYAE6OF02FTB0M.38.30.C08.1.454.CMB.1.raw
  modified_base (154)..(154): a, c, t, g, unknown or other
  misc_feature (154)..(154): n is a, c, g, or t
  modified_base (173)..(173): a, c, t, g, unknown or other
  misc_feature (173)..(173): n is a, c, g, or t
  modified_base (175)..(175): a, c, t, g, unknown or other
  misc_feature (175)..(175): n is a, c, g, or t
  modified_base (178)..(178): a, c, t, g, unknown or other
  misc_feature (178)..(178): n is a, c, g, or t
  modified_base (182)..(183): a, c, t, g, unknown or other
  misc_feature (182)..(183): n is a, c, g, or t
  modified_base (186)..(186): a, c, t, g, unknown or other
  misc_feature (186)..(186): n is a, c, g, or t
  modified_base (189)..(189): a, c, t, g, unknown or other
  misc_feature (189)..(189): n is a, c, g, or t
  modified_base (192)..(192): a, c, t, g, unknown or other
  misc_feature (192)..(192): n is a, c, g, or t
  modified_base (196)..(196): a, c, t, g, unknown or other
  misc_feature (196)..(196): n is a, c, g, or t
  modified_base (201)..(202): a, c, t, g, unknown or other
  misc_feature (201)..(202): n is a, c, g, or t
  modified_base (210)..(210): a, c, t, g, unknown or other
  misc_feature (210)..(210): n is a, c, g, or t
  modified_base (213)..(213): a, c, t, g, unknown or other
  misc_feature (213)..(213): n is a, c, g, or t
  modified_base (217)..(217): a, c, t, g, unknown or other
  misc_feature (217)..(217): n is a, c, g, or t
  modified_base (219)..(219): a, c, t, g, unknown or other
  misc_feature (219)..(219): n is a, c, g, or t
  modified_base (222)..(222): a, c, t, g, unknown or other
  misc_feature (222)..(222): n is a, c, g, or t
  modified_base (246)..(246): a, c, t, g, unknown or other
  misc_feature (246)..(246): n is a, c, g, or t
  modified_base (253)..(253): a, c, t, g, unknown or other
  misc_feature (253)..(253): n is a, c, g, or t
  modified_base (306)..(306): a, c, t, g, unknown or other
  misc_feature (306)..(306): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcggngtgttcaggtgcattaagncntgnagtnngtntgntcngggnctgannctgggccnganctcncngtncagctctgattcacttgctgctgnccatgancgtggtccgcgaggctccgaggtacgggtctggaggtcggtctactacgttanacgtagtaagtgtggtacgtacctacgtacgttacggacgtacgtaacgtaccgtccggtaacggtaaccgggtcccgtaacaccgtacgtaccgtaccgtaacgaacgtaacgtaacgtaaccgtaaacgtaaccgtaacctaacctaaccttaacgtacgtaacgtaaacgtaacgtaaccgtaaccgtaacgtaacgacggaccggtaaccggaaccgaccgtaccgtaacgtagttaacgttacgtacgtacggtacggtaacgggtaacggtacgggtaccggtaccggtacggtacgggtaccggtaccggtaccggtacggtaccgtacccgtaccgtccg

SEQ ID NO: 1466 - DNA, 700 bp, Homo sapiens
  misc_feature: GYAE6OF02GLK45.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggaggcttggtacagccgtggggggtccctgagactctcctgtgcacgcctctggacttcacctttagcagctatgccatgagcgtcgggtcccgaccgaggcctccggacggggacgggtctgggaggttcgggtctctacgttatacgtaagtaattacggtgggtacggtacccacgtatttcggacgtcaacgtaccgtccgtagggaacggggtccccgggtttacaacccgtacgttaccctaccgaaggaacgtaaccttaaacttacccgaaaagtaaaccaccgtaacttaactacctacgaactaaaagtcgaaacgacccgtagaacggacgaccggaaggacccgaacggaccctaatacgttaactagttaggtagtaacgggaaacggggtcggaacggggttcgaacccgttccggtacggggaccgaacggggtaaccccgtgggtaccctacccggtccttaccccgg

SEQ ID NO: 1467 - DNA, 965 bp, Homo sapiens
  misc_feature: GYAE6OF02JHFS4.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggcttttctagtggctattttaaaggtgtccactgtgaggtgcagttgttggagtcgtgggggaggcttggtacagccgtgggggtccctgagactctcctgtgcagcctcgtggattctacctttagcagctatcgccatgagcgtcgggtcccgaccgaggcctccgacggggtaccgggtcgtgggacggttcgggtcctacgtaaccgttagtccgtaaggttaaacgtaggttacggggttacgggttaacccctaacgtacgtttaccggaccggtaccgtaacggtaacccgttcccggggtaagggaaaccgggggttccccgggtttacccgtaaacccgtacgtttacccgtacccgaaagggtaaaccggtaaaccgttaaaccgtttaacccgaaaaacgggtaaaaccctaaacccgtaaacccgtttaaacccgttaaaccccggttaaacggaaacccttaaaaaacggttacccgggtaaaaacccggttaaacccccgttaacgggtaaaaccggggaaacccgggtaacccccggggaaacggggtaaaccccgaaaccccgggggtaaaccccttaaaacgtttaaaccgtttaaaaccgttttaacccggtttaggggttaaccgtttaaaacgggggggtaaaacccgggggtcccgggttaaaccgggggttaacggggtccccggtttaaaccccggggtcggggggtaaaccccccggttaaccgggggtaaaccccccggtttcggggtacccccggttaaccccggtttccccgtttaacccccggg

SEQ ID NO: 1468 - DNA, 817 bp, Homo sapiens
  misc_feature: GYAE6OF02J22EX.38.30.C08.1.454.CMB.1.raw
tcagtcgatcacgtcacgaccggtgctcgatttagtctgacgtcaaagggaaagggtcgtgagagaggagcccagccctgggatttcaggtgtttcatttggtgatcaggactgaacagagagaactcaccatggagtttgggctgagctggcttttctagtggctatttaaaaggtgtccactgtgaggtgcagttgttggagtcgtgggggaggcttaggtacagcctggggggtccctggagactctcctgtgcgagcctctggattcacctttagccagtcctatcgccatgacgtctgggtacccgccaggtcctccgaggggtacgggttctgggacggttcggggtcctcgtaaccgtttagtaccaagggtttaaactggtacggggttagggtaacccctacgtaaacgtttccggaaccggcaacgggtaacccgttcccggttagggaaaccgggggtccccgggttttacaacccgtaacgttcccgtaccgtacggaaagtacccgtaaagtttcccgaaaacggaaccaaccgtaaaccgtacttaacccgttaggacctaaaacgtagtaaaccgacccgttacgaaggtaacccggaccggaacgggtaaccgtaaccgggacctaacttaaggttaactttaccgggttagttaccgggttaacgggtaaacgggggggtaaacccgtaggggggttaaccgtacccggtttacccgggtacgggggggacccccgtaaacggggggtaacccccgttacggggttccccggttaaaccccgggtccgtttaacccccgg

SEQ ID NO: 1469 - DNA, 556 bp, Homo sapiens
  misc_feature: GYAE6OF02F3KJR.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtctgggggaggcttggtacagcctggggggtccctgagactctcctgtgcagcctctggattcacctttagcagctatgccatgagctgggtcccgccaggctccgagggacgggtctgggagtgggtctcacttatcagtaatagtggtggtaccacattcgacgccagactccgtgaacggggccggttacaccatctccagacgacaattaccaagaaccacactatacctgacaaatagaacgaccctgacgacgaccgacggacaccggcaatatattactgtgtagaaggggcacggggtgacgtcgtgggcctacgggacccgtggtcctaccgtctcccg

SEQ ID NO: 1470 - DNA, 561 bp, Homo sapiens
  misc_feature: GYAE6OF02G4LQI.38.30.C08.1.454.CMB.1.raw
  modified_base (443)..(443): a, c, t, g, unknown or other
  misc_feature (443)..(443): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtctgggggaggcttggtacagcctggggggtccctggagactctcctgtgcagcctctggattcacctttagcagctatgccatgagctgggtccgccaggcctccgacggggacgggtcgtgggaggtggggtctcacttatcagtaatgtaggtggtaccacattcgacgcagacctccgtgaacggggccggttcaccatctccagagacaattccaagacacactataccngacaaatgaacgaccctgaagacgccgagaccacgccatatatactgtagtaggaagggcaggggtcgacgtccgtaggggacccgacgggaaccctcgggtaccaccgtcctacccg

SEQ ID NO: 1471 - DNA, 752 bp, Homo sapiens
  misc_feature: GYAE6OF02GCO2I.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggcgttttcaggtggctattttaaaaggtgtccactgtgaggtgcagttgttggagtctgggggaggcttgggtacagcctggggggtccctgagactctcctgtgcagcctcgtgattcacctttagcagctatgcctatggacgtctcggggtcccgccgacggtcctccgaacggggtaccggtcgtgggtacggttcgggtcctactactttacgactaacggttaaagttacggttaggggttcggttaaacccacgtaacgtttaccggacgtaccgacgtaaccgttccggtaagggaacggggtcccggttaacacccgtacgttccaccgaaggaacgtaacctaattaccgaaaagaacctaacctaacttaactaccttacggaactaaaacgttcggaaaacctaccccgtaggaaacgaaccggtcccggaagggtaaccacccgggactaaacgtaagtttaaacgttacgttcggtagtaccggggtaaaggggtccggaacgggggtacgtaacccggtcggtacccgggggaccgtaccggggtaaacccgttcggaacccgttacccggttccttaccccg

SEQ ID NO: 1472 - DNA, 567 bp, Homo sapiens
  misc_feature: GYAE6OF02JHRGD.38.30.C08.1.454.CMB.1.raw
  modified_base (330)..(330): a, c, t, g, unknown or other
  misc_feature (330)..(330): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtctgggggaggcttggtacagcctggggggtccctgagactctcctgtgcagcctctggattcacctttagcagctatgccatgagctgggtccgccaggctccgaggggacgggtctgggngtcgggtctcacttatcgagtaataggtggtcggtacactattcgacgcagactccgtgaacgggccgtacacagtcctccagacgacaattccaagaaccacactatacctgacaaatgaacgacctgaagacgaccgaggacacggcatatatacgtgtgtagaacggggcacggggtagtaccgtccgtaggggaccctacggggaacccctgggtaccctaccggtctacccg

SEQ ID NO: 1473 - DNA, 718 bp, Homo sapiens
  misc_feature: GYAE6OF02JCANK.38.30.C08.1.454.CMB.1.raw
  modified_base (185)..(185): a, c, t, g, unknown or other
  misc_feature (185)..(185): n is a, c, g, or t
  modified_base (277)..(277): a, c, t, g, unknown or other
  misc_feature (277)..(277): n is a, c, g, or t
  modified_base (404)..(404): a, c, t, g, unknown or other
  misc_feature (404)..(404): n is a, c, g, or t
  modified_base (576)..(576): a, c, t, g, unknown or other
  misc_feature (576)..(576): n is a, c, g, or t
tcagtcgatcacgtcacgaccggtgctcgatttagtctgacgtcaaagggaaaggggtctgagagaggagccccagccctgggattttcagggtgttttcatttggtgatcaggactgaacagagagaactcaccatggagtttgggctgagcggtcgtcgtttccaaggtggctatttaaaggntcatgtgagtgctagttgtgacgtcgtgggggacgtcttaggtacgaggccgtgggggtcctgagtacttcgtcctggtagcagcctaacgngggaacttccaacgtttagcctagtactagttcgcctagtcgacgtcgttcgggtacccgacgtacgggtccgtacccgaggggtaccgggtacgttgggacggttcggggtactacgtacgtttanaccgtaggtaaatacggttcggtacgtaacctaccagtttaccgacgtacgaacgaccgttccggtacgaacgggtcccggtttacacctataccgttctaacgacgtaaacttaacgttaccaaacgaacctacgtaacttaacttactagtaactatacgtacgtaccgnggaacgcgtaccgaggacacggtactaacgtatacgttacgtgtcggtaaggtaaccgggtaggtaccggttagtaacccgttcgggtaccgggtacccgtaaccgggtaccccgttacggtccgtaaccggttcctaccgg

SEQ ID NO: 1474 - DNA, 621 bp, Homo sapiens
  misc_feature: GYAE6OF02IKY2I.38.30.C08.1.454.CMB.1.raw
  modified_base (257)..(257): a, c, t, g, unknown or other
  misc_feature (257)..(257): n is a, c, g, or t
  modified_base (293)..(293): a, c, t, g, unknown or other
  misc_feature (293)..(293): n is a, c, g, or t
  modified_base (304)..(304): a, c, t, g, unknown or other
  misc_feature (304)..(304): n is a, c, g, or t
  modified_base (389)..(389): a, c, t, g, unknown or other
  misc_feature (389)..(389): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgtgtttcagtggctatttaaaggtgtccactgtgaggtgcagttgttggagtcgtgggggagcgttggtacagccgtggggggtccctgagactctcctgtgcngcctctggtattcacctttgcagtctatcgcattgngcgtgggtccnccgaggctccgaggggtccggtgtgggtgtgggtctactactatcgaagttagtacgtggtaggtacccagtacttacggaaccncgacgtaccgtcggtaggtaccggtccggtctaactacgtcgacgacgacgtaactactaacgaacaactacactactacgtagaactaaacgtacgaacgaccgtagacgacggaccgagaccgacgactagtactagttactagtacggtacggtacgggacggtacgggtcgtaccggtacggtaccggggacgtaccgggtaccgtccggaccgtcccgtaccgtccg

SEQ ID NO: 1475 - DNA, 776 bp, Homo sapiens
  misc_feature: GYAE6OF02I8H8D.38.30.C08.1.454.CMB.1.raw
tcagtcgatcacgtcacgaccggtgctcgatttagtctgacgtcaaagggaaaggggtctggagagaggtagcccagccctgggattttcaggtgtttcatttggtgatcaaggactgaacagagagaactcaccatggagtttgggctgagcgtggcgttttctagtggctattttaaaggtgtccactgtgaggtgcgagttgttggagtcgtggggagtcgttggtacagccgtgggggtccctgagactctcctgtgcagcctctggacttcaccttagctagtctagtcgccagtcgacgtcgtcggtcccgacgaggtcctccggacggggtacgggttcgtcgggtaacggttcggggtcctccggtacgttacgtaccgtaagttaagtacggttacggtacgggttaacccaacgtacgtttacggacgacgaacgtacccttaccggtacggaaaccgggttcccggtaacctaaccgtacgtaccctaccgtaacgtaacgtaaccttaaacgttacccgaaaacggtaacctaaccctaaccgttaacgttaacccgttacgaacctaaaacgtacggtaaaccgtacccgtaggtaacgtaccggtacccggtaacggaccgaaccggtacccgtaactaacgttaacgttaccgtaggttacggtaacgggtaacggggtaccggtaccgggttacgtacccgtacggtacggtaccgggtaaccgggttacccgtacggtaccgtacccgttcgtaccccg

SEQ ID NO: 1476 - DNA, 618 bp, Homo sapiens
  misc_feature: GYAE6OF02F1MIU.38.30.C08.1.454.CMB.1.raw
  modified_base (461)..(461): a, c, t, g, unknown or other
  misc_feature (461)..(461): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtctgggggaggcttggtacagccgtggggggtccctgagactctcctgtgcagcctctggattcacctttagcagctatgccatgagctgggtccgccgaggcctccgaggggacgggtcgtgggagtgggtctcgacttatcgagtaataggtggtggtaaccactattcgacgcagacctccgtggaagggtccgttacacctatcctacgacgacgactaacttaccaaagtaaccactaactactaccngacaatgaacgtaccctgaacgacggacccgaaggaccgacgggcctaattactaattacgtgttaggtaggaaacgggggcgacggggtgaacccgttccggtacgggggacccgtaacggggtaccccgttgggacccgttaccggtctaccccg

SEQ ID NO: 1477 - DNA, 797 bp, Homo sapiens
  misc_feature: GYAE6OF02H1L8X.38.30.C08.1.454.CMB.1.raw
  modified_base (244)..(244): a, c, t, g, unknown or other
  misc_feature (244)..(244): n is a, c, g, or t
tcagtcgatcacgtcacgaccggtgctcgatttagtctgacgtcaaagggaaagggtctgagagaggagcccagccctgggattttcaggtgttttcatttggtgatcaggactgaacagagagaactcaccatggagtttgggctgagctggtcttttctagtggctattttaaaaggtgtccactgtgaggtgcagttgtggagtcgtgggggaggcttggtacagccgtgggggtccctgngactctcctgtgcagccctctggattcctaccgtttagccagtctatcgccatgagtcgtgggcccgcacggccgtccgaggggtacggtcgtgggagtgggtcctctaacgttatcgtaagtaaatacggttggtacggttaacccagtacgttccgaacgcgtaacgaccgttccggtagggtaaaccggggtcccgtttaccgtaacccacttcccgtaccgaaggaacgacctaaacgttacccaaacgaaacctaaccctaacttaaaccgtaacccgtagtaaaccctaaagttaaacgaaccgtaaaccccttaggaaccggaaccggaaccccgggaaacggaacccgtaaaccgggtaccccgtaaatttaaaccgtttaactttaaaccggtttggttaacgggtaacgggggtaaaacggggtccgggttaaaccggggggtcccgtaacccggttacccggggtaccgggggtaacccggtaacccgggggtaacccccggttcggggtaacccccttacccgggttccgtaaccccccgg

SEQ ID NO: 1478 - DNA, 706 bp, Homo sapiens
  misc_feature: GYAE6OF02GV21I.38.30.C08.1.454.CMB.1.raw
tcagtcgatcacgtcacgaccggtgctcgatttagtctgacgtcaaagggaaaggggttcgtgagagaggagcccagccctgggattttcaggtgttttcatttcggtgatcaggactgaacagagagaactcaccatggagtttgggctgagctggcttttctagtggctattttaaaaggtgtccactgtgacggtgcagttgttggagtcgtgggggaggcttggtacagccgtggggggtccctggagactctcctgtgcacgtcctctggacttcacctttagcaggtctagtcgaccatgacgtctacgggtcccgccaggtcctccgaggggcggtccgtgggagggttcgggtcctcgtacgttagtccgaagttaactaggttgggtacggttacctaacgtacgtttaccgacggtccgtaacgtacccgttacccggtaggtaaaccgggggtcccggtttaccaacccgtacgttcccttccggaaacgtaacggaaccttaaacgtttaccaaacggtaaacctacctaacttaactacccgtagaacaaacttagaaccgtaccgtagacgaagccgtaagacgacgaccaatatattacgtgtagttacggaagggtaccgtacgggtactaccgttccgtgggaacccggtacggtaaccccgtcggtaacccgtaccggtccttacccg

SEQ ID NO: 1479 - DNA, 750 bp, Homo sapiens
  misc_feature: GYAE6OF02HP2ZD.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggcttttctagtggctaatttaaaaggtgtccactgtgaggtgcagttgttggagtcgtgggggagcttggtacagccgtggggggtccctgagactctcctgtgcagcctcgtggattccacctttagcagctatgccatgagcgtgggtccgaccgaggcctccgagggacggtctgggagtcgggtctcgtacttatacgaagtaaagtaggtgggtacgtacccaacgtagtttaccgaacgctaacgaccttacccggaggtaaccggggtccggtttaaccacccgtaatcccgtaaccgaggtaacgtaccaaacgttaaccaaaacgaacccaacctaaaccgttaaacctaaccgtacgaactaaaacgacgtaaaacgaccccttaggaaacggaaccggacccggaaacggaacccgaacggtaaccctaaagttaaacttaactttaaccgtaggttaggttaacgggtaaaacgggggccggtaaccgggggttacgacccggttacccgggtacgggggacccgtaaacccgggggaacccccgtttaggggaaccccgttaccccggtacccgttaaccccgg

SEQ ID NO: 1480 - DNA, 610 bp, Homo sapiens
  misc_feature: GYAE6OF02IBQZC.38.30.C08.1.454.CMB.1.raw
  modified_base (293)..(293): a, c, t, g, unknown or other
  misc_feature (293)..(293): n is a, c, g, or t
  modified_base (328)..(328): a, c, t, g, unknown or other
  misc_feature (328)..(328): n is a, c, g, or t
  modified_base (349)..(349): a, c, t, g, unknown or other
  misc_feature (349)..(349): n is a, c, g, or t
  modified_base (372)..(372): a, c, t, g, unknown or other
  misc_feature (372)..(372): n is a, c, g, or t
  modified_base (382)..(382): a, c, t, g, unknown or other
  misc_feature (382)..(382): n is a, c, g, or t
  modified_base (602)..(602): a, c, t, g, unknown or other
  misc_feature (602)..(602): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggcttttctagtggctaagtttaaaggtgtccatgtgaggtgcagttgttggagtcgtgggggagcgttggtacagccgtggggggtccctgagctctcctgtgcagcctctggacttcacctttagcagctatgcatgngtcgtcgggtccacgaggcctacggagggccggtntgggagttgggctctacttancgagtaatacgtgtaggtaaccnattcgacgtnaggctcgtaggacggcgttcacgatccgacagacgaacaattaccgaagaacgactaacgtacaccgttagaactaaacgtcgaaacgtaccgagacgacgaccggagaccgacgacctagtaactagtactcggtgtaacgggtaagggtccgtaggggttcgaccggtaccgtccggggaaccgtaccgggaaacccgtcgggtccgtaaccccggtntaccccgg

SEQ ID NO: 1481 - DNA, 709 bp, Homo sapiens
  misc_feature: GYAE6OF02HDDNM.38.30.C08.1.454.CMB.1.raw
tcagtcgatcacgtcacgaccggtgctcgatttagtctgacgtcaaagggtaaaggggttcgtgagaggaggagcccagccctgggattttcgaggtgttttcagttttcggtgatcaggactggaacagagagaactcaccatgggagtttgggctgagcgtggctttttctagtggctattttaaaggtgtccactgtgaggtgctagttgttggaggtcgtggggagcttggtacagccgtggggggtccctggagactctccgtgtgctagtccttagtggatttccaaccgtttagcgagctactcggcctatgaagtccgtgggtcccgccgacggcctaccgagggggtaccggttctacgggaggttcgggtacctactacgtttagtccgaagttaacgtaggtggtacgtaccacgtagttacgacgtctacgtaccttccggtacgaacggggtcccgtttacaccgagttccgtaccgaagacggaactaacgtttaccaacgaaacctacgtactacgttaaccctgaaacctaaagtacgaaaccgtcccgttaggaacgtaccgacggaacgaccgacggtaaccaatttaacggaattcgtagggtgtaacgggaagggccggtacgggtctaccgttaccggaggggacccgtaacgggccctttcggggtaccctccgggttacctcccgg

SEQ ID NO: 1482 - DNA, 633 bp, Homo sapiens
  misc_feature: GYAE6OF02GWZ0Y.38.30.C08.1.454.CMB.1.raw
  modified_base (181)..(181): a, c, t, g, unknown or other
  misc_feature (181)..(181): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
tcagtcgatcacgtcacgaccggtgctcgatttagtctgacgtcaaagggaaaggggtctgagagaggagcccagccctgggattttcaggtgtttcatttggtgatcaggactgaacagagagaactcaccatggagtttgggctgagcggtcgtggttcaaggtcggctatttaaaggntcatgtgagtgcagtgtggatcgtgggagntggacngcctgggggtcctggagctctcctgtagcagcctcgtaggattcgaccgtttagcgtagtctacgtcgcgtgtgtcgtcgtcggtcgcgacgtcgtacgacggtcggtcgtggtggtcgtcgtcgtacgtacgtacgtagtagtagtacggtacgtacgtacgtacgtacgacgacgacgtacgtacggtacggtacggtaccgtaccgtaccgtacgtacgtacgtacgtacgtacgtaacgtaacgtaacgtaactactaactacgtacgtacgacgtaacgtacgacgtaccgtacgacgacgacgacgacgacgtactacgtactactacgtgtagtacggtacggtacggtacggtacggtacgtacggtcggaccggtacggtaccgtaccggtaccgtaccgtcgtccg

SEQ ID NO: 1483 - DNA, 829 bp, Homo sapiens
  misc_feature: GYAE6OF02GEQW3.38.30.C08.1.454.CMB.1.raw
  modified_base (303)..(303): a, c, t, g, unknown or other
  misc_feature (303)..(303): n is a, c, g, or t
  modified_base (722)..(722): a, c, t, g, unknown or other
  misc_feature (722)..(722): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgcgttttcaggtcggctaattttaaaggtgtccactgtgaggtgctagttgttggagtcgtgggggaggcttgggtacagccggtggggggtccctggagactccttccgtgtcgcgagcctcgtggtatctaccgtttagccagcttancgccatggacgtcgtcgggtccgccgacggccgttacccggacggggtacggggttccgtagggtacgggttcgggttacctcgtacgtttaacgtaccgtaagttaacgttaaggttagggttaaccgggttaacccgtaacgttacgtttacccggaaccggttacgaacccggttaccgttaccccgggttacgggaaaccggggggttccccggtttaacccgtaacccgttaccggttacccttaacccggaaaggtaaccggtaaaccttaaaccgttaaacccgaaacgttaaaaccccaacgtaacccgttaaacttaacccggacgttaacctaaagttaaccggaaaccgtacccggtagaacgaaccggcgggaaccgaccgaccgacctaagttacttacgttacgngttacgggagggtaaccgggcggtaaccgggtacgtacccggttaccgggacgggtacccggaaccgggttaccccggtaggtaccccgtaccggtccgttaccccg

SEQ ID NO: 1484 - DNA, 719 bp, Homo sapiens
  misc_feature: GYAE6OF02JD5OL.38.30.C08.1.454.CMB.1.raw
tcagtcgatcacgtcacgaccggtgctcgatttagtctgacgtcaaagggaaggggtcgtgagagagggagcccgagcccctgggattttcagggtagttttcactttggttcgattcgaggactgaacagagagaactcaccatggagtttgggctgagctggctttttctagtggctattttaaaaggtgtccactgtgaggtgcagttgttggagtcgtgggggagcttggtacagccgtggggggtccctgagctctcctgtgcagcctctggattcacctttagcagtctatcgcctagtgacgtcgttcggggtcccgccgtaggccttaccggaacgggggtaccggggtcgtggggtacggttcggggttccttccgtaaccgtttatacgtaagttaacgttaggttaggggttacggtaaccccgtataacgttttccggacgtaccgaacggtacccgttacccgggtaggtaaaccgggggtcccgggtttaccaaacccgtctacccgttacccgaaggtaacgtaactaaacttaccgaaagtaaccactacgttaactaccctagaacctaagtacgaacctacccgtagaacggtacgccggacgaacgtaccgacctattatacttacgtgtagtagggaagggccgtagggtcaccgttcggacggaccgtacggacccgttggaccgtacctcgtacccg

SEQ ID NO: 1485 - DNA, 655 bp, Homo sapiens
  misc_feature: GYAE6OF02HP3WT.38.30.C08.1.454.CMB.1.raw
  modified_base (304)..(304): a, c, t, g, unknown or other
  misc_feature (304)..(304): n is a, c, g, or t
  modified_base (344)..(344): a, c, t, g, unknown or other
  misc_feature (344)..(344): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggagcttggtacagccgtggggggtccctgagactctcctgtgcagcctctggattcacctttagcagctatgccatgagctgggtccnccaggctccgagggacggtctgggagtgggtctcacttancagtaatagtggtgtacactattcgacgcagtactccgtaggaacgggtccgttacaccatctccaagacgaacaattacaaagaacaacactactaaccgtagacaaagtacgaaacgacccgtagaagacggtaccggaacggaaccgaaccgggacctaacgttaataacgtttaaccgtaggttacgtaagggaaacgggggaccggtaacgggggtacggtaaccggttacccggtacggggggtacccgaaccgggggtaaaccccgttcgggtaaccccggtacccgttacccgttaaccccgg

SEQ ID NO: 1486 - DNA, 756 bp, Homo sapiens
  misc_feature: GYAE6OF02IF7O5.38.30.C08.1.454.CMB.1.raw
  modified_base (613)..(613): a, c, t, g, unknown or other
  misc_feature (613)..(613): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttcagtggtcttaatttaaaaggtgtccactgtgaggtgctagttggttggagtcgtgggggagtcgttaggtacacggccggtcgggggggtcccctggacgtaccgttccgtcccgtggtcgaccgacggtcccttcgtagggtactttacctaccgttttaggaccaagccttaagtcgacctagtggacgtcggttccgggacccgccgaggtccgtaccgaaggggtacgggtccgtagggtacgggttcgggttcctcgttaacttacgtacgtaaagttaaacgttaggttacggtaccgggtaacctaacgtacgtttaccggaaccgacgtaacgtaacccgtcccgggttaaggaacccggggttcccggtttaccaacccgtagttccctaaccgaagacgaaacctacgttaaccgaaagaacctaccaaacttacacgtanaacgtaaatacgaaacgacccgtagaccgaacgccgaacggactaccgagaatactagttactggtacgaagggacggccggagggtacgtaccgtcggtccgggaccgaacggtaacccgtgtaccgtacccgtcctacccg

SEQ ID NO: 1487 - DNA, 864 bp, Homo sapiens
  misc_feature: GYAE6OF02JZPEE.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggctatttaaaaggtgtccactgtgaggtgctagttggttggagtcgtgggggaggctttagggtacagccgtggggggtccctggacgtactcctccgtgtcgcgacgtcctcgtggtacttctacctttagcagtctagtcgcctatgagtccgtcgggtcccgccggaggtctaccggaggggaccgggtcgtagggacgttgggtctccgtacgttagtctaaggttaagttggttcgggttacggtacctaacgtacgtttcggacgtacgtaacggtaccgtaccgggttacgggaacggggtcccggtttaaccacccgttacgttacccgtaccgaaacgggtaacgtaaccgtaaaccgtttaacccgaaaacggtaaacccgtaaaccgtaaacccttaaccgttaaaccccgtacggtaaaccctaaaacggtaaccgtaaaacccgtacccggttaagtaaccgggtaaccgaacccgggtaaaccgggaaacccggaaccgggtaacccgttaaagttaaacgtttaaccgtttaacggtacgggtttacggtaacggggtaaaccggggtacggtaacccggggggttacgtaacccgggttcccggggtaaccggggacccggtaacccgggggtaaccccgttaccggggtacccgttacccgggtttacccgtacccccgg

SEQ ID NO: 1488 - DNA, 666 bp, Homo sapiens
  misc_feature: GYAE6OF02I6QAF.38.30.C08.1.454.CMB.1.raw
  modified_base (198)..(198): a, c, t, g, unknown or other
  misc_feature (198)..(198): n is a, c, g, or t
  modified_base (211)..(211): a, c, t, g, unknown or other
  misc_feature (211)..(211): n is a, c, g, or t
  modified_base (217)..(217): a, c, t, g, unknown or other
  misc_feature (217)..(217): n is a, c, g, or t
  modified_base (225)..(225): a, c, t, g, unknown or other
  misc_feature (225)..(225): n is a, c, g, or t
  modified_base (252)..(252): a, c, t, g, unknown or other
  misc_feature (252)..(252): n is a, c, g, or t
  modified_base (314)..(314): a, c, t, g, unknown or other
  misc_feature (314)..(314): n is a, c, g, or t
  modified_base (347)..(347): a, c, t, g, unknown or other
  misc_feature (347)..(347): n is a, c, g, or t
  modified_base (471)..(471): a, c, t, g, unknown or other
  misc_feature (471)..(471): n is a, c, g, or t
  modified_base (477)..(477): a, c, t, g, unknown or other
  misc_feature (477)..(477): n is a, c, g, or t
  modified_base (571)..(571): a, c, t, g, unknown or other
  misc_feature (571)..(571): n is a, c, g, or t
  modified_base (645)..(645): a, c, t, g, unknown or other
  misc_feature (645)..(645): n is a, c, g, or t
  modified_base (657)..(657): a, c, t, g, unknown or other
  misc_feature (657)..(657): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttggctgagtcgtgtcgtttcgaaggtcggctaagttaaaggtgtcgatgtgagtgtnagttgtggagtgnggggangtggtacngtccggtggggtcctagagtctctcgngtgccagcctgagtctcgtaccgttgcgagtacttgcgtccagtgatcggttaacgccgcgngtcgccgtaggcggtacgtggtagtcggtaccngtagttacgtacgtagtaaaggttggtacgtaggttacccattaacggttacgaacgtctaacgtaccgttccggtaagggcggttacgtaacgcgtactacgtcacgtaagatacctaaacgngaaacnctacgaacttacgtaactacaacggttaacaagaaccgtaccgtagaaccgaggaccgaaaggactcgaaacgttataaaccgtatttaccggngttaacggaacgggtaacggttaccgggacgtttaaccgggcgttacggaccggtaacgaccgggttaacccgngggtttaacccnccggtaacc

SEQ ID NO: 1489 - DNA, 678 bp, Homo sapiens
  misc_feature: GYAE6OF02G2P96.38.30.C08.1.454.CMB.1.raw
  modified_base (367)..(367): a, c, t, g, unknown or other
  misc_feature (367)..(367): n is a, c, g, or t
  modified_base (628)..(628): a, c, t, g, unknown or other
  misc_feature (628)..(628): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggtcgttttcaaggtggctatttaaaaggtgtccactgtgaggtgcagttgttggagtcgtgggggagtcgttggtaccaggtccgtgggggggttccctggacgtactcctccgtgtgcacgcctctggattcctacctttagcagctagtcgccagtgacgtcgtcggggtcccgccggaggccgtacccggaggggtccgggtcggtgggnggttcgggtctctacgttactcgtaagtaacgtaggtcggtacggtaaccatacgttacgacgtcaacgtccgtcggtacggacgggtcccgtacacccgtatccgtacctaagaacgaactaaccgtacaaacgaacctaacgaacttaccgtaacacgaacaaacgtacgaaccgacctaggaacgacggaccggaacgtcaaccggtactaagtacttaagttaccgtggtacgtagggaacgggtcggaacggggtntccggtaccggcgggtacgaccggtaccgtgtacccgaccgtccgtaccg

SEQ ID NO: 1490 - DNA, 660 bp, Homo sapiens
  misc_feature: GYAE6OF02GB8XZ.38.30.C08.1.454.CMB.1.raw
  modified_base (515)..(515): a, c, t, g, unknown or other
  misc_feature (515)..(515): n is a, c, g, or t
tcagtcgatcacgtcacgaccggtgctcgatttagtctgacgtcaaagggaaaggggtctgagagaggagcccagccctgggattttcaggtgtttcatttggtgatcaggactgaacagagagaactcaccatggagtttgggctgagcgtggcttttctagtggctatttaaaggtgtccactgtgaggtgcagttgtggagtctgggggagcttggtacagcctggggggtccctgagactctcctgtgcagcctcgtggacttcacctttagctagctagtcgccatcgagtcgtcgggtccgccagggcctacccgagggggtcggtcgtagggacggttggggtcctcgtaactttacgtcctaggttaactaggtaggtcggtaaccactacgtttccggaacgcaacgtaccgttccggtagggaacgggtcccgggtttacaaccgtatcccgtaccgaagacgacctaaagtttacccaaagtaccaacctaactactaaccgtnaacctaagagaacgaccctagagaccggcggacgtacgacggtaccattagtaacttacgttacgtgtaggaacggggcgtacggggtacaaccgttccggtcgggacgtaccgggtaaccgttcggacccgtacggtcctaccg

SEQ ID NO: 1491 - DNA, 843 bp, Homo sapiens
  misc_feature: GYAE6OF02JCV1Y.38.30.C08.1.454.CMB.1.raw
tcagtcgatcacgtcacgaccggtgctcgatttagtctgacgtcaaagggaaaggggtcgtgagagaggagcccagccctgggattttcaggtgttttcatttggtgatcaggactgaacagagtagaactcaccatggagtttgggctgagctggctttttctagtggctatttaaaggtgtccactgtgaggtgcagttgttggatcgtgggggagcttgggtacaggccgtggggggtccctggacgtacttcgtcctggtcgcgacgccttcgtggtacttctaccgtttagccgaagtcgtaattcggccctatagacgtcgtcgggtacccggccgtacggcctaccggaagggggtaccgggtcgtacggggtacggttccgggggtaccttccgtaaccgttttagaccgttaaagggttaaacttacggggttagggtaccggggttaacccaacttacggtttacccgggacgaccgtacggtaacccttcccggggttaacgggaaacggggggtccccgttttacggaaccctacgttacccgttacccgaaggaccgtaacgtaacttacccgaaaaggtaaccaactacccgttaacttaaccgtacggtaactaaacgtaggaaacccgtacccgtaaggtaacggaccgtaccggaaacgggaaccgtaaccgggaccctaaagttaacgttaacttaccggttagtaccgggttaaggaaacgggggtaccgtaacggggggttctaaccccggtacggggttccgggaaccggtaaccggggtacccccttaggggttacccctaacccgggttgtaacccccgg

SEQ ID NO: 1492 - DNA, 828 bp, Homo sapiens
  misc_feature: GYAE6OF02GQ418.38.30.C08.1.454.CMB.1.raw
  modified_base (323)..(323): a, c, t, g, unknown or other
  misc_feature (323)..(323): n is a, c, g, or t
  modified_base (616)..(616): a, c, t, g, unknown or other
  misc_feature (616)..(616): n is a, c, g, or t
tcagtcgatcacgtcacgaccggtgctcgatttagtctgacgtcaaagggaaaggggtctgagagaggagcccagcccctgggattttcaggtgttttcatttggtgatcgaggactgaacagagagaactcaccatggagtttgggctgagctggtctttttctagtggcttattttaaaaggtgtccactgtggaggtgctagttgttggagtcgtgggggaggtcgttggtacgacgtccgtggggggtccctggaagtctctcctgtcgcacgcctcgtggtattctacctttagctagtccttagtcgaccagttggngtccggttacgggtcccgccggtacggtccgtacccgggacgggggtacggttccggtgggtacgggttcgggttcctacgtaccgtttaactaccgtaaggttaagttacggttcggggtacgttaaccgaactacggtttaccgaaccgcgtaacggtaaccggtccggtaacgggtaacccggggttcccgggttaaccctaacccgtacgttacccgttaaccgaacggttaaacgaacgttaaaccttaccgaaaacgtaaacaccctaaacgtcttaaaacccggtnaaaccgtaaaacgtcgtaaacccgtaccgtaagaccggaaccgtaccggaacggaccgaacccggtacctaaagtttacttaaacgtttaccgttaggtaccggttaaaggggaacgggtacgggtacgggggtaacttacccggttccgggtacggggtacccgaacggggttaaccccgttggtaccccggtacccgttccgtaaccccg

SEQ ID NO: 1493 - DNA, 683 bp, Homo sapiens
  misc_feature: GYAE6OF02H7FNU.38.30.C08.1.454.CMB.1.raw
  modified_base (224)..(224): a, c, t, g, unknown or other
  misc_feature (224)..(224): n is a, c, g, or t
  modified_base (279)..(279): a, c, t, g, unknown or other
  misc_feature (279)..(279): n is a, c, g, or t
  modified_base (292)..(292): a, c, t, g, unknown or other
  misc_feature (292)..(292): n is a, c, g, or t
tcagtcgatcacgtcacgaccggtgctcgatttagtctgacgtcaaagggaaaggggtctgagagaggagcccagccctgggatttcaggtgttttcatttggtgatcaggactgaacagagagaactcaccatggagtttgggctgagctggcttttctagtggctatttaaaaggtgtccactgtgaggtgcagtgttggagtcgtgggggaggcttggtanagccgtgggggtccctgagctctcctgtgcagcctctggactcacctttagcagntatcgccatgagngtcggtccgctaggcctcgtaggacggtctggagtggtctcgtactatgaagtaactagtggtagtaccaacgtattcgacgtcacgaacctccgtgaaacggggtccggttacccaccgtaagtcccgtaccgacggagtaaaccacgttaccgaaaagaacaaccaacgtaacaacctttgaaacccaaatacgtaaacacccgttaagaggtaaccggacccgaaacgaccgaacccggtacctaaactaagtaaaccttaacgtacggttgggtaacggaaacggggaccggttaaccggggtacggtaaccggttacccggttagggggaacccgtaccgggaaacccgttacccggggtacctaccggttaccccgttaacccgg

SEQ ID NO: 1494 - DNA, 547 bp, Homo sapiens
  misc_feature: GYAE6OF02II8UA.38.30.C08.1.454.CMB.1.raw
  modified_base (423)..(423): a, c, t, g, unknown or other
  misc_feature (423)..(423): n is a, c, g, or t
  modified_base (449)..(449): a, c, t, g, unknown or other
  misc_feature (449)..(449): n is a, c, g, or t
  modified_base (467)..(467): a, c, t, g, unknown or other
  misc_feature (467)..(467): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggtctttttctagtggctattttaaaaaggtgtccactgtgaggtgcagttgttggagtcgtgggggagcttggtacagcctggggggtccctgagactctcctgtgcagcctctggattccacctttagcagctatgccatgagcgttgggtcccgccaggcctccgaggggacgggtctgggagttgggtctcgacttatcagtaatggtgtcggtacacagtttcgacgcagactcgtaggaacggtccggttcaccatctacaganactattaccaagaacacatactactnacaaatacaacacctganaggccgagacacggcaatatatatgtagtgaagggcacgggtcacgtcgacgggcgacggaccgtggacctccgtctccg

SEQ ID NO: 1495 - DNA, 816 bp, Homo sapiens
  misc_feature: GYAE6OF02IE2N0.38.30.C08.1.454.CMB.1.raw
  modified_base (352)..(352): a, c, t, g, unknown or other
  misc_feature (352)..(352): n is a, c, g, or t
  modified_base (379)..(379): a, c, t, g, unknown or other
  misc_feature (379)..(379): n is a, c, g, or t
tcagtcgatcacgtcacgaccggtgctcgatttagtctgacgtcaaagggaaagggtctgagagaggagcccagccctgggattttcaggtgttttcatttggtgatcaggactgaacagagagaactccaccatggagtttgggctgaactggtcttttctcgtggcttaagtttaaaaggtgtccagtgtgaggtgcagctgttggagtcgtggggaggtcgttggacaggccgtggggggtccctagacgctcgtccgtgtgcagcctcgtggtacttcctaacctttaagtaattatcgccatagaacgtcggtccgacgacggccgtaccgaaggggaacgggtcgnggtaggtcggtctcgtatcgtagtagngtacgcgttaggtcgggtagggtacgggacgtacggaaccttacgacgtaacggaccgttccggtaacggggaacccgggttacccggttacccaaccgtttacgttaacccgtaaacggacgtaaaccgttaaaccgttacccgaaaacgtaaacccgtacccggtaacttcggtttacccttaaccgttaaggtttaaaccgtaaccgtaaaccgtacccggttaacgtaccggtaaagtaccggtaaccgggaaacggtaacccgaaaccggtacctaaagttaaacgtttaaacgttaagtaccggttaacggtaaccgaaaaggttcgtttaagggggtcggggttacggtcccgtttaacggtccccgtttacggtaacccggtccggttacccggggtaaccggtaaccccggggtacccgttacccggg

SEQ ID NO: 1496 - DNA, 838 bp, Homo sapiens
  misc_feature: GYAE6OF02GWLH2.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggctattttaaaaggtgtccactgtgaggtgcagttgttggagttcgtggggggaggtcgttgggtacagtccggttgggggggttccctggacgtactctcctggtgcagcctctggtacttctaaccttttgcctagctagtcgccatgagccgtcgggtcccgcgacggcctaccggaggggccggtcgtgggaggtcgggtctacgttaacgttatactaagtaagttacggtgggttacgtacctacgtacgtttcgacggttaccaagtaccgtacccgggtaggtaaccggggtcccgtttaccgaccctcgttaccgtaccgtaaggaacgtaacctaaaccgttaccgaaacgaacctaaaccgtaacctaacgttaacccgtactaaacgtaaaccgtacgtaaaacccggtcccgttaaggaaccggaacccgggtacccgggaaaccggggaaccctaacccggggtaaccctaaacgtttaaacgtttaaccgttttaacccggttagggttacgggttaaacggggtaaccggggggtacccgggttaaaccgggggttacggtaacccccgttacccggggtaccgggggaccccggttaaccgggggacccccggtttaccgggtaccccgttacccccggttccgttacccccgg

SEQ ID NO: 1497 - DNA, 756 bp, Homo sapiens
  misc_feature: GYAE6OF02GXKVE.38.30.C08.1.454.CMB.1.raw
  modified_base (503)..(503): a, c, t, g, unknown or other
  misc_feature (503)..(503): n is a, c, g, or t
tcagtcgatcacgtcacgaccggtgctcgatttagtctgacgtcaaaagggaaaggggtctgagagaggagcccagccctgggattttcaggtgttttcatttggtgatcaggactgaacagagagaactcaaccatggagtttgggctgagctggtcttttctagtggctattttaaaaggtgtccactgtgtaggtgcagttgttggagtcgtgggggagcttggtacagccgtgggggtccctgagtactctcctgtgcgtacgcctctggacttaccgtaccctttaagccgtaggtacctagtcgccctaagtggacggtcgtcgggttacccgaccgtaggtcccgtaccggtacggggtaccgggtcgtgggtacggtcgggtacctcgtaacgttagactaagtaacgttggtacggttacgtacctacgtacgtacgacgcgtacgtccgtacgacggtacgggtcccgttaccaccgtacctccgtccgtaanaacgtaactaaacgttaccgaaaacgacctaacccgaaacttaccgtaaccgtagtaaacctaaagtccgtaaaccgcccgttaaggacgtaccgaacccggtaactaaccggaccgttacctaagttaaacttaggttaccttaggtagttaggggaaaccgggtcggtaaccggttaagacccggtacccgggttaccggacccggtaaacgggtccccgttaaggtcccggttacccgtaccgtacccgg

SEQ ID NO: 1498 - DNA, 747 bp, Homo sapiens
  misc_feature: GYAE6OF02F3M35.38.30.C08.1.454.CMB.1.raw
  modified_base (181)..(181): a, c, t, g, unknown or other
  misc_feature (181)..(181): n is a, c, g, or t
  modified_base (303)..(303): a, c, t, g, unknown or other
  misc_feature (303)..(303): n is a, c, g, or t
  modified_base (635)..(635): a, c, t, g, unknown or other
  misc_feature (635)..(635): n is a, c, g, or t
  modified_base (721)..(721): a, c, t, g, unknown or other
  misc_feature (721)..(721): n is a, c, g, or t
tcagtcgatcacgtcacgaccggtgctcgatttagtctgacgtcaaagggaaaggggtctggagagaggagcccagccctgggattttcaggtgttttcatttggtgattcaggactgaacagagagaactcaccatggagtttgggctgagctggtcttttctagtgctattttaaaggngtccactgtgaggtgctagttgttggagtctgggggagtcgttggtacacggtcggtcgggggtaccctggagtcctcgtcctgtgccagtcctctaggtcttccacgttagctacgactancgaccgtatcggatccggtaggggtaccccgtccgaggggtaccctacgggacggggtaccggttcgtagggtacgggttcggtccttaacgttaacgtttctacggtaacggtttacgtacggttacgggtaccgtaaccacggttagttccggtaccgacgacgttaacccggtccggttaaggacccgggtccctaacgagtaccgtacctacccgagaccgtactaccgtaactacgaacacgtactaacgtcccgtagaccctaagtactaccgtacctacggacggtacgaccgtaacggacgtaacgacccggttataaacggtnttaacgttgtacgggtacggtaacccggggtggttaccgggtataaccgggtccggtaacggttaccggggacccggttaaccggnggtttccccggattcccgggtaaccc

SEQ ID NO: 1499 - DNA, 818 bp, Homo sapiens
  misc_feature: GYAE6OF02JOECK.38.30.C08.1.454.CMB.1.raw
  modified_base (259)..(259): a, c, t, g, unknown or other
  misc_feature (259)..(259): n is a, c, g, or t
  modified_base (356)..(356): a, c, t, g, unknown or other
  misc_feature (356)..(356): n is a, c, g, or t
  modified_base (409)..(409): a, c, t, g, unknown or other
  misc_feature (409)..(409): n is a, c, g, or t
  modified_base (447)..(447): a, c, t, g, unknown or other
  misc_feature (447)..(447): n is a, c, g, or t
tcagtcgatcacgtcacgaccggtgctcgatttagtctgacgtcaaagggaaaggggtacgtgagagaggagcccagccctgggatttcaggtgttttctatttggtgatcaggactgaacagagagaactcaccatggagtttgggctgaactggctttttctcgtggctattttaaaggtgtccagtgtgaggtgcagctgttggagtcgtgggggagcttgggacaggccgtgggggggtccctgagactcgtccngtgcaaggcctctggtatcctactttaaacgaattagtgcctatgtaactcgggtccgccgacggctccgagggacggggctgggaggtggtccgtnacgtctagtacgtacggcgtactaggtggtggtaggggctagtacctacgcgngtaacgtcgggtacgaaaggggtccgtttacaaccgtntttacccgaagtacggtaactaaaccgttccgaaaacggtaacctacccggtactttaccggtaccttcgttaacgttttaaaccggtacgaaacccggttacgggtaccccttagggtaaacggtaaccggggttaccgtaaacccggggtacccgaacccgggggtaacccttaaagttttaaaccggttaaacctttaaccgggttagtacccggggtaaacggttaaaaggttccgttaacgggggtttcgggggggttacgtaccggttcggggtttaccccccgttaacgggggtttaacccctccgggggtttaaacccgggggggacccttaacgggggggtaacccccccgtttaacggggg

SEQ ID NO: 1500 - DNA, 825 bp, Homo sapiens
  misc_feature: GYAE6OF02ILQHW.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggctatttaaaaggtgtccagtgtgaggtgcaggtgtcggagtcgtggggagtcttggttcagccgtgggggtccctgagactctcctgtcgcagtctcgtggtaactttaaccgtttagtacgtacttagtcggacctagtgacttccggtcgggtccccgccgtacgggtccttacccggaagggggtaacgggggtccgttaggggaacgggtttcggggtacctccggaaggtacgtaaacgtttaacggtggggttaacgggggttacgtaacgttaccgaacccttaagtttaaccgttaaccgacgtaacggtaccgttcccggggggttacgggggggtcccgtttacccgaacccgtacgtacccaacccggaaggaaccgtaaacccgtaaaccgtcccggaaagggaccggaaccaaccgtaacttaacgtacgttaacctaaacgtaaacgttccgaccaaccgtacgtaccgttagggaacgtacggttacggaacggaccgtaaccgggtccgttaagttacgtttagttacggtcggacgtaacggtacgtaacccgttaacccggtaaacgggtaccgaacccggttaaccgtttgggttaccgtttacgttttacggtactttttccggaggttaacccggg

SEQ ID NO: 1501 - DNA, 693 bp, Homo sapiens
  misc_feature: GYAE6OF02GO2UW.38.30.C08.1.454.CMB.1.raw
  modified_base (351)..(351): a, c, t, g, unknown or other
  misc_feature (351)..(351): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtctgggggaggcttggtacagccgtggggggtccctgagactctcctgtgcagcctcgtggattcacctttagcagctatgccatgagctgggtcccgccgaggctccggaggggaccgggtcgtggagtgggtctcacttanctaagtataggtggtagtaccacgtattcgacgcaagtaccgtccggtaggaacggggtcccggtttacaccgtagtccgtaccgaaggaacgaacctaaattacccaaacgaaacctaaccctacttaactacccgtagaacctaaaagttacgaaaccgtaccccgttaagggagaccggaccgggaacgggaaccgaccgggacctagtaacttaattacgttggtaggtaacgggaaaggggcggtaaccgggggttagacccggttccgggtaccgggggacccgaacgggggtaacccccgtttcggggtaccctaccccggtttccgtacccccg

SEQ ID NO: 1502 - DNA, 751 bp, Homo sapiens
  misc_feature: GYAE6OF02HN2CL.38.30.C08.1.454.CMB.1.raw
  modified_base (320)..(320): a, c, t, g, unknown or other
  misc_feature (320)..(320): n is a, c, g, or t
  modified_base (341)..(341): a, c, t, g, unknown or other
  misc_feature (341)..(341): n is a, c, g, or t
  modified_base (394)..(394): a, c, t, g, unknown or other
  misc_feature (394)..(394): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggtctttttctagtggacttaagttttaaaggtgtcactgtgaggtgacagtttgttggagttcgtgggggagtcgtttggtacagtccggtgggggtccctaggtagtacctctccgtggtcgcgacgtcccgtgtcggtacttaccctacgttttacgcgtaacncttagtcgaccgtagttacgnggtcgtcgggtaccccgcgaggtccctcgggaacggggtccggtggtacgggnggttcggttctacgttaacttctaggaacgttaagtagttcgggtacgtaccgtacttacggttacccgacgtcgtacgtaacccgtcgggttggaacgggtcccgttaccgacgtaccttccgacgacggtaaacgtaccgtaacttaaccaagaaacctactaacgtaacttaccgtaccgaagtaaaccgtacgaaccgtacccgttaggaacgtacgggaaccgtaccggaccgaccggccttaagtaacttacggtacttagggtacgtaaggggtaacgggtcggtaccggtacgcgggttaacccggtggaaccggtaccggtaccgtcgtaaccgtccgtaccctccgg

SEQ ID NO: 1503 - DNA, 774 bp, Homo sapiens
  misc_feature: GYAE6OF02IA1EJ.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcacatggagtttggctgagctggctttttctagtggtacttaagttttaaaggtcgtccagtgtgtaggtgctagttgttggagttcggtgggggagtcgttggtacacggtccggtggggggtccctggaacgtcctcgtccgtgtcggactacgtcctcgtaggtacttcctacgtttagacaggtctagttcggacctgttagcgtccgttacgggtcccgaccgcggtcccttccggaaggggtcccggttcgtggggtacccgggttgggtaaccccttcttaaccgttgtaccgtaaggttaggtagttaccgggtacgtaacacgtacgttacgacgtgtaacgtacgtccggtacggacggggtccctacgacgtactcgtacgaacgtacggaaccttacgtaaccgtaacgtaaactacctaaactaccgtaacgtacaaccgtaaagttacgaaaccgtaccggtacgacggtaacggccgaaaccgccgtaacccgactaacgtacttaacgttacttcggtacggtaacgggaacgggtcggtaaaccgggtcgtaccggtacccggtacgggtaacccggtaaccgggtacccgttaccgggtacccgttcccgggtaaccttaccccggg

SEQ ID NO: 1504 - DNA, 626 bp, Homo sapiens
  misc_feature: GYAE6OF02G7NLM.38.30.C08.1.454.CMB.1.raw
  modified_base (176)..(176): a, c, t, g, unknown or other
  misc_feature (176)..(176): n is a, c, g, or t
  modified_base (185)..(185): a, c, t, g, unknown or other
  misc_feature (185)..(185): n is a, c, g, or t
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (327)..(327): a, c, t, g, unknown or other
  misc_feature (327)..(327): n is a, c, g, or t
  modified_base (484)..(484): a, c, t, g, unknown or other
  misc_feature (484)..(484): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgcgtttcagtgctatttaaaggngtcactgtnagtgcagttgtggatcgtggggagcttggtacagcctgggggtcctgagctctcctgtgcagcctctggattcactttagctagctatgccatgagcgtggtccncgaggcctccagggcggtcnggagtggtactgacttncgagtagtagtggtcgtaccaactagttacgacgacgacgtacgtacccggtagaacgggtccccggtttacaacccggtatttcccaccgaaaggtacgaacctaaacgttccgaaaaggtaaccaacctacgtaacgtaacctagaacgttaaancgaaaacgcctagaagtaccgacgaggacttaccggacctaagtataacgttacgtagttggtaaggaacgggttcgaacggggttacaccgtcggtacgggaccgtaacggggtaccctgggtaccctaccggtctacccg

SEQ ID NO: 1505 - DNA, 853 bp, Homo sapiens
  misc_feature: GYAE6OF02ISSBF.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggctattttaaaaggtgtccactgtgaggtgctagttgttggagtcgtgggggaggtcttggtacaggccgtggggggtccctggagactctcctgtgacagcctcgtggtattcctacctttagctacgctaagtcgaccagtgacgtcgttcgggtcccgaccgtaggtccgtaccggacggggtaccgggttccgtaggggtacggttcggggttactaccgtaacgtttataccgtaaggttaaagtaggtttacgggtacggttaaaccccagttaacgtttaccggaaccgtcgtaacgtacccgttaccgggtaacgggtaaacgggggtccccggttttaccgaacccgtacgtttacccgtacccgtaaaggaaccggtaaaccgtaaaccgtttaacccgaaaaacgtaacccgaaaccttaaacccgttaaacgttaacccgtaacgtaacgaaaaacgtttacgggaaaacccgtaaccccgttagggaaccggtaaacggacccgggaaacgggaacccgaacccgggtacctaaagtttaacgtaacgtttaccgttgggttacggttaacggggaaacggggtcggtaaccggggttcgaacccggttccgggtacggggtacccggtaacggggtaccccgttcgggtaccctacccggttccctacccgg

SEQ ID NO: 1506 - DNA, 637 bp, Homo sapiens
  misc_feature: GYAE6OF02HOCRN.38.30.C08.1.454.CMB.1.raw
  modified_base (155)..(155): a, c, t, g, unknown or other
  misc_feature (155)..(155): n is a, c, g, or t
  modified_base (406)..(406): a, c, t, g, unknown or other
  misc_feature (406)..(406): n is a, c, g, or t
  modified_base (487)..(487): a, c, t, g, unknown or other
  misc_feature (487)..(487): n is a, c, g, or t
  modified_base (609)..(609): a, c, t, g, unknown or other
  misc_feature (609)..(609): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtgngtttcagtggctatttaaaggtgtcactgtgaggtgcagttgtgagtcgtggggagctaggtacagcctgggggtccctgagactcgtcctgtcgactacgcctcgtaggtacttccaccgtttagccagcctatcgccagtgtacgctgggtacccgccgtaggtcctcccggaagggtcggtctcgggagttcgggtcctacggtacttaagcctaagtactacggtaggtcgttaacactagttacgngacacgtacgtccgtagacgggccgttcaacgctacctcgacgaagtaacaacttacaaagaccaacgtacgaacttacgngaactaacgagaactccgaagtcgaacgcgacggactcggtaccagttataacgtctagtacggtaggaaacggggtcgtaccgggtaatccgtcggttaacggccgtaacggggtaccccngggttaccctaccccgtcgttaacccgg

SEQ ID NO: 1507 - DNA, 667 bp, Homo sapiens
  misc_feature: GYAE6OF02IGBGE.38.30.C08.1.454.CMB.1.raw
  modified_base (305)..(305): a, c, t, g, unknown or other
  misc_feature (305)..(305): n is a, c, g, or t
  modified_base (310)..(310): a, c, t, g, unknown or other
  misc_feature (310)..(310): n is a, c, g, or t
  modified_base (410)..(410): a, c, t, g, unknown or other
  misc_feature (410)..(410): n is a, c, g, or t
  modified_base (519)..(519): a, c, t, g, unknown or other
  misc_feature (519)..(519): n is a, c, g, or t
  modified_base (533)..(533): a, c, t, g, unknown or other
  misc_feature (533)..(533): n is a, c, g, or t
tcagtcgatcacgtcacgaccggtgctcgatttagtctgacgtcaaagggaaaggggtctgagagaggagcccagcccctgggattttcaggtgttttcatttggtgatcaggactgaacagagagaactcaccatggagtttgggctgagcgtggtcgtttttctaggtggcttaagttttaaaaggtgttcctactgtgaggtgctagttgttggagtcgtgggggaggtcgttggtacgagccgtgggggtccctgagactctcctgtgacgagcctcgtggtacttctactttagcagctntgccngtagtgcgtcggccgtaccgaggtccgtccgaggggtaccggtcgtggaggttcggtctcgtacttagacgtaagttagtaggtggtacggacctacgtntttacggacgtcacgtacctcggtagggaccggtcgggtttaccacctcgttccaccgagtaacgaacctagttaacccaaaggaaaccacgtaaactacgttaaccgngaacaatacgaacnccgtagacgaacgccgacgaccgacgactacgtaaattcctagttacgaggtacgggacggaaggtccgggtactccgtccgggaccgggccgaaccggggtacccgtgtaacccggtcccttacgtaccccgg

SEQ ID NO: 1508 - DNA, 689 bp, Homo sapiens
  misc_feature: GYAE6OF02H6FQT.38.30.C08.1.454.CMB.1.raw
  modified_base (337)..(337): a, c, t, g, unknown or other
  misc_feature (337)..(337): n is a, c, g, or t
  modified_base (405)..(405): a, c, t, g, unknown or other
  misc_feature (405)..(405): n is a, c, g, or t
  modified_base (495)..(495): a, c, t, g, unknown or other
  misc_feature (495)..(495): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcacatggagtttgggctgagcgtggtctttttctagtggcttaattttaaaaggtgtacctagtgtgaggtgcaggtgtcggagtcgtgggggaggcgttgggttcgagtccgtcggggggtcccctggacgtacgtctccgtgtgctagtctcgtggtactttaacctttagtggtactaatcgcctatgtatcgttacgggtcccnccgacggtcctaccggaggggaagggcgtgggagtcgggtctcgagactaagttagtggggtagggtntacgtaccactatacgtacgactagtaccgtccgggtcgggggtacccgttacgacctagtccgaccagacgaaccaaccgtcgaagacncgaactaacgtatacgtactaactaaagtcactaacacgtcctagggtacgaacggtacgggaaccgggaccgaaccggggtccgttaacgttaattacgttgttaaggacgagtacgtaacgtaccccggaacggtacgtaaccccgtgtttacgggtactttgtttacggttacgtttcggtacggtacggg

SEQ ID NO: 1509 - DNA, 615 bp, Homo sapiens
  misc_feature: GYAE6OF02F5NQN.38.30.C08.1.454.CMB.1.raw
  modified_base (417)..(417): a, c, t, g, unknown or other
  misc_feature (417)..(417): n is a, c, g, or t
  modified_base (421)..(421): a, c, t, g, unknown or other
  misc_feature (421)..(421): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgcagttgttggagtcgtgggggaggtcttggtacagcctggggggtccctggagactctctgtgcagcctctggacttcgacctttagcagctagtcgccatgagcgtggtccgccaggctccgaggggacggtcgtgggagtgggtctcaccttatcgtagtaataggtgggtcgtaccactagttcgacgcagtactccgtggaacgggtccgtcacctntccnccagacgactaataccaagaaccacacttaacacctagacaaatcgaacaccgtgaacgacgccgaaggaccgaccggtacacgtacttattaccgtgtagtaggaacggggccgtaacggggtctaaccgtcccggtacggggacccgtaacggggtaaccccgttcggtaccgtacccggtccgttaccccg

SEQ ID NO: 1510 - DNA, 709 bp, Homo sapiens
  misc_feature: GYAE6OF02JW6CU.38.30.C08.1.454.CMB.1.raw
  modified_base (411)..(411): a, c, t, g, unknown or other
  misc_feature (411)..(411): n is a, c, g, or t
  modified_base (531)..(531): a, c, t, g, unknown or other
  misc_feature (531)..(531): n is a, c, g, or t
  modified_base (596)..(596): a, c, t, g, unknown or other
  misc_feature (596)..(596): n is a, c, g, or t
tcagtcgatcacgtcacgaccggtgctcgatttagtctgacgtcaaaagggaaaggggtctgagagaggagcccagccctcgggattttcaggtgttttcatttggtgatcaggactgaacagagagaactcaccatggagtttgggctgagctggtctttttctaggtggcttaattttaaaaggtgtccactgtgaggtgctagttgttggagtcgtgggggagtcttggtacagcgtgggggtccctgagtactctccgtgtcgcagtcctcgtgggattccacttttacgcaagtctatgacccgattcggagtcgttcgggtcccgaccgacggtcctcccgaggggtacggtcgtgggtagtcgggtctcgtacttagtcgagtaaagtgtcggtaggttaaccncgtatttaccggcacgacgaccggtttccgaagggtaccgggtcccggttttacaacccggttaatcctaccggaagtacgaactaacttacgaaacgtaccagtacctactaaccgtanacgtaaaattcgaaaccgtccttaagggacgaaaccggtaccggaaggacggaaccgactaactnttaaaccgtgttacggtgtaagggaaccgggtcgtaaccggggtctaaccggccgtttaacgggggaccgtaacggggtaaccccttggaacccgttcccggtacttccccgg

SEQ ID NO: 1511 - DNA, 781 bp, Homo sapiens
  misc_feature: GYAE6OF02JNXOV.38.30.C08.1.454.CMB.1.raw
  modified_base (228)..(228): a, c, t, g, unknown or other
  misc_feature (228)..(228): n is a, c, g, or t
  modified_base (777)..(777): a, c, t, g, unknown or other
  misc_feature (777)..(777): n is a, c, g, or t
tcagtcgatcacgtcacgaccggtgctcgatttagtctgacgtcaaagggaaaggggtctgagagaggagcccagccctgggattttcgaggtgttttcatttggtgatcaggactgaacagagagaactcaccataggagtttgggctagagcgtggtctttttctagttggacttaattttaaaaggtgtaccactgtgaggtgctagttgttggagtcgtggggngtcttggtacacgcggtcgggggtacctggacgtctctccgtgtcgctcgcctcgtacggtacttccgtaccgttacgcgtacgtactacgtcgacctagtcgtacgtccggtcggtcccgccgacggtccgtaccggtacgggaccgggttacggtagggtcggttcgggtccgttaccgtaacgttacgtaagtacggttaaagttacggttcgggtaccggttaaccacgttaacgttccggaaccgtcgtaacgtcccggtacggtacgggaacccgggtccggttaaccaccgtaacgttcccgtacgaacgtacgtaaactaacgttaacccaaaggtaaacctacgtaaacccgttactaacccgtaagaacgtaaaaccgtacgtaaaccgcccgttaaggacccggtacggaccccggtaagggacccgtaaccgtactataacggttattaccggtaggtaggacggtaacgggccggtaaggtcgtacccgtcgggacggtacccggaacgtacccgtcgttaccgacccggttaccncccg

SEQ ID NO: 1512 - DNA, 939 bp, Homo sapiens
  misc_feature: GYAE6OF02H44ZQ.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttggctgagctggtctttttctagtggccttaagttttaaaacggtgtaccacttgtgaggtgcagttgttggagtcgtgggggaggtcttggtacaggccggtcgggggttcccctggagcctcctccgtgtgcagcctcgtgtacttcgtacctttaggccagtaccgtagtcgaccgtatagacggtcggtcgggttacccgccggtaggccctaccggacgggggtacgggttcgcgggtacggttacggggtccttacctaacggttttaagtaccgtaaggttaacggttaacggttaccgggttacggtaacccggtaaccgttaccgggtttcccgaaaccgtaccgtaaccgggtaccgttaccgggttaacgggggtaacccggggtaaccccgggttttaccctaacccgggttacgtacccttaacccggtaaacggtaaccgttaaaacccctaaacgttttaaaccccgaaaaaacggtaaacccgtaaccctttaaacgttaaaccgtttacccgttaaaccgggaaaacccttaaaccggggtttaaaggaaaccccgtaaccggtaacgacgggttaaacccggaaccggggtaaccgaacccggaaacccggttaccgttaaagtaacggtttacgtttaacgtaacgggtttagggaaccggggttaaaccggggggtcggtaaaccgggggttttcccaacccgggtttaaccgggtaccggggaacccgggtaacggtacccggttacccggtaccgtaccccgttccgtaaccccgg

SEQ ID NO: 1513 - DNA, 849 bp, Homo sapiens
  misc_feature: GYAE6OF02JQ072.38.30.C08.1.454.CMB.1.raw
  modified_base (327)..(327): a, c, t, g, unknown or other
  misc_feature (327)..(327): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagcgtggtcgttttctaggtggtctagttttaaaaggtgttccactgtgaggtgcagttgttggacgtgtgggggagtgttggtacagccgtgggggtccctggagacttctccgtggtcgcgtagcctcgtaggactttccgtaccctttaggacctagtctaacgtcgacctagtgngtccgttcgggtccccgaccgcggttccgaccggtaacggggtcggtccgtagggacggttcgggtccgttaccgttaacgtttacgtacgtaaggtttaacgtacgggtttacgggtaccgttaaacccgtaccgttaacggttttaccggaacgggtaccttaacggtaacccgttacccgggtaacgggtaaaccggggttcccggtttaaccaccccgttaagttccccgtaccgtaacggtaaaacgaccgttaaacgttaccgaaaaccggtaacaaacgtacccgttaaaccggaacccttaacgaaccgttaaaacgtacggaaaaccgtcccttaaggggaacctaaccggacccggtaacgaacccggtaccgggtaaacctagtaaaccgtttaattcccgggtaagtaccgggttaaaggggaaaccggggtccggttaagggtacccggtacggtacggtacccggtacccggaacgggtacccgtccggtacgtaccgtcccgtaccg

SEQ ID NO: 1514 - DNA, 756 bp, Homo sapiens
  misc_feature: GYAE6OF02GX42K.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtcttttctagtggacttatttaaaaggtgtcctacgtgtgaggtgcgtagttgttggagtacgtgggggaggtcgtggtacagccgtggggggtaccctggagtactctcctgtgcagcctacgtggtacttccaccgtttagacagtacttagtcgcctagtgacgtcgttcgggcccgaccgacggtccgtaccggtaacgggtccgggtacgtggacggtcgggtacctacgtacttactacgtaagtaacgttacggtaggtaaccggtaaccgtacgtaagtttccaaacgtacgtacgtaccgtcgtacggaacgggtaccgtaccgaaccgtacgtaccgtaccgtaacgaacggtaaacctaaccgtaaccgaaagaaaccctaacaaccgttaaccgtaaacctacgaaacgtaaaactaaggaacccgtaaccggtacgtaacgaccggtacccggaaagacccgtaacggcctaaaagttactaaacgttacgtggtaacgtacgggtaaaacgggccgtaacggggtccgtaaccggtaccgggtacgggaccgaaccggaccggtacggtacccgtaccggtctacccg

SEQ ID NO: 1515 - DNA, 805 bp, Homo sapiens
  misc_feature: GYAE6OF02FMAO0.38.30.C08.1.454.CMB.1.raw
tcagtcgatcacgtcacgaccggtgctcgatttagtctgacgtcaaagggaaaggggtctgagagaggagcccagccctgggattttcaggtgtttcatttggtgatcaggactgaacagagagaactcaccatggagtttggctgagctggctttttctagtggctattttaaaggtgtccactgtgaggtgctagttgttggacgtcgtgggggaggtcgttcggtacgaggtcccgtggggggtcccctggagtactccttacctggtcgctagcctcgtcggtacttcctacctttagctacggtctagtcgcctaagtacgacggcgttcgggtcccggtacgacggtccgttacccggagggggtccggggtacgtacggggtacggtacggggttccttacgtactttacgtacgtacgtaagtaggtcgggtacgtaaccgtactagttccggaacgtaccgtagtacccgttccggtacgggtaccggggtcccgttacgtaccctacgtacctccgtaaaggtaccgtaaccgtaaccgttaccaaaacggacctaaccgtaacgttaaccttaaccgtacgtaccctaaagtaccgggtaacccttaaccgtgaaccgggtacgaccggtaccggtaaaccggccggttaaccgtaataaccgtttaacgttacgttcggttaccgtaaggggaacgggtccgggaacggggttacgacccggttacccgggcgggggttaaccccgacggggttaaccccgtcgggtaacccccgaccgtttcccgtaacccg

SEQ ID NO: 1516 - DNA, 698 bp, Homo sapiens
  misc_feature: GYAE6OF02I3GO8.38.30.C08.1.454.CMB.1.raw
  modified_base (187)..(187): a, c, t, g, unknown or other
  misc_feature (187)..(187): n is a, c, g, or t
  modified_base (558)..(558): a, c, t, g, unknown or other
  misc_feature (558)..(558): n is a, c, g, or t
  modified_base (669)..(669): a, c, t, g, unknown or other
  misc_feature (669)..(669): n is a, c, g, or t
tcagtcgatcacgtcacgaccggtgctcgatttagtctgacgtcaaagggaaaggggtctgagagaggagccccagccctgggatttttcaggtcgtttttcattttggtgatcaggactgaacagagagaactcaccatggagtttgggctgagcgtcgtgtttctaaggtcgctatttaaaggtntccatgtgagtgcagttgtgcgtcgtgggagtcgttgtacagccgtgggggtccctggagcttcctccgtgtcgcacgtccgtcgtgacttcctcctttagcctagctaacgtcgacctatcgagtcgtcggtacccgtaccgcggctccggacgggtacggttcgtaggtcgtcggtctccgttattacgtactagtagtaggtacggttcgaccgttacgtacgttaccgacgtacgtaaccgtccgtccgggtacggttaacggggtccgttacccaacgttccttaccgtaaccgaggtaaccacttaaaccgtcctaaacggaactacctactacgttcctacacgttaacgactaccgtaacgtnaacggtacgaccgtaaggacccgaaggtcctaaaacttacggtaacgtcgttacgtagggaacggtacgggtcgttaacgggccgtaaaccggtcggacgggttaacccgngggtaccctacggaccgttcgcccttacg

SEQ ID NO: 1517 - DNA, 661 bp, Homo sapiens
  misc_feature: GYAE6OF02F4406.38.30.C08.1.454.CMB.1.raw
  modified_base (181)..(181): a, c, t, g, unknown or other
  misc_feature (181)..(181): n is a, c, g, or t
  modified_base (187)..(187): a, c, t, g, unknown or other
  misc_feature (187)..(187): n is a, c, g, or t
  modified_base (189)..(189): a, c, t, g, unknown or other
  misc_feature (189)..(189): n is a, c, g, or t
  modified_base (194)..(194): a, c, t, g, unknown or other
  misc_feature (194)..(194): n is a, c, g, or t
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (264)..(264): a, c, t, g, unknown or other
  misc_feature (264)..(264): n is a, c, g, or t
  modified_base (287)..(287): a, c, t, g, unknown or other
  misc_feature (287)..(287): n is a, c, g, or t
  modified_base (407)..(407): a, c, t, g, unknown or other
  misc_feature (407)..(407): n is a, c, g, or t
  modified_base (498)..(498): a, c, t, g, unknown or other
  misc_feature (498)..(498): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagttttgggctgagcggcgtggttcaaggtcgctatttaaaggntccatntnagtcnagtgtgcgtctgggagctagtcagtcgtgggtcctgnacnctctgtgcagtctatggattcgacgtttanccagtctaatcaccagttggganccgttgggtacccgccgaaggtccgtacccggaaagggtccgggtacgttcgggtaacggtggttacctcctaagttaccttgaaacgtatttacggtggttacggaaccacctagtccncggtacaagccgtttgacggagggtccctacgtaacaattacctaccaggacgtttaaccaagttcccaagaccgaatacgtaattacccngttaacgaactgaaactcccgaacgacgaacggacggaaccacggttacgaccccgttattaataccggtttaatccggtggttaacggaagggttcgaaaccgggtttcggcccttcgggaccgttggaaaccggtccttccgggactttaaccggcctccg

SEQ ID NO: 1518 - DNA, 750 bp, Homo sapiens
  misc_feature: GYAE6OF02F1ITI.38.30.C08.1.454.CMB.1.raw
  modified_base (335)..(335): a, c, t, g, unknown or other
  misc_feature (335)..(335): n is a, c, g, or t
  modified_base (341)..(341): a, c, t, g, unknown or other
  misc_feature (341)..(341): n is a, c, g, or t
  modified_base (393)..(393): a, c, t, g, unknown or other
  misc_feature (393)..(393): n is a, c, g, or t
tcagtcgatcacgtcacgaccggtgctcgatttagtctgacgtcaaagggaaaggggtctgagagaggagcccagcccctgggatttttcgaggttgttttcatttggtgatcaggactgaacagagagaactcaccatggagtttggctgagcgtcggtcgttttcgtaggtggacttaagttttaaaaggtcgtacctatgtggtacgtgctaggttgttaggacgtcgtgggggagtcttaggtacgtcgcccggttgggggtccctaggagtccgttactccgtgtagcgtacgtccttcgtggtattcctaaccgttgcctaagccttanccgtanagtcgacgtcgtacgggtccgccgtaaggtccgtaccggacgggtacgggtntaagggtggtcggtaccgttagtacttacgtactaaggtactaggaggttaccggtacaacgtacgtacgacgtacgaaccgcgttaaccgtgggtaaaccggtccgttacgactaacgtcctaacgtacgaacgtaacgtaacttaaccgaaactaaacgactaaccgtactaaccgtacgtaacgaaagtagtaaaccgtccgaaggtacgaacggtacgaaccgtaccgacgttaaccacgttaaccgttagtacgtagtacggaacggtacggggacgtaacgggtacgacccgttaggaccgggttaccggaacggttacccggtcgttaaccggaccgtaccgttacccgg

SEQ ID NO: 1519 - DNA, 795 bp, Homo sapiens
  misc_feature: GYAE6OF02FK80W.38.30.C08.1.454.CMB.1.raw
  modified_base (203)..(203): a, c, t, g, unknown or other
  misc_feature (203)..(203): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtcttttttctagttggcttaagttttaaaaggtgtaccactgtgaggtnctagttgttggagtcgtgggggagtcttggtacagcccgtgggggtcccctggaacgtaccttccgtccgtggtcgccgtacgtccttcgtacggtacttcctaaccgtttaggcctacgtcttatcgacctagtggacggtccgtcgggtcccgaccgtacgggtcccgttaccgggtacggggtaccgggttccgtagggtacggttcgggtccttacgtacgtttactacgtaagttaaacgttacggttacgggttaccgtaacctactacgttcgacggtacacggtaccgtaccggtacggtaaccggtccgttaccgacctacgtaccgtaccgaagacgtaactaaccgttaccgaaagtaaaccaactaaccgtaacttacccgtacgtaaccgtaaagtacgaaccgtaccggtacgaacggaccgaccggacgaacccgacgtaccgtaactaacgttacgttacgtacgtagggtaacgggtaacgggtacgggttaaccgggtacgtacccggttaccgggtaccggggacccggtaaccgggtacccgttaccggtacccgtacccggtaccctcccg

SEQ ID NO: 1520 - DNA, 845 bp, Homo sapiens
  misc_feature: GYAE6OF02III29.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggctttttctagtggctattttaaaaggtgtccactgtgaggtgctagttgttggagtcgtgggggagcttggtacagccgtggggggtccctggagtactctccgtgtcgcacgcctctggtacttcctacctttacgtcgacgtctactcgtccgtagttacggaagtccgttacgggtccccggacccggtaaccgggtacgtacccccccccggaagggggtaccggggttaccggttagggtaacgggttcggggttccgttacccgttaaccgttaacgttacgtaacggttaaagttacggttacggggttaccgggtaaccgtaaccgttacgtttaccggtaacgaccgtacgtaacccgttacccgggtacgggtaaccgggtcccgggttaccgtacccgtaaccttaccgtacccgaacgaaccgaaccgtaaacttaaccgaaacgtaaaccgtaaccgaaccttaacgttaaccctacgaaccgtaaacgtacgaaacgtacccgtagacgaacggaccggaacgaaccgaccgtaccaacgtaacttaaccgttacgttagtaggttaacgggaacggggtaccggtaccggggtacggtaaccggtcccgggttaccggggaccggtaacgggtaaccccggttacgggtaccgtacccggttaccccgttacccgg

SEQ ID NO: 1521 - DNA, 912 bp, Homo sapiens
  misc_feature: GYAE6OF02H3QJI.38.30.C08.1.454.CMB.1.raw
tcagtcgatcacgtcacgaccggtgctcgatttagtctgacgtcaaagggaaaggggtctgagagaggagcccagccctgggattttcaggtgttttcattggtgatcaggactgaacagagagaactcaccatggagtttgggctgagctggctttttcgtagtggctatttaaaggtgtccactgtgaggtgcagttgtggagtcgtggggaggcttggtacagcctggggggtccctgacgacgtctcctgtgcagtcctcgtggacttcgaccttttagcgaagtctaatggcccaatgacgtccgttaggggtccccgccgaagggccgttccgacggggtaccggggttccgtggggtaacgggttcgggtacccgttccgtaacttttaacgtccgtaagtaaattaacggttgggtacggtttaccgacgttacgtttacgaacccgtcggaaacgtacccgttccggtacgggtaaaccggggtccccgggttttaaccaccccgttaaacgtcccgtttacccaacgggtaacgggtaaacctaaccgtttaccgaaaaccggtaaaccaaccgttaaaccgttaaaaccttaaacccttacggttaaacccggtaaaaactttaccgggaaaaacgggttacccccgttaagggtaaccggtaaacgggaccccggggtaaacggaaaccgggttaaccccggtaaccggtttaaaccgttaacctttaaaaccgggtttaccgtttaccgggttaattaacgggggtaaaacgggggtcccggttaaacgggggggtaccggttaaacccgttcccggggtacccgggggtacccggtaaaccgggggtacccccggtttaacgggtccccggttaaccccggttcccggttacccccgg

SEQ ID NO: 1522 - DNA, 725 bp, Homo sapiens
  misc_feature: GYAE6OF02IQDWC.38.30.C08.1.454.CMB.1.raw
tcagtcgatcacgtcacgaccggtgctcgatttagtctgacgtcaaagggaaaggggtctggagagaggagcccagcccgtgggattttcaggtgttttcatttcggtgatcaggactgaacagagagaactcaccatggtagtttgggctgagcgtggtactttttcgtagtggacttaagtttttaaaaggtgttccactgtcgaggtgctagttgttggagtcgtggggaggtcttacggtacacgtccggtgggggtccctggagtactcctccgtgtgctacgtcctcgtaggtacttactacctttagctacgtcctagtccgtccagtcgacgtcggtcggtaccgcgtacggtcgtccggacgggtacggtcgtacggtacggtcgggtcctacgtacttagtacctagtaagttagtcggtacgtaactcgtacgtcggactacgtacgtaccgttccgtacggtaaccgggtcccgtttacaaccgtacttaccctacgaacgacgtactaaaccgttaaccgaaacgtaaacctaacctaccttaacgttacctacggaactaaagttacgaacgtacccgtagtacgaccgtacccggagaaccgaccgtacttaagtaacgtttagacgttcggtagacgggtaacgggtcgtaacgggttcgaccgtcgggtacggccggtacggtaccgtcggtccgtaccgtctacccg

SEQ ID NO: 1523 - DNA, 696 bp, Homo sapiens
  misc_feature: GYAE6OF02JMOO4.38.30.C08.1.454.CMB.1.raw
  modified_base (240)..(240): a, c, t, g, unknown or other
  misc_feature (240)..(240): n is a, c, g, or t
  modified_base (523)..(523): a, c, t, g, unknown or other
  misc_feature (523)..(523): n is a, c, g, or t
  modified_base (680)..(680): a, c, t, g, unknown or other
  misc_feature (680)..(680): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggtagtttgggctgagctggtctttttctagtgggcttagttttaaaaggtcgtaccactgtgaggtgcaggttgttggagtcgtgggggaggtcgttggtaacngccgtggggggtccctggagctccgttccgtgtaggcaggccttcgagggtatttccgtacctttacggctagtactatcggaccctattcggacgtccgtcggggtcccgaccgacggtcctaccgacgggggtacgggtccgtagggtggtacgggtcttacacgttttacgagtaggttaaatggtacgggttggtaaaccctcgtactttacggacgtcgagtacccgtcggtacggaaggggttcccggttacctacgacgtcccgtacgtacggaanaccttaaacgttcaaacgtaacgacctaactcgtactcgaacaaagtagtaaccgacccgtaggacgacggaccgagaccgacgtactagtactaactagtcgtacgtggaagggtccacgggtcgaacctcggtacggaccgtaggggtaaccccngggacctcgtactccg

SEQ ID NO: 1524 - DNA, 725 bp, Homo sapiens
  misc_feature: GYAE6OF02JH5MZ.38.30.C08.1.454.CMB.1.raw
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtcttttctagtggctattttaaaaggtgtccactgtgaggtgctagttgtggagtcgtgggggtaggtcgttggtacgagtccgtcggggggtaccctggagaccttccgtcctgtcgacacggtcctcgtggtacttcctacctttagctagtcctagtcgacctatcggacgtcgttcggggtaccccgtcgacgggtcctacccggacggggtaccgggtcgtacggggtagggttcgggtacctccgttaacgttacgtacgtagttaacgtaggtgggtacggttaaccctagtaacgtttccgaacgtcgtaacggtcccgtaccgggtaggtacggggtcccgttacaccgtaactccgtacgagaacgtactaactacgaaacgaactacctaactacctaaccgtgaaactaagtacgaaacgacctacgaggacgacgacgagaccgtacgaatactacgttaagtcggtagtacggaagggtaccggtaacgggttcgaccgttccgggtacggaaccggtaacgggtacccgttcgggtaaccctaccggtcctacccg

SEQ ID NO: 1525 - DNA, 848 bp, Homo sapiens
  misc_feature: GYAE6OF02F8M59.38.30.C08.1.454.CMB.1.raw
  modified_base (273)..(273): a, c, t, g, unknown or other
  misc_feature (273)..(273): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggtacttaagtttttaaaaggtgtacctactgtagagggtgctagttgttgggagtcgtgggggagtcgttggtacagccggtggggggtccctggagactcgtccngtcgcacgcctctggacttcacctttagctaggctgtcgccagtcgaggcgtcggggtacccgccgcggtccgtaccggacgggggaccggggttcgtagggggacgggtttcgggttccgttactaaccgtttaacgttacgtaaaggttaaacgttaggttaccggggttacggtaaccctaccgttaacggttaccccgggaacgtacccgtaacggtaacccgtttacccgggtaggggtaaaccccgggggttcccgggtttaccaacccggttacttaccccgtaacggaacgtaaacgtaaacccgtaaaccgttaaccgaaaaacccgttaaccgaaacccttaaccgttaaaccgttacccgtaacgtaactaaaacgtaacggaaacctacccggtagaacgggtacccggacggtaccggaaccgacccggtactaacgttacgttaactacgttgggtaggtaacgggaacggggtccggtaacgggtactaccgggttcccggaacggggtccccggtaacgggacccggttcggtacccccgttaccgtcccgttacccgg

SEQ ID NO: 1526 - DNA, 700 bp, Homo sapiens
  misc_feature: GYAE6OF02GUX5Z.38.30.C08.1.454.CMB.1.raw
  modified_base (262)..(262): a, c, t, g, unknown or other
  misc_feature (262)..(262): n is a, c, g, or t
  modified_base (300)..(300): a, c, t, g, unknown or other
  misc_feature (300)..(300): n is a, c, g, or t
  modified_base (343)..(343): a, c, t, g, unknown or other
  misc_feature (343)..(343): n is a, c, g, or t
  modified_base (353)..(353): a, c, t, g, unknown or other
  misc_feature (353)..(353): n is a, c, g, or t
  modified_base (360)..(360): a, c, t, g, unknown or other
  misc_feature (360)..(360): n is a, c, g, or t
tcagtcgatcacgtcacgaccggtgctcgatttagtctgacgtcaaagggaaaggggtctgagagaggagcccagccctgggattttcaggtgttttcatttggtgatcaggactgaacagagagaactcaccatggagtttgggctgagctggtctttttctagtggcttattttaaaaggtgtccactgtgaggtgcagttgttggagtcgtgggggagtcttggtacagccgtgggggtccctgagctctcctgtcgcngcctctggattccactttagcagctagtcgcctagtgngcgtgggcccgccgaggccgtccggaggggtccggtcgtgggnggtcggtctntacgttnactagtattaggtggtacgtactactagtcgacgcagaccgtcggaggacgggtcccgtacaccgtactccgtacaagacgtactaacgttacaaacgaacctacaacctaacttaccgagaaactaagacgaaccgtacccgtaaggacgtaccggaccggaaccgggaacccgaccggtaaccctaaatttaaccttaacgtttaccgtaggtagggtaacgggaaacggggtccgggtaaccggggttaccggtaacccggttccgggtacccggggtaaccggaacccggggttaaccccgtacgggtaccccgttacccggtcccttaaccccgg

SEQ ID NO: 1527 - DNA, 884 bp, Homo sapiens
  misc_feature: GYAE6OF02GIP1F.38.30.C08.1.454.CMB.1.raw
  modified_base (203)..(203): a, c, t, g, unknown or other
  misc_feature (203)..(203): n is a, c, g, or t
  modified_base (237)..(237): a, c, t, g, unknown or other
  misc_feature (237)..(237): n is a, c, g, or t
tcagtcgatcacgtcacgaccggtgctcgatttagtctgacgtcaaagggaaaggggtctgagagaggagcccagccctgggattttcaggtgtttcatttggtgatcgagactgaacagagagaactcaccagtggagtttgggctgagcgtgtcttttcgtaaggtggacttatttaaaaggtgtaccactggtagaggtnctagttgtggagtcggtggggacgtcgtggtacncgccggttcgggggtccctggacgacttccgtacctgtcgcacgtccttcgtacggtacttcctaccgtttacgctacggtactacgtctacgtagtcggtcgtcggttaccgggtcccgaaccggtcggtccgtacgggtaccggggtacgggtccggtaggtacgggtcgttaccgttacgtaacttacgtagtaacgttaaggtacggttacggttacgaaccgtacgtacgttaccgaacgaccctacggtacccgttacggacgggtaaccgggttcccttaacgacctacgttcccgaacgtaacgaaccgtactaaaccgttaacggaaacctaaaccgaccttaacctaacccgtttaaccggacgtaaaaccgtaacgaaccgggtaacccgttaacccggtaagtaaccgggaccggttaaccgggaacccggggtacctaacccggttaacgttaagttaacccttaagggtttaaccgggttccgtaaaggggtttaaaccgggggaaccgggtcccgggttaacgggttaccccgggtaccgttttaacccggggggaaccgggtaccccggtaacccggggtttaaccccggttccgggtaaccccggttttaccgtaccccgttaccccggg

SEQ ID NO: 1528 - DNA, 292 bp, Homo sapiens
  misc_feature: GYAE6OF02IMXU7.38.30.C08.1.454.CMB.1.raw
  modified_base (249)..(292): a, c, t, g, unknown or other
  misc_feature (249)..(292): n is a, c, g, or t
tcagtcgatcacgtcacgaccggtgctcgatttagtctgacgtcaaaagggaaaggggcacggggtgactcctggggccagggaaccctggtcaccgtctcctcagcctccaccaaggcccatcggtcttcccccctggccaccctcctccaagagccacctcgtgggggccacagccggccctgggctgcctggtacaaggactcttccagtgatacgatgacgcggtctggcaaggcgatatagcannnnnnnnnnnnnnnnnnnnnnnnnnnnnnnnnnnnnnnnnnnn

SEQ ID NO: 1529 - DNA, 274 bp, Homo sapiens
  misc_feature: GYAE6OF01EP4MP.49.29.C07.1.454.CMB.1.raw
  modified_base (274)..(274): a, c, t, g, unknown or other
  misc_feature (274)..(274): n is a, c, g, or t
tcagagtcgagagacacgaccggtgctcgatttagagtgctacgaagggaaaggggctcccagtctggcacctcagcctccctggccatcagtggcctccggtccgaggatgaggctgattattattgtgcagcatgggatgacagcctgagtggtctcgtcttcggagctgggaccaaggtcaccgtcctaggtcagcccaaggccaacccactgtcactctgttcccaccctcctctctctcgactctgagcgggctggcaaggcgcatagn

SEQ ID NO: 1530 - DNA, 289 bp, Homo sapiens
  misc_feature: GYAE6OF02IVISS.49.29.C07.1.454.CMB.1.raw
  modified_base (278)..(289): a, c, t, g, unknown or other
  misc_feature (278)..(289): n is a, c, g, or t
tcagagtcgagagacacgaccggtgctcgatttagagtgctacgaagggaaagggggctcccagtctggcacctcagcctccctggccatcagtggcctccggtccgaggatgaggctgattattattgtgcagcatgggatgacagcctgagtggtctcgtcttcggagcgtggaccaaggtccaccgtcctaggtcagcccaaggcccaaccccactgtcactctgttccccacctcctctctctcgactctgacgcggctggcaaggcgcatagnnnnnnnnnnnn

SEQ ID NO: 1531 - DNA, 513 bp, Homo sapiens
  misc_feature: GYAE6OF01COHZV.13.21.B10.1.454.CMB.1.raw
  modified_base (304)..(304): a, c, t, g, unknown or other
  misc_feature (304)..(304): n is a, c, g, or t
  modified_base (380)..(380): a, c, t, g, unknown or other
  misc_feature (380)..(380): n is a, c, g, or t
  modified_base (420)..(420): a, c, t, g, unknown or other
  misc_feature (420)..(420): n is a, c, g, or t
tcagtcacgtactacacgaccggtgctcgatttagtgtcgtcgcaagagaggagggggggtgcctcagccatggcatggatccctctcttcctcggcgtccttgcttactgcacaggatccgtggcctcctatgagctgactcagccaccctcagtgtccgtgtccccaggacagacagccagcatcacctgctctggagataaattgggggaataaatatgcttgctggtatcagcagaagccaggccagtccctgtgctggtcatctatcaaagataaccaagcggccctcagggactcccngagcgattctctggttccaaactcgtaggaaatacagccaactctagaacccatcgaaacgggactcgaggctagnggatgaggctgactatactgtcaggtgtgggacagacaanacctatggtaggtagttcggcggaggaccaagcgtagaccgtcaggtcacgccgaaggctcgccccctgctactcgtcgtcccgccctctacg

SEQ ID NO: 1532 - DNA, 677 bp, Homo sapiens
  misc_feature: GYAE6OF01C045E.13.21.B10.1.454.CMB.1.raw
tcagtcacgtactacacgaccggtgctcgatttagtgtcgtcgcaagagaggaggggggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaatggcagataaatatacttctggtatcagcagaagtcagccagtccctgtgctggtcatctatcaagatcgaccaagccggaccctcgagggactcccgtgagcgtattctcgtggccttccaaactcgtagggaacctcgaacgcccaactctacgaacccagtccgacggaccgggaccccaagggccttaagtagggaactgggaacgggtaccttaggtaaccttaagtttaccgtacggttacgaacggggccggtagggaaccacggacgaacgggcctaacgtccggaccccgtacgttaacgttcggttacgtttaccgggaaaccgttcggggaaacccctaaagggttcccaaacccggttacccgtaaaacggttcccgaaaccggtacccccgaaacgggacccccaaaacccccggtaccttacggtacctaacccgttccgtacccggtttaccccccg

SEQ ID NO: 1533 - DNA, 610 bp, Homo sapiens
  misc_feature: GYAE6OF01C64CW.13.21.B10.1.454.CMB.1.raw
tcagtcacgtactacacgaccggtgctcgatttagtgtcgtcgcaagagaggagggggggggtgcctcagccatggcatggatccctctcttcctcggcgtccttgcttactgcacaggatccgtggcctcctatgagctgactcagccaccctcagtgtccgtgtccccaggacagacagccagcatcacctgctctaggaaataaattggacagataaatatactctggtatcagcagaagtcaggccagtccctgtgctggtcatctatcaagactcgaccaaggccggccctgagggactcccgtgacgcgattctctggcctccaactcgtagggaactcgacgccactctacgaccatcgacggcgggacccaggctagtggatggacgtctacgaacttacgttagtcggtcgagggtccgtagggactacggcacggaccgtacgtcgccccgtataacgtccggttacgtttaccgggaacgtcggggaacctaacgggtcccgtaacccgttaccgtaaacggtcccaaccggccccgaaaccgggacccccaaccccgtataccggtacctaaccgttcccgttacccgttaccccccg

SEQ ID NO: 1534 - DNA, 695 bp, Homo sapiens
  misc_feature: GYAE6OF01DDN4G.13.21.B10.1.454.CMB.1.raw
  modified_base (377)..(377): a, c, t, g, unknown or other
  misc_feature (377)..(377): n is a, c, g, or t
  modified_base (388)..(388): a, c, t, g, unknown or other
  misc_feature (388)..(388): n is a, c, g, or t
tcagtcacgtactacacgaccggtgctcgatttagtgtcgtcgcaagagaggagggggggggtcaaccgccatccttgccctcctcctggctgttctccaaggagtctgtgccgaggtgcagctggtgcagtctggagcaggaggtgaaaaagcccggggagtctctgaagatctcctgtaagggttttggaaacagtctttatcagccactggatcggctgggtgcgccagatcggacccgggaaaggcctgggagtgggagtggggatcatctatcctggtgactctgactaccagaactacacgcccgtccttaccgaaggcccaggtccaaccatctcacgcccgaacagtcccatcacgccaccgcctaccngacagtggacncacgcctaggaacggtccgtacggaccacccgcctacgttcgttaacttacgtagtacgaactaaaacgtccgactaacttaaccggttaacggttaactttaccgtaaccggtacctttaaccttaacgtaaccgtaacgggttacgtacgggtaccgttacgggtacggggaaccggtaacgggaacccgtaccgggtccacccggttccctacccgtaccgaccgtaccccgtacccgaaaccggaaccgggtcccctaacggttaccccggttcccttaccccccggtcgcccctaacccccg

SEQ ID NO: 1535 - DNA, 647 bp, Homo sapiens
  misc_feature: GYAE6OF01B7LRP.13.21.B10.1.454.CMB.1.raw
  modified_base (280)..(280): a, c, t, g, unknown or other
  misc_feature (280)..(280): n is a, c, g, or t
tcagtcacgtactacacgaccggtgctcgatttagtgtcgtcgcaagagaggagggggggggtgcctcagccatggcatggatccctctcttcctcggcgtccttgcttactgcacaggatccgtggcctcctatgagctgactcagccaccctcagtgtccgtgtccccaggacagacagccagcatcacctgctctagaaataattggacagaataaatatacttcctggtatcagcagaagtcaggccacgtccctgtcgctggtcatctatcaagntcgccaagccgcctcgacgggactcccgtgacgtcgtattccgtcgtcggcctacctaacgtcgtacgggaactccacgccctactctacgaccctagtcgacggtaccggaaccgtaggacttagtcggtaatcggacggtctacgtacttaacttacgtgtcgaacgggtcgtacgggaacgtacggcaacggcctaacggtccgtacccgtacgttaggtcggttacccgttacgggtaaccggttcggggaaacccgtaacgggtaccctaacccggttaccgtacggtacccgaccggtaccccgaaaccggtaccccaaacccgtcttacgtaccctaccttcccgttcccgttccccccg

SEQ ID NO: 1536 - DNA, 556 bp, Homo sapiens
  misc_feature: GYAE6OF01D9PCM.13.21.B10.1.454.CMB.1.raw
  modified_base (158)..(158): a, c, t, g, unknown or other
  misc_feature (158)..(158): n is a, c, g, or t
  modified_base (226)..(226): a, c, t, g, unknown or other
  misc_feature (226)..(226): n is a, c, g, or t
  modified_base (284)..(284): a, c, t, g, unknown or other
  misc_feature (284)..(284): n is a, c, g, or t
  modified_base (536)..(536): a, c, t, g, unknown or other
  misc_feature (536)..(536): n is a, c, g, or t
tcagtcacgtactacacgaccggtgctcgattttagtgtcgtcgcaagagaggagggggggggggtgcctcagccatggcatggatccctctcttcctcggcgtccttgcttactgcacaggatccgtggcctcctatgagctgactcagccaccctnagtgtccgtgtccccaggacagacagccagcatcacctgctctaggaaataattggacagaataaatntacttcctggtatcagcagaagtcaggccagtcccctgtcgctggtcatctatcaagntgaccaaggccggccctcgacgggactcccgtagacgtcgtatttcgtcgtcggcctaccaacctcgtacgggaactcgacgcctactctacgaccatcgacggccgggacccaggctagtggatggacggtctagtacttacttacgtgtcgagggcggtaggacagcagcacgtcgccgtgtactcgttacgtacggacgtcggaaccacggtaccaccgtactaacgtcgacgcccgaacgcccacccnctacactctcgtcgtccccg

SEQ ID NO: 1537 - DNA, 808 bp, Homo sapiens
  misc_feature: GYAE6OF01AGRVK.13.21.B10.1.454.CMB.1.raw
  modified_base (199)..(199): a, c, t, g, unknown or other
  misc_feature (199)..(199): n is a, c, g, or t
  modified_base (207)..(207): a, c, t, g, unknown or other
  misc_feature (207)..(207): n is a, c, g, or t
  modified_base (406)..(406): a, c, t, g, unknown or other
  misc_feature (406)..(406): n is a, c, g, or t
tcagtcacgtactacacgaccggtgctcgatttagtgtcgtcgcaagagaggaggggggggtcaaccgccatccttgccctcctcctggctgttctccaaggagtctgtgccgaggtgcagctggtgcagtctggagcagaggtagaaaaacggcccggggagtctctgaagatctccgtaggtaagggttttgaaacngtctttancagccacgtggagtcggcgtgggtcgccgccgagcgtcggacccgggaaggccgtagggagtagggagtggggactacacgttctacgtccgtggtacactcgtgaactaccgaagtactaccgtaccgtccccgttcctaccgaacgccacggtccaccgtactcctacgacgaccgactaacgtccacgtaccaccncccgtaccccgaccttaccgtggtacgacggtacgggacgaccgaccggtccggttaacggaccggacccgaccggaacctccccgtactagtttacgtaactttacgtacgtaacgaaccgtaaaacgtccgtaacgttaacgttaaccggttaaccggttaacctacccggtaaccggtttacttaaccgtaacgttaaccgtaacggtacggtaccggtacggtaccgggaacggggtacccggaaccgggtaccccgtaccgggtacccgtaccccgttaccctaccccgtaccgtacccgtacccccgtaacccgtaaccccggtaacccggaccccgttaccgttaccccccggttacccccttccccccggtcccgtacccccgttaaccccccg

SEQ ID NO: 1538 - DNA, 780 bp, Homo sapiens
  misc_feature: GYAE6OF01B7XWM.13.21.B10.1.454.CMB.1.raw
tcagtcacgtactacacgaccggtgctcgatttagtgtcgtcgcaagagaggaggggggggtcaaccgccatccttgccctcctcctggctgttctccaaggagtctgtgccgaggtgcagctggtgcagtctggagcagaggtagaaaaaggcccggggagtctctgaagatctccgtggttaagggttttaggaaacagtctttatcagccacgtggagtcggcgtgggtcgcgaccgaggacgtcgggacccggggaaacggtccgtagggtaggtgggaggtggggatcagttcttacgtccgtaggtacgtaccttcgtgtaactaccgaagtactaaccgaccgtccccgttccttaccggaacggccacggtaccaccgtactcgtacacgacccgacaacgtccactcgacgaccgacccgacctaccgtcgacgaggtcggacgcgacgtccgtacggaaccggcccgtacggaccgacccgtacgtattacgtacgttacgtagtacgtaagtaaaacctacgaactaacttaaccgttaacgttaaccgttaccggtacccgttaacctttaacctaacgtaaaccgttaacggtaacgtacgggttaccggtaccgggttacgggaaccggtacgggacccggtaaccggtaccctacccggtaccttaccgtacccgtacccgacccgtaccccgaacccggtaaccggtccccgtaccggttaccccggttaccccgtttacccccgtcggtacccctaccccccg

SEQ ID NO: 1539 - DNA, 746 bp, Homo sapiens
  misc_feature: GYAE6OF01BYVLY.13.21.B10.1.454.CMB.1.raw
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (386)..(386): a, c, t, g, unknown or other
  misc_feature (386)..(386): n is a, c, g, or t
tcagtcacgtactacacgaccggtgctcgatttagtgtcgtcgcaagagaggaggggggggtcaaccgccatccttgccctcctcctggctgttctccaaggagtctgtgccgaggtgcagctggtgcagtctggagcaggaggtagaaaaacggcccggggagtctctagaagattctccgtaggttaagggttttaggaaacagtctttancagcctacgtggatcggcgtgggtncgccagtagtggacccgggaaagccgtagggagtagggagtaggggatactatcgtaatccgttgggtacacttcgtagtaactaccgaagtactacgacgtccccgtactacgaacggccagactacacatactcgacgtaccgaanaacgtccatacgacgtccacccgtacctaccgtgacgaaggtcgacgacacggtccgtaaggaaccggcccgtacggaacccacccgtacgtaacgttacgttaaacttaacgtcgtaaacgtaaacctaaaacgtcgtaacttaaacgtaaccgttaacggttaactaccggtaacgttaacccttaaacgtaaaccgtaacggtaacggtagtaaccgggtaccgttacgggtaaccgggacgaaacgggtaccctacggtaccctaccggttcctaccgttaccgaccgtccctaacccgtaaaaccgaccggtacccgtacgttcccggttaccccttccccggtcgtaacccccg

SEQ ID NO: 1540 - DNA, 882 bp, Homo sapiens
  misc_feature: GYAE6OF01DX4S3.13.21.B10.1.454.CMB.1.raw
tcagtcacgtactacacgaccggtgctcgatttagtgtcgtcgcaagagaggaggggggggtcaaccgccatccttgccctcctcctggctgttctccaaggagtctgtgccgaggtgcagctggtgcagtctggagcaggaggtagaaaaacggcccggggagtctctagaagatctccgtaggttaagggtttaggaaactagtctttatacagcctacgtggacgtcggtcgtgggtcgaccgaccgaggtacgtccgggaaccccggggaaagtccgtagggtacggtagggaggtaggggactactacttctacgttccggttggtaccactcgtacggactaacgactaactaccgtaccgtccccgtacctaccgaacggccgtacggtaccaactctactcgacgacccgaacacgtaccataccgacgaccctacccgtacctacgacgtacggacggtacggaccgacggacccgtacggtaacgggaaccccgtccggtacccggaacccgtaacccgtctaacggtttaactaccgttaacgttacggtaacaaaaccgttaaacgaccgtaactaaccggtttaaaccgttaccggttaaaccgtttccccggtaacccgtttaacctttaacccgtaaacgttaaccgggtaacggttaccggtaaccgggtcggttaccgggtaaccggggaacccggttaacccggggacccgtaaccggttcccgtaacccgggtttcctaccccgtaacccggtaccccgtacccgtaaacccccggaaccgggtaaccccggtaacccggtttccccggttacccccggtccccccgtttaccccggtccccgttaccccgtaaaccccccgg

SEQ ID NO: 1541 - DNA, 790 bp, Homo sapiens
  misc_feature: GYAE6OF01AQBP7.13.21.B10.1.454.CMB.1.raw
  modified_base (214)..(214): a, c, t, g, unknown or other
  misc_feature (214)..(214): n is a, c, g, or t
tcagtcacgtactacacgaccggtgctcgatttagtgtcgtcgcaagagaggtaggggggggtcaaccgccatccttgccctcctcctggctgttctccaaggagtctgtgccgaggtgcagctggtgcgagtctcggagcagaggtgaaaaacgcccggggagtccgtctagaagtacgtctaccgtaggttaaggggttttacggaaaaccnggtccttttaagtcaacggccctacgtgggtactcggtcgtgggtcgtccgccgagtagtacggacccgggtaacggtcgtgggacggtggtagtcggggatacgtactcgtaacggtccgtggtacgactcgtacgaagtacccgaagtaaccgtaccgtaaccggtccccgtaccgttaccggtaacggtacccgtacggttaccaaccgtactccgtacgaacggtaccaaccgtaactccgactacgacaccgcccgtaccgtactacggtcaaggtcggacgtcgaaccgttccgtacggaacggtcccgtaacggaccgtacccgacgtactacggtactacgtacgtacgaacgttaacgtacgtactaacgttaccgttacgtaacgtccgtacgttaccttaacgtaacgtaacgtaacggttcgtacggttacggttacgggtaccggtaacccgaacggtaccggtaccgtaccgtacccggtaccttccgacccgtcgtacccggtcccgaccggtaccgccgtacccggtcccgttacccgtccccgtcgtccccgtaccccc

SEQ ID NO: 1542 - DNA, 781 bp, Homo sapiens
  misc_feature: GYAE6OF01B0CYV.13.21.B10.1.454.CMB.1.raw
  modified_base (604)..(604): a, c, t, g, unknown or other
  misc_feature (604)..(604): n is a, c, g, or t
tcagtcacgtactacacgaccggtgctcgatttagtgtcgtcgcaagagaggaggggagaggagcccagcactgggattccgaggtgtttccattcggtgatcagcactgaacacagaggactcacatggtagtttggctgagtcgttgggttttccttgttgtcttaagttttaaaaggtcgtacccagtggtgaggtgcgagtcgtggtggtaggtcgtggaggacggtcttggtactaccgacggtccggtcggggggtccgtggacgtccgttcgttccgtggtcggtcgccgtccgttcggttcgggttacccgtaccggtacctacggtacccaacccgtaaccttaaccgagtcggtacggtccggttcgggtccccgccggtacggccggtaccggaacggggaacgggcggttagggtcggttcgttcgtttcgttttacgttttaatttaggttaggttacggtagtaagtacgtactcgtacgcgtacgtacgtcggtaggcgggtacctaactcctacgtaccttcgacgtaaacgtaagtaaaccttactaaaccgaaacgtaccacgtttaccttacgtttaccgtaaanaaccgttagaaaccttagggacgtacggaacttcgggaaccttggacccgaccgttacggtacgtttgtacgttgagtcgaggtaaagacggtcgggtaaccccgtaaccggtaacgttaacgacccggttagcccggttagaccggttacgggccgggttaaccgggaaacccggg

SEQ ID NO: 1543 - DNA, 1101 bp, Homo sapiens
  misc_feature: GYAE6OF01E2NA8.13.21.B10.1.454.CMB.1.raw
tcagtcacgtactacacgaccggtgctcgatttagtgtcgtcgcaagagaggaggggggggtcaaccgccatccttgccctcctcctggctgttctccaaggagtctgtgccggaggtcgcagcttggtgacgagtcgtgggacgacgaagggtaagggttaacggaaaaaaccgggccccgggggtaattcctcgttaaggtaaacgtacttccgttaccggttagggttttaaacggggttttacggaaaacctggttacttttaacgtcgaacgtccgtaacgttcggacgttccgggtcggtgggtccgaccgaccgtaaggtaccggtacccgggaaccgggtaacggtccggttaggggaacggttacggagggtacggtaactttacgtaaacttcgttaaccgttccggttaggttacctaccttaacgtacgaaaccgtaacgtaagtaaccgtaccccggtaccggttaccccgttacccgtaaccgggtaacgacccgttaacgcccaaccgttacgtcgaacgttacccgaaccgtaaacgttaaccgtccggaacttaccgaccggtaaccccgtaccccgttaaccgttacggtaggaccggttaaacggtccggacggttaccctaaaccgggcccgtaaacgggtacccggtacccgggtaaccccggaaccgtaaccggtaccgtttaacgtttaaggttaacccgtttacgtaacggttaaaccaaacggtttaaaacgtaccggttaaccgttaaaccgtttaaaaccgggtttaacccgtttaaaccgtttaaccccgggttaaacccttttaacgttaaaccccgggttaaacgttaaccgggttaaacgggttacccgttaaacggggtaacccgttcggggttaaaccccggggtaaccgggttaaacccgggtaaacccggtaccccgggttaaccctacccggttaccccggtccccgttaaccgacccggttaaccccgtaccccggtaaccccgtaaacccgggtcccccgttaacccggttaccccggtttaccccggtttaccccccgttcccgggttaacccaaccccccg

SEQ ID NO: 1544 - DNA, 578 bp, Homo sapiens
  misc_feature: GYAE6OF02GCSJD.13.21.B10.1.454.CMB.1.raw
  modified_base (365)..(365): a, c, t, g, unknown or other
  misc_feature (365)..(365): n is a, c, g, or t
  modified_base (369)..(369): a, c, t, g, unknown or other
  misc_feature (369)..(369): n is a, c, g, or t
  modified_base (459)..(459): a, c, t, g, unknown or other
  misc_feature (459)..(459): n is a, c, g, or t
  modified_base (497)..(497): a, c, t, g, unknown or other
  misc_feature (497)..(497): n is a, c, g, or t
tcagtcacgtactacacgaccggtgctcgatttagtgtcgtcgcaagagaggaggagccttagccctggactccaaggcctttccacttggtgatcagcactgagtacagaggactcaccatggaattggggctgagctgggttttccttgttgctattttagaaggtgtccagtgtgaggtgcagctgacggagtctgggaggagacttggtccaggccgggggggtccctgagactctcctgcatagtctacaagtatttagtgttcagtaattatggatgagcgtgggtccgccgaggctaccgaggggaaggggctgggagtggggtggccaacataaagcacgatggaagtggagaaacngtanggtggagtcgtgtaggaacggggcctattcaccctattcctaccaagacgaccaacgccaaagaactcaactgatctgactaggatggancagcctgagaggacgaggacacggctagtatattacgnggtacgacggaaggggttaactttagttttaactcgttaggtagttaaggttcggttacgggtttaccctaccggttaccg

SEQ ID NO: 1545 - DNA, 772 bp, Homo sapiens
  misc_feature: GYAE6OF02JRSXU.13.21.B10.1.454.CMB.1.raw
tcagtcacgtactacacgaccggtgctcgatttagtgtcgtcgcaagagaggaggggggggtcaaccgccatccttgccctcctcctggctgttctccaaggagtctgtgccgaggtgcagctggtgcagtctggagcagaggtagaaaagcccggggagtctctgaagatctctgtaagggttttggaaacagtctttatcagccacgtggatccggcgtgggtcgccgccgagtagtcggacccgggaaaggtccgtggaggtgggaggtaggggatcgatctactccgtggtagtacttacgtagtaactaccgaagtactaccgtaccggtaccccgttcccgttaccggaacggtaccgtaacggtacccaacccgtacgttaccgtccgaacggtaccccgtaaacgtaaccggttcccaacgttaccgaaccgacccgtaaccccgtacccgttaccgtacgtaccgaaggtacggacgtaccggtacgtaccgtaacggaaccggtcccgtaacggacccgtacccgacttacgttacggttaactacggtacgtacgaaactaaacgtcgtaactaacgtaacgttacgttaacctaccgtacttaccgtactaaccgtacgtaaccggtgaccggtacgtacggtacgggaacgtaccggacctccggtacctaccgttacctaccgtccgaccgtaccctaccggaccgtaccggtaccctcggttaccccggtccctccccggtacgtcccctaaccccg

SEQ ID NO: 1546 - DNA, 690 bp, Homo sapiens
  misc_feature: GYAE6OF02JGRPB.13.21.B10.1.454.CMB.1.raw
  modified_base (495)..(495): a, c, t, g, unknown or other
  misc_feature (495)..(495): n is a, c, g, or t
  modified_base (653)..(653): a, c, t, g, unknown or other
  misc_feature (653)..(653): n is a, c, g, or t
tcagtcacgtactacacgaccggtgctcgatttagtgtcgtcgcaagagaggagggggggggtgcctcagccatggcatggatccctctcttcctcggcgtccttgcttactgcacaggatccgtggcctcctatgagctgactcagccaccctcagtgtccgtgtcccccaggacagacagccagcatcacctgctctaggaataacttggcagataagtatacttctggtatcagacagaagtcgagtccagtcccctgtcgtcgtggcatctatcaagatgaccagccgcccgtacgacgggactacccgtgaacgtcgtacttctaccgtcggacctaccctaaccttcggtacggggtaaccttcacgtacccaccgttctacgaaccctactaccggacggcccgggaacccgtggacttaggtacggtacgtaggacggtcttagacctttaagttaccgtgtacggtacgggtacggtacgggaacnggtaccaggtccctaacggtccgacccgttctagttcgttaccggttacgggtaaccggtccgggtaaccgtacggttacccgtacccggtaacttaaccggtacccgtaaccggtaacccggtaacccggaccccgttaaacccccggtgtttaccnccccggttaccttacccggttcccgttaaccccccgg

SEQ ID NO: 1547 - DNA, 547 bp, Homo sapiens
  misc_feature: GYAE6OF01BA1W6.39.26.C04.1.454.CMB.1.raw
tcagtcgcactagtcacgaccggtgctcgatttagtctagcgactttgggtttggggctgagagaggagcccagccctgggattttcaggtgttttcatttggtgatcaggactgaacagagagaactcaccatggactttgggctgagctgcctttttcttgtggctatgttaaaaggtgtccagtgtgaggtgcagctgttggagtcgtgggggagcttggtacaggccgggggggtccctgagactctcctgtgcagcctctggattcaccttcagcagctatgccatcgacctggggtccgccgaggcctccgagggaagggactgggagtgggtctcgtctagttagtggaagtggtgcttatacaaactacgcagcctcgtgacggcctctcaccatctccagacactattacaagacgcactctagtatctgacaaatcgaacacgcctagagtcgaccgacggaccgaccgccctattattattgtgtacgaaggtgggtagggggaggtcggggtcttacgtcgtggtcgtttgtacg

SEQ ID NO: 1548 - DNA, 730 bp, Homo sapiens
  misc_feature: GYAE6OF01A670N.39.26.C04.1.454.CMB.1.raw
  modified_base (516)..(516): a, c, t, g, unknown or other
  misc_feature (516)..(516): n is a, c, g, or t
tcagtcgcactagtcacgaccggtgctcgatttagtctagcgactttgggtttggggctgagagaggagcccagccctgggattttcaggtgttttcatttggtgatcaggactgaacagagagaactcaccatggactttgggctgagcttgtcctttttcttgtggctatgttaaaaggtgtccagtgtgaggtgcagctgttggagtcgtgggggagtcttggtacgaggggtccggggggggtccctggacgtacctccgtccgtgtacagtctcgtggtattcgagtcttacgcctacctatcgccagtgacggtcgtcgggtcccgccgacggtccgtaccggaggggaacgggcgtagggaggttcgggtctaccgactccgtagttacggtggtcgaccgtagggtaggtaggtaactactaagttattagtgtacggtacgtccggtaggtaccgggtccgttaccaccgtactccgtacgaagactaacctaacgttacccgaaanacctactacgttacgtactccgtaagaactaaacgtcgaactacgtccgtaggacggtacccggacggtaaccggaccgtaacccggtaccttaagtaacgtttacgtacggtacggtaaccgttaacccgttcccggttacccgttaacggtttacggtaaccgggttttacccaacccccttaaaccgtttcgttaacccggtacccccggg

SEQ ID NO: 1549 - DNA, 707 bp, Homo sapiens
  misc_feature: GYAE6OF01COR23.39.26.C04.1.454.CMB.1.raw
  modified_base (250)..(250): a, c, t, g, unknown or other
  misc_feature (250)..(250): n is a, c, g, or t
  modified_base (307)..(307): a, c, t, g, unknown or other
  misc_feature (307)..(307): n is a, c, g, or t
  modified_base (324)..(324): a, c, t, g, unknown or other
  misc_feature (324)..(324): n is a, c, g, or t
  modified_base (333)..(333): a, c, t, g, unknown or other
  misc_feature (333)..(333): n is a, c, g, or t
  modified_base (350)..(350): a, c, t, g, unknown or other
  misc_feature (350)..(350): n is a, c, g, or t
tcagtcgcactagtcacgaccggtgctcgatttagtctagcgactttgggtttgggggaggcttggtacaggcggggggggtccctgagactctcctgtacagtctctggattcagctttagcacctatgccatgagctgggtccgccaggctccgaggggagggctggagtgggtctcatccattagtggtgccaggtggtaggtaatacatattatgtgactcgtgaacgggcgttcacatctcaganacattccaagacactctgtatctgactaaagtgaacagcctgagccgacggaggacnccggcctatatactgtnacgaatccnccgtattggaggtttcnccctaactaactttgacctccggtcgggccaacgggaaccctcgggtcctaacccggttctccctacgacgtccctacccgaccgtaaccgggcccctaacggttccccggtttaccccgttcccccgtccgggtacccctacccccctttaccccgtacccgaaacccggtacgtaccccgtaacccgttccgggtaccggggggaccctaaccggaaccgggcccgggtccccgggtcgggtcccgtccggtccgtacgggtaccgtaaacgggtacccttaccgttacccctaacgtacggttcgaccggtacgacggtacgggccggtcgtacgggacgtacggcgtcgaagg

SEQ ID NO: 1550 - DNA, 758 bp, Homo sapiens
  misc_feature: GYAE6OF01EL2U6.39.26.C04.1.454.CMB.1.raw
  modified_base (636)..(636): a, c, t, g, unknown or other
  misc_feature (636)..(636): n is a, c, g, or t
tcagtcgcactagtcacgaccggtgctcgatttagtctagcgactttgggtttggggctgagagaggagccccagcccctgggatttttcaggtgttttcatttggtgatcaggactgaacagagagaactcaccatggactttgggctgagctgtcctttttcttgtggctatagttaaaaggtgtcagtgtgagtgcagcgtggttggaggttcggtgggggacggtcgtttgggtaacggacggggtcccggggggggttccctaggacgtaccttccgtcccttagtaccgtacgttccgtcgttggtactttcgaacgttaccgttttaacgaccctaaccttagtcgacctaagtggacggtccggttccggggtccccgaccgggacgggtccggtaccgggaaggggggacgggtacgggttagggtacgggttcgggttcctacgtaccgtaccgttaagtttacggtgggtacggtaccggtagggttacggtaaggttaaactacgttaagttagtttaagttggtacggtaccgttaccgggtacgggaccgggttaccgtaccaccgtactccgaccgaagacgtaaacctaactacgaaacgacctactctagtactactanaacgtaacaagaaccacgcgtacgaccgccgacgaccgacgaaccgtctattacgtcgtagtaccgtaataccgtccgtacgttagtcgttacgtccgaacctaccgttcgtccgtacccgg

SEQ ID NO: 1551 - DNA, 741 bp, Homo sapiens
  misc_feature: GYAE6OF02GHHNF.39.26.C04.1.454.CMB.1.raw
tcagtcgcactagtcacgaccggtgctcgatttagtctagcgactttgggtttggggctgagagaggagcccagccctgggattttcaggtgttttcatttggtgatcgaggactgaacagagagaactcaccatggtacgtttgggctgagctgtcctttttcttgtggctatagttaaagtgtcagtgtgaggtgcagcgtgttggagtcggtgggggagtcgttggtacgagggccggggggtcctggacgactctccgtgtacgagtctcgtggtattcgagtctttagccaaccttagtcgacctagtgacgtcgtcgggtcccgccgaggcctaccggaaggggaacgggcgtgggaggtggtctcacgtcctaagttaggtggtcgaccgtaggttgggtaggttaaactacgtaattagtttaagtggttacgggtaccttccgggtaggtaaacgggggtcccggtttaccaacccgtacgttccgtacccgaaggtaacgaaacgttaaaccttaacccgaaaacgtaaacctaacgttacttacgttaacttcgttacgaactaaaagtcgaaaacgacgtcccgtaggaccggtaccgacccgggaaagacccgtaaccggacccttaagttacgttacgtagggttacgaaccgtaaacttcccgttaacccgtacgtttaggtacggttttaccgaccccgtaaccttaaccgttttgtaaccccgg

SEQ ID NO: 1552 - DNA, 730 bp, Homo sapiens
  misc_feature: GYAE6OF02GCL0O.39.26.C04.1.454.CMB.1.raw
  modified_base (283)..(283): a, c, t, g, unknown or other
  misc_feature (283)..(283): n is a, c, g, or t
tcagtcgcactagtcacgaccggtgctcgatttagtctagcgactttgggtttggggcgtgagagaggagcccagccctgggattttcaggtgttttcatttggtgatcaggactgaacagagagaactcaccatggactttgggctgagctgcctttttcttgtggctatgttaaaaggtgtccagtgtgaggtgcagctggttggagtcgtgggggaggcttggtacagggccggggggggtccctggagactctcctgtacagcctctggattcaccttnagcagctatgccatgacctgggtccgccgaggctccgaggggaagggactgggagtgggtctcgtctagttagtgggaagtggtgtactttagtaaccaaacgtacgcaacgcccttacccggtaggaaacggggtccccgtccgtttaccaaccctacttcctcccgaaggtacgtaaccttaacttacccgaaaggaacgcctaaccttcgttacgttaacttaccgtagtacctaaaacgttcgaaaaccgtacggtacccgttaggaacggtcggacccggagggaacccgtacccgggtacccgttaagttaacgtttagtttacggtacggaacgggtaaacgtttcggggtaggggggggttacggttacgggggggtacctttaaccggttaccccggtttaggggttcccggttttttagggaccggtttaaccgggg

SEQ ID NO: 1553 - DNA, 757 bp, Homo sapiens
  misc_feature: GYAE6OF02J01EA.39.26.C04.1.454.CMB.1.raw
tcagtcgcactagtcacgaccggtgctcgatttagtctagcgactttgggtttggggctgagagaggagcccagccctgggattttcaggtgttttcatttggtgatcaggactgaacagagagaactcaccatggagtttgggctgagctggctttttctgtggctattttaaaggtgtccagtgtgaggtgcagctgttggagtcgtgggggagcgttggacgaggccggggggtcctggagactctccgtgtgcagcctcgtggatcctacctcgagcagctagtgcctatcgccgtgggtcccgccgtacggccgtccggaaggggacggaccgtagggtaggtcgggtcgtcgttcttaagttagtagggtaacgtggtacgtacgtttaagtaaccgaaactaccggcaacggtcccgttacccgggaggtaaccggggcccgtaccgtttacccacccgtaacgtccgtacccgaaggtacgtaaccgttacgttaaccgaagtaaccgacctacgttaccgttacgttactaccgttcgaaaccgtaaggtacgtaaaccgtacgccgttacggaacggttccggaaccggtaacggaccgtaacccgacccgtttaacgttaacgtttacgttagttacgggaccggttaaaggttcgggggttaggggggtaacggttccgggggtaccgttaacccggttccgggtttccggtttaaccggttttaccggtaccggttaaccgggg

SEQ ID NO: 1554 - DNA, 798 bp, Homo sapiens
  misc_feature: GYAE6OF02JXTXP.39.26.C04.1.454.CMB.1.raw
  modified_base (726)..(726): a, c, t, g, unknown or other
  misc_feature (726)..(726): n is a, c, g, or t
tcagtcgcactagtcacgaccggtgctcgatttagtctagcgactttgggtttggggctgagagaggagcccagccctgggattttcaggtgttttcatttggtgatcaggactgaacagagagaactcaccatggactttgggctgagctgtcctttttcttgtggctatagttaaaaggtgtccagtgtgaggtgcagctgttggagtcgtagggggaggtcgttcgggtacgagggtccggggggggttccctgggaacggtacctcgttccgtaggttaccgacgttccgtcgttacggtaactttccgtaggttccgttttaacggaccctaaccgttacgtccgggtaccctaaggttcggtaaccggtccggttccgggggtaaccccgtcccgggtaaccggtccggtaccgggtaacggggggtaaaccggggtcgtacggggtagggttcggggtcctacgtacgttacccgtaaggtttacggtcggggtcgtaccgtcgggttacgggtacgggttaactaacgtacgtttaattacggttagggttacgtaccgggttaccggtacgggtaacgggtccgttaccgactaccttcgtaccgagtaacgtaacgttactaacgaacgtaaactcgttactacgttaactctagtaccaaagttccgaaacgtcggacgttcgagccgacgaacggtccgaacgttcctaacgtnttacggtacgtacaaccgtactacgtaccgttgttacgtacggtccctaccgtaacttcgttccgtaccggg

SEQ ID NO: 1555 - DNA, 698 bp, Homo sapiens
  misc_feature: GYAE6OF02H9H2I.39.26.C04.1.454.CMB.1.raw
  modified_base (298)..(298): a, c, t, g, unknown or other
  misc_feature (298)..(298): n is a, c, g, or t
  modified_base (517)..(517): a, c, t, g, unknown or other
  misc_feature (517)..(517): n is a, c, g, or t
tcagtcgcactagtcacgaccggtgctcgatttagtctagcgactttgggtttggggctgagagaggagcccagccctgggattttcaggtgttttcatttggtgatcaggactgaacagagagaactcaccatggactttgggctgagctgcctttttcttgtggctatagttaaaaggtgtccagtgtggaggtgcgagctgttggagtcgtggggggaggcgttggtacgagggccggggggggtccctgagtactctcctgtacagtctctggattcagtctttagctaactanagccagtcgagtcgtgggtcccgccgacggccgtccgaacggggaacggggtctggggaggttcgggtctacgtctacgtagttacggtggtcgaccgtagggtaggtaggtaactaacgtattaattagtcgtacggaccgtcggtcgggtaacggggtccgttacgacctacttcccgtaccgaggtaactactaaaccgttaccaaaggtaaaccncgttcgttagtacttcgtacgaacgtaaaacgtcgaaacgacgttcctacgggaacgcccggaaccgggaacgtaaccggaaacccgtcccttaagtactttacgtgacggtaaccgtaactccccggttacctacgttcggtaccggtttccgaaccctaactttaccgttgtaacccgg

SEQ ID NO: 1556 - DNA, 783 bp, Homo sapiens
  misc_feature: GYAE6OF01D2DG1.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagagccgtggggcctcgagtgaaggtctccgtgacgaaggtcttcgtggactacctaccttccgaccggtctactatactacacgtgggtgcgacgacggccccgtaggacgaagggtcttaggaggtggagtgggacggtagtaccgaaaccctaagaagtcggtacgaccctaacgtcgtagtaacgtcgactaaaccgtaagttaaacctttacggaacgggtaacggtaacggggttacccaaccgtaagtaccggaacccggaaggggaaccctaaccggtaacctaactaacccaaaccgaaccgaacgggtaaccctaaccgtaacggtaccggaacccgttagggaacgtacccgaacggtacccctaacggtaaccggtaacccgttacggaaccccggaaccgggtaacccggggttaccgtttaccgtttaaaccgttttccggttacggtacgggtaccggtaacgggttacccggtttaccccgttaaggtttccggggtttaacccggggaccccgttaaaccggggttccggggttaaaccgtttacgggtaaaccccgggg

SEQ ID NO: 1557 - DNA, 509 bp, Homo sapiens
  misc_feature: GYAE6OF01CRM9G.43.5.A05.1.454.CMB.1.raw
  modified_base (453)..(453): a, c, t, g, unknown or other
  misc_feature (453)..(453): n is a, c, g, or t
  modified_base (458)..(458): a, c, t, g, unknown or other
  misc_feature (458)..(458): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagctggggcctcagtgaaggtctcctgcaaggcttctggatacaccttcaccggctactatatacactgggtgcgacaggccctggacaagggcttgagtggatgggacggatgaaccctaacaatggtgccactctgtatgcacagtaacttcaggacagggtcacatgaccgagggacacgtcatcaacacaggctacatggacctgacgcacgcctcagacctgacgacgacgggctctattcngtcgngagtcgtaccctagttcggttcgggaccctaagtcggggtactttgtaccg

SEQ ID NO: 1558 - DNA, 549 bp, Homo sapiens
  misc_feature: GYAE6OF01BOOIH.43.5.A05.1.454.CMB.1.raw
  modified_base (310)..(310): a, c, t, g, unknown or other
  misc_feature (310)..(310): n is a, c, g, or t
  modified_base (326)..(326): a, c, t, g, unknown or other
  misc_feature (326)..(326): n is a, c, g, or t
  modified_base (368)..(368): a, c, t, g, unknown or other
  misc_feature (368)..(368): n is a, c, g, or t
tcagtgtgagtagtcacgaccggtgctcgatttagatagatagacagggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggaactgtcaccagtgtcattatccctatggttccagcagaagcctggccacggcccccggacactgatttatgatacaagcaacaaactttcngacactgcccgattcncacgctcctcgtggggcaaacgctgccctcgaccttcgggtncgcacgcctgaggatgaggctgactattactgtcttgctcgtcctagttcatcgccgtgttccgggtttcgggcggagggaccaaggtttacgaccgtacgtagtcacgaccgaacggcctaccgcccccgtcggtaccacttcctaccgttcccccaaccctcccgttacctcctaaccc

SEQ ID NO: 1559 - DNA, 531 bp, Homo sapiens
  misc_feature: GYAE6OF01BEZQO.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccggctactatatacactgggtgcgacacggcccctggacaaggggcttggagtggagtggggacggagtgaaaccctaacaagtggtgccactctgtatgcacagtaactttcaggacagggtcacatcgaccagggacacgtccataccaacacaggctacagtacggacctgagcagcctcacgacctgacgacgacgggcgtctagttctggtcgcggaggtcgttcccgtagtggttcgggaccctaaggtcggggtactttggtaaccg

SEQ ID NO: 1560 - DNA, 516 bp, Homo sapiens
  misc_feature: GYAE6OF01CCY5Y.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatggaaccctaacaatggtgccactctgtatgcacagaactttcgaggacagggtcaccatcgacagggacacgtccatcaacacaggctacatcggacctgacgcacgcctacacgacctgacgacgacgggcgtctatttctgtcgagagtcgtccctagtcggttcgggccctaagtcgggtactttggaaccg

SEQ ID NO: 1561 - DNA, 586 bp, Homo sapiens
  misc_feature: GYAE6OF01DIS0Y.43.5.A05.1.454.CMB.1.raw
  modified_base (285)..(285): a, c, t, g, unknown or other
  misc_feature (285)..(285): n is a, c, g, or t
  modified_base (329)..(329): a, c, t, g, unknown or other
  misc_feature (329)..(329): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacncggccctggacagggcttgagtgagtgggacgatcgaacctaanaatggtagccactcgtgtatgacacagtaactttcgaggacagggtcacgatcgacagggacacgtcatcaacacaggactacagtcgacctgacgcacgcctacgacgaccgtagaacccgacgaaccggggtccgtttaccgtacgtttttccgcgggttacggtaccggtacggttaccggttacccccttaaggtttccgggtttccggggaaccccgtaacggttacgggggttacttttcgggtaacccgg

SEQ ID NO: 1562 - DNA, 584 bp, Homo sapiens
  misc_feature: GYAE6OF01CERHI.43.5.A05.1.454.CMB.1.raw
  modified_base (567)..(567): a, c, t, g, unknown or other
  misc_feature (567)..(567): n is a, c, g, or t
tcagtgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggaactgtcaccagtggtcattatccctatggttccagcagaagcctggccacggcccccggacactgactttatgatacaagacaacaaactttcctaggacacctcgcccgattctcacggtcctcccgtccgttgggggacaaacgctcgccctgtacccgtttcgggtcgccgcgacgcctggaggagtgaggctgacttattacgtgtcttgctccgtcctatgatcgcgttcgtcgttcggggttttcggcgggtacgggacctaaggttcgacccggttcgtacggtccgacggcccgaacggtcctaccgcccccgtcgtcctacctcctaccgttccccncccctccgtcctaaccc

SEQ ID NO: 1563 - DNA, 540 bp, Homo sapiens
  misc_feature: GYAE6OF01C956I.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggagtgggacggatcgaaccctaacaatggtgaccactctgtatgcacagaactttcaggacaggggtacaccagtacgacgagggacacgtccataccaacacgaggctacagtcggacctgacgcacgcctcacgacctacgacgacgaccgggtcgtctatttcgtggtcgcgagtccgtccctagttcggttcgggaccctaaggtcggggtactttggtaacccgg

SEQ ID NO: 1564 - DNA, 556 bp, Homo sapiens
  misc_feature: GYAE6OF01EJ2SE.43.5.A05.1.454.CMB.1.raw
  modified_base (294)..(294): a, c, t, g, unknown or other
  misc_feature (294)..(294): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccacggccccccggacactgatttangatacaagcaacaaactttccaggacacctgcccgattctcacgcctccctccgttggggacaagctcgccctcgtacccgtttcgggtcgcgcagcctgaggatgagctgactattactgcttgctcgctatgactcgccgtcgttcgggtttcggcgggtacgggacctaaggttcgaccgtcgtaggtcacgcccgaacggtcctccggcccccgtcgggtaccacgttcccgtcgttcccccgccctccctcactacc

SEQ ID NO: 1565 - DNA, 584 bp, Homo sapiens
  misc_feature: GYAE6OF01BQHTQ.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctccgtgcaaggcttcgtggactacaccttcaccggctactatatacacgtgggtcgcgacacggcccgtggacgaagggcttggagtggagtgggacggatcgaaaccctaagaagtcggtcgccactctggtatgcacgagtaactttcgaggacgagggtcaccgatcgacgagggacaccgtacatacaacacaggactacgagtcggacctcggagccgacgcctacgaacgaccgttacggaacgaccggaccgggtcgttacttacgtttccgtggtcggacgacggtacgttcccgtagttcgggttacgggaccctttaagggtcgggttacgtttggtaaccgg

SEQ ID NO: 1566 - DNA, 514 bp, Homo sapiens
  misc_feature: GYAE6OF01A3GD3.43.5.A05.1.454.CMB.1.raw
  modified_base (330)..(330): a, c, t, g, unknown or other
  misc_feature (330)..(330): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacgatgaaccctaanaatggtgccactctgtatgcacagtaactttcaggacagggtcaccatgacagggacacgtccatcaacacgaggctacatcggactgagcagccctacgacgacctgaccgacgacgggctcttattcgtggtcgcgagtcgtcctagtcgttcgggccctaaggtcgggtacttggtaaccg

SEQ ID NO: 1567 - DNA, 567 bp, Homo sapiens
  misc_feature: GYAE6OF01A7IZF.43.5.A05.1.454.CMB.1.raw
  modified_base (285)..(285): a, c, t, g, unknown or other
  misc_feature (285)..(285): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcacggtctcacctgtgctccagcactggaactgtcaccagtggtcattatcctactggttccagcagaagcctggccaacggccccccgganactcgatttatgatacaagcaacaaactttcctaggacacctgccgattctcaggctcctcgtggggcaaagctagccctgacccgtttcggtcgcgtcacgcctggaggatggacgtctgacttattactgtcttgcctcgtccttatgatcgcgtcgtttacgggtttcggacgggtacggtacctaaggttccgtaccgtcgtaggtccacgacccgaaggtcctacgccccgtcggtccaccgttccgtccgttccccgcccttcctccgtacctacc

SEQ ID NO: 1568 - DNA, 669 bp, Homo sapiens
  misc_feature: GYAE6OF01C56BZ.43.5.A05.1.454.CMB.1.raw
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtgctccagcactggaactgtcaccagtggtcattatccctactcgttccagtcagaagcctggccacggccccccggacactgatttactgaatacaagacaaactaaactttccaggaccacctcgcccgtattctcacggtcctcccgttcgtggggactaagctcgcctcgtcccgtttcggtcgccgtcgacgccgtggacggtgtaggacggctaggtaacttattaccgtggtctttcgccgttaccgccttagtcgacgtccggtccgttccggtttcgggggtttcggaccgggtacgggtaccgtaaggttccggtacccgttacgttacgggtaccgacggtacccgtaacgggtccctacccggcccccgttccgggttaccctacccgtttccccggtttcccggtttaccccccgtacccccgtttcccctcccgtaacccgttaaccccg

SEQ ID NO: 1569 - DNA, 668 bp, Homo sapiens
  misc_feature: GYAE6OF01B3MC8.43.5.A05.1.454.CMB.1.raw
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtcgtcccaggagggacagtcactctcacctgtcgctccagcactggaactgtcaccagtggtcattactccctattcggttacagcaagacgccgtcggaccgaccggcccccggacacgtgtactttagtacgtaactaacaacgactaaactaaacctttccgtacggaacctaccgtacgacccgtacttccgtacgtaccggtcccttcccgtaccgggttacggggacctaacgtccgtcgtcccgtcgtacccgtttcggtcgcgtcgacgtcgtagacggtacgtacggtacggtctacgtacttacgttacgtcgttacgttcgtcgtccgtaccttacgtcgtacgtccggtccggttccggttcggggtttccgggacggggtaacggtaccgtacggtccggtaccgtccgtacgtcgaccgaccgacgtccgtccgtcccgtcgtcctccgttccgtccgttccccgtcctcctcctctacc

SEQ ID NO: 1570 - DNA, 590 bp, Homo sapiens
  misc_feature: GYAE6OF01B3FZX.43.5.A05.1.454.CMB.1.raw
  modified_base (336)..(336): a, c, t, g, unknown or other
  misc_feature (336)..(336): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcgtgggcctcagtgaaggtctcctgcaaggcttctggatacaccttcaccggctactatatacacgtgggtgcgacgacggccctggacgaagggcttggagtggagtgggacgagtacgaacctaanaagtggtcgcacgtctgtatgcaacacgtaactttcgaacggtacacgggtacaccgatcgaacgacgggacacgtacacgtacaacacaggactacgagtcggactgacgccgacgcctacgacgacctcgaaccgacgaccgggtcgttacttaagtttccgtggtacgtacggtaacggtaccgttcccgttaaggttcgggttaccgggacccgtaaacggttcggggttaacgttttcggtaacccggg

SEQ ID NO: 1571 - DNA, 519 bp, Homo sapiens
  misc_feature: GYAE6OF01ATWFJ.43.5.A05.1.454.CMB.1.raw
  modified_base (331)..(331): a, c, t, g, unknown or other
  misc_feature (331)..(331): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaaggcttctggatacaccttcaccggctactatatacactgggtgcgacacggcccctggacaagggcttgagtggagtgggacgatcgaacctaanaagtggtcgccactctgtatgcacagtaacttcgaggacagggtcacatcgacgagggacacgtcaatacaacacaggctacatggactgacgcagcctcgagacctaggaccgacgacgggtctcttactttcgtggtagcgagtcgtccgtagttcggtcggacctaaggtcgggtacttggaacg

SEQ ID NO: 1572 - DNA, 595 bp, Homo sapiens
  misc_feature: GYAE6OF01BK3QA.43.5.A05.1.454.CMB.1.raw
  modified_base (289)..(289): a, c, t, g, unknown or other
  misc_feature (289)..(289): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtcccagggaggacagtcactctcacctgtgctcagcactggaactgtcaccagtgtctattactcctatgttccagcagaagccgtggccacggcccccgacactgtatttangatacaagcaaactaaactttcctaggaccaccgtcgaccgtattcctcacggtcctcccgtcgtggggacaagctcgccgtcgtacccgttcggtcgtcgcacgccgtagacggatcggacggtctagtaacgttactacgtgtcgttcgtaccgttcgtccttagtcgtactcggcgtcgttcggggtttcggcggtacggtacgtacgtcgtaccgtccgttaggcacggaccgacggccgttcgaccccgtcgtaccctaccgttcgtccgttaccccacccgttccctcgtccttaacccg

SEQ ID NO: 1573 - DNA, 506 bp, Homo sapiens
  misc_feature: GYAE6OF01BMZQF.43.5.A05.1.454.CMB.1.raw
  modified_base (450)..(450): a, c, t, g, unknown or other
  misc_feature (450)..(450): n is a, c, g, or t
  modified_base (459)..(459): a, c, t, g, unknown or other
  misc_feature (459)..(459): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaaccctaacaatggtgccactctgtatgcacagaactttcaggacaggggtcacatgacagggacacgtccatcaacacaggctacatggacctgacgcagcctcagacctgacgacacgggctactnttctggtgngagacgtcctattcgtcgggcccaaggtcgggtactttggtaaccgg

SEQ ID NO: 1574 - DNA, 523 bp, Homo sapiens
  misc_feature: GYAE6OF01A9YI0.43.5.A05.1.454.CMB.1.raw
  modified_base (335)..(335): a, c, t, g, unknown or other
  misc_feature (335)..(335): n is a, c, g, or t
  modified_base (421)..(421): a, c, t, g, unknown or other
  misc_feature (421)..(421): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcacggctactatatacactgggtgcgacaggcccctggacaagggcttgagtggatgggacgatgaacctaacaatggtncactctgtatgcacagaactttcgaggacacgggtcacgatcgacgagggacacgtacatcaacacgaggctacgactcggtaccngacgcgacgcctacacgacctgaccgacgaccgggctacgtatttccgtgtcgacgaggtacgtcctagtcgttcgggacctaggtcgggtattgtaaccgg

SEQ ID NO: 1575 - DNA, 560 bp, Homo sapiens
  misc_feature: GYAE6OF01B4S2U.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactccccaggtgcagctggtgcagtcgtggggctggaggtgaagaagccgtggggcctcagtgaaggtctcctgcaaggcttctggatacaccttcgaccggctactatatacacgtgggtgcgacacggccccgtggacgaagggcttggagtggagtgggacggatacgaaccctaacaagtggcgccactctgtatgacacagtaactttcgaaggtacgagggtccaccatcgaaccgacgggacacgtccactacaacacgagctacgatcggacctgacgcgacgtcctcgacgacctcgaccgaccgacgggtctacgttatttcgtgtcgacgacggtcgttccctagttcggttccggacccgaaggtcgggttcttcggtaaccgg

SEQ ID NO: 1576 - DNA, 539 bp, Homo sapiens
  misc_feature: GYAE6OF01B4G0Q.43.5.A05.1.454.CMB.1.raw
  modified_base (316)..(316): a, c, t, g, unknown or other
  misc_feature (316)..(316): n is a, c, g, or t
  modified_base (376)..(376): a, c, t, g, unknown or other
  misc_feature (376)..(376): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccacggccccccggacactgatttatgatacaagcaacaaactttccnggacacctgcccgattctcaggctccctcgttggggcaagctgccctgaccctttcgggngcgcgagcctgaggatgaggctgacttatactgcttgctcgcctatgatgccgtcgttcgggttttcggcgggtagggacctaagttcgaccgtcgtaggtcacgcccgaaggcctcgcccccgtcggtccacgttctcgttccccaccgtccctcactaccc

SEQ ID NO: 1577 - DNA, 543 bp, Homo sapiens
  misc_feature: GYAE6OF01BUBQH.43.5.A05.1.454.CMB.1.raw
  modified_base (487)..(487): a, c, t, g, unknown or other
  misc_feature (487)..(487): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctccgtgcaaggcttctggatacaccttcaccggtctactatatacactgggtgcgacacggccctggacgaaggcttggagtggagtgggacgatacgaacctaagagtggcgcactctgtactgacacgacgtaactttagacggacgaggtcactagtcgacgagggacacgtacatacaacgacacgactacagtcgacctgacgcacgccacgacgacctacgaccgacgacgggcttactattcgtggtcgngacggtcgtacctaggtcggttcggaccctaaggttcgggtacgttggtaacccgg

SEQ ID NO: 1578 - DNA, 669 bp, Homo sapiens
  misc_feature: GYAE6OF01D43BF.43.5.A05.1.454.CMB.1.raw
  modified_base (294)..(294): a, c, t, g, unknown or other
  misc_feature (294)..(294): n is a, c, g, or t
tcagtgtgagtagtcacgaccggtgctcgatttagatagatagacagggggagcatcacccagcaaccacatctgtcctctagagaatcccctgagagctccgttcctcaccatggactggacctgggaggatcctcttcttggtggcagcagccacaggagcccactcccaggtgcagctggtgcagtcgtggggctgaggtgaagaagccgtggggcctcgagtgaaggtctccgtgcgaaggtcttcgtggactaccaccttcgaccggtctactatatacacgtgggtcncgacgcggccccgtaggacgaggtcttggacgtggagtgggacgtagtacgaaacctaacgtaagtggtacgacccgacttcgtagtaagtcgacctaaacgtaacggttaaaccgtttcgaaacgggtacgtaacggggtaccaaccgtagtaaccggaacccggtaacgggaacctaacccggtaccctaacgtaaccaaaccgacgtaacggactaacgacgtacggaccgtaggacgcgaaccgtccgtacgaacgaccgtacggaaccgaccggtacggtccgttacttacgttcgtggttcgaggtacgtccgttacccgtggttcggttaccggaccgttaaggttcgggttaacgttcggtaaccgg

SEQ ID NO: 1579 - DNA, 903 bp, Homo sapiens
  misc_feature: GYAE6OF01CPBC4.43.5.A05.1.454.CMB.1.raw
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggacgccctcactgactgtcgtcccgaggaggacagtcactctcacctgtgctcagcactggactgtcacagtgtcattactcctacgtgttaccagtcaagaacgccgtcggcccgaccgggtacccccccggaacaccgttagtacgttttaacgtacgtaaacttaccaaacggtaacctaaaaccttaaaaacccgtttttccgaacgggtaaccctaaccccgttacggtacccccggttaactttacccggtaacgtaacccgggttccccctttaccccccggtttacccgggttttaccgggggggggaaacccttaaaaaccgggtcccgtttacccgggtacccccgtttacccgggtttaacccccccgggttttttcggggggtacccggttaccccgggtaccgtaaccgggttccccggttaagggtaaccggggtaacggttacgggtaacgggtaccggtttacgttaaacgtttaacgtttaaccggttcggtaccgtttcggtaacccgttccgtacccgttaagttcgtacgttccggtccggtttaccggtttaccggggtttacgggaccgggtaacggtaccgtaacggttaccgaccggttaccgtacggtaccgaccggtaccggtaaccggtccctcccggacccccgttcgggtacccttaccgttacccgttcccggtttaccccccctcccgttacccgttaccacccgtttaacccc

SEQ ID NO: 1580 - DNA, 569 bp, Homo sapiens
  misc_feature: GYAE6OF01CUU51.43.5.A05.1.454.CMB.1.raw
  modified_base (285)..(285): a, c, t, g, unknown or other
  misc_feature (285)..(285): n is a, c, g, or t
  modified_base (318)..(318): a, c, t, g, unknown or other
  misc_feature (318)..(318): n is a, c, g, or t
  modified_base (382)..(382): a, c, t, g, unknown or other
  misc_feature (382)..(382): n is a, c, g, or t
  modified_base (396)..(396): a, c, t, g, unknown or other
  misc_feature (396)..(396): n is a, c, g, or t
  modified_base (415)..(415): a, c, t, g, unknown or other
  misc_feature (415)..(415): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattactcctactggttcccagcagaagcctggccacggccccccgganactgatttatgaatacaagcaacaaactttccnggacacctgcccgattctcaggcctcctccgttgggggcaaagctcgccctgaccctttgggcncgcagcctagaggntggaggctagactattacngtcttgctcgcctatgatcggcgtcgttcgggtttcggcgggtaggacctaagttcgaccgtcgtacggtccacgcccgtaacggcctccgtcccccgtcggtaccgtacttcccgttccgttacccccgtccccttcctccgtacccttaccg

SEQ ID NO: 1581 - DNA, 858 bp, Homo sapiens
  misc_feature: GYAE6OF01CVC1D.43.5.A05.1.454.CMB.1.raw
  modified_base (308)..(308): a, c, t, g, unknown or other
  misc_feature (308)..(308): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtcgtccccaggaggacagtcactctcacctgtggctccagcactggaactgtacaccgagtggtactattactccctacgtcggttccagcaagaacgccgtggcccgacggccccccggacactgtatttagngatacaagcaaacctaaacttttccaggaacctaccgtcgacccgtaatttccgtacgaccggtccttccccgtaccggtttacgggggaacctaaacggtccgtacccggcccgttaccgggttacccccgttttggggtaccgcccggtacgaaccgggtacccgtagggaacgggtaacgttacggggtacgggtaccgttacggtaaaccgttttaacgtttaacccgttggttacccgttttacgggtcccgtttaccccggttacccgtttaagttcgggttaaccgttccgggtaccccgggtttcccgggtttttaccgggggttttacccggggaccggggtaaccggggttaaaccccggttaacgggtttaccgggtaccccgttaccggttaacgggttacccgaaccgggtaccccggtaaaccgggtcccgttaccccgggtacccccccggttcggttaccccgtaccgtttaccccgttaccccgggttacccccctaccccgtttacccccgtaccttaacccgttaaccccg

SEQ ID NO: 1582 - DNA, 542 bp, Homo sapiens
  misc_feature: GYAE6OF01APY19.43.5.A05.1.454.CMB.1.raw
  modified_base (345)..(345): a, c, t, g, unknown or other
  misc_feature (345)..(345): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggatggggacggatcggaaaccctaacgaatgggtnccactctgtatgcacagtaactttcgaggacagggtccacatcgacagggacacggtaccatacaacacgacggactacagtcggacctggagccagccctacacgacctacgacgacgacgggtcgtacttacttcgtgtcgagacggtcttccctagtcggttcgggaccctaaggtcgggtactttggtaccgg

SEQ ID NO: 1583 - DNA, 508 bp, Homo sapiens
  misc_feature: GYAE6OF01EFECE.43.5.A05.1.454.CMB.1.raw
  modified_base (339)..(339): a, c, t, g, unknown or other
  misc_feature (339)..(339): n is a, c, g, or t
  modified_base (431)..(431): a, c, t, g, unknown or other
  misc_feature (431)..(431): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggccctgggacaagggcttgagtggatgggacggatagaaccctaagaatggtnccactctgtatgacacagtaacttcaggacagggtcaccatcgacagggacacgtcatacaacacagctacagtcggacctgagcacgcctnacgacctgacgacgacgggctctattactggtgacgagtacgtcctagtcggttcggacccaagtcgggtcttgacg

SEQ ID NO: 1584 - DNA, 779 bp, Homo sapiens
  misc_feature: GYAE6OF01D0FZC.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaaggtctccgtgcgaaggtcttcgtggaactaccgtaccttccgaccggtctaactaattacgtacgacgttggggtcgaccggaaccgacggtcccccgtaggaaccggtaacggggtcgttggaaggttgggaagttaggggaaccggtaagtaccggtaaaacccgtaaacgaagttgggtacgaccctaacgttcgttagtatcggacctaaacgtaacgttaacgtttacgaacgggtaccgtacggggttaccaaccgtagtaccgggaacccgaacgggtaacccgtaaccggttaccaactaacccgaaacaacggtaacggacctaacgtaagtaccggtaaccgtggaacgccgaccgccctaacgaccgaacccgtacggaacccgaccggtaccggggtacttaccgttagtttacccggtggttaccggtaccggtaaccggttaccggtttaccccgttaggtttacccgggttacccggggtaaacccccgttaacggggtttaccggggttaaccgtttcgggtaaaccccgggg

SEQ ID NO: 1585 - DNA, 514 bp, Homo sapiens
  misc_feature: GYAE6OF01BN8AR.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggatgggacggatgaaccctaacaatggtcgccactctgtatgcacagaactttcaggacagggtcaccatgaccagggacacgtcatcaacacgaggctacatgacctgagcagcctcacgacctgaccgacgacgggcgtctatttcgtgtgcgagcgtcccgtagtcggttcgggaccctaagtcggggtctttggaaccgg

SEQ ID NO: 1586 - DNA, 575 bp, Homo sapiens
  misc_feature: GYAE6OF01BRIXW.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacacgtgggtgcgacacggcccctggacgaagggcttggagtggagtgggacggatacgaaccctaagaagtggtcgccactcgtagtatgacaacgagtaacttcgaacggacgagggtcaccgatcgaacgaggacacgtccaataccaacacacgactacagtcgactgacgacacgcctacgacgacctagaccgacgacgggtccttcgttagttccgtggtcggacgacggtacgttacccgttaggttcgggttaccgggaccccgtaagggtcggggttaccgttgggtaacccgg

SEQ ID NO: 1587 - DNA, 761 bp, Homo sapiens
  misc_feature: GYAE6OF01BZQ43.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctgggaggatcctcttcgttggtggcagcagccacgaggacgcccactcccgaggtgcagcgtggtgcagtcgtggggctggaggtagaagacggccgtggggcctcgagtgacggtcctccgtgacgaggtctttcgtaggactacctaccttcgaccggtctaactatactacgacgtggggtcgacgaccgacggtccccgtaggaacgaagggtcttaggaggtggacggtaggggacgtaataccggaaccctaaacgaagttgggcgaccacgttcgtaggtactgacctaacgtaacgtaaccgtttacgaacgggtaccgacggggttacccaaccgagttaaccgggaccggaacgggaacctaacccggtaccctaaacgtaccgaaaacgacccgtaacgggaccctaacgagttacccggggaacctagggaaccgaccgtaaccgacccgttaacgaacccgggtaacccgtacggaacccggtaccggaaccgggttccggtttactttaaccggttttcgacgggttaccgaggtaacccgtcccggtttaccctagggttccgggtttacccgggacccggttaacgggttccggggtttaaccgtttccggtaacccgggg

SEQ ID NO: 1588 - DNA, 569 bp, Homo sapiens
  misc_feature: GYAE6OF01CTMZI.43.5.A05.1.454.CMB.1.raw
tcagtgtgagtagtcacgaccggtgctcgatttagatagatagacgagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcagtgaaggtctcctgcaaggcttctggatacaccttcaccggctactatatacactgggtgcgacaggccccgtggacaagggcttggagtggagtgggacggaagtacgaaccctaacaagtggtcgccacttctgtatgacacgagtaactttacgagggacgacggggtacaacctagtacgaccgaaggggacctacgtaccaataccgaacaacgacggctaacacgttacggaccctaggacgacacgcctacacgacctcgacgacgacggtcgttctagttcgtgttcgagagtacgtccctagtcgttcgggaccctagtcggggtactttggtaaccg

SEQ ID NO: 1589 - DNA, 700 bp, Homo sapiens
  misc_feature: GYAE6OF01D1U0K.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctgggaggatcctcttcttggtggcagcagccacaggacgcccactcccaggtgcagctggtgcagtcgtggggctggaggtgaagtaagccgtggggcctcgaggtgaaggtctacctgccaaggtcttctggactacaccgttcgaccgctactatatacacgtgggtcgacgaccgacggtacccgtggaacgaagggtcttggaggtggagcgggagatacgaaccgtaacgaagtggtacaccgtactacgtgtagtcgacacgtagtaactttgaacgtacgtacggtacaaccgtagtcgaccgagggaacccgacgtaccaagtaccgaaacgaccgtacggaccgtaacgtaacgtacggacctacgggacaccggactaccccgtacgaccgttaaccgtacgaaccggacggttaaccggggtcgtttaccttaacggtttaccgttcgggttaccggtaccggtacgttaacccgggttacccgtttaagggtacccgggtttaccggggtaacccccgttaaggggtttaccgggggtttacggttaaccgttaaacccggggg

SEQ ID NO: 1590 - DNA, 672 bp, Homo sapiens
  misc_feature: GYAE6OF01CX15Y.43.5.A05.1.454.CMB.1.raw
  modified_base (347)..(347): a, c, t, g, unknown or other
  misc_feature (347)..(347): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttcgtggataccaccttccaccggtctactatactacacgtgggtgcggcacggccccgtggacgaagggcttggagtggagtgggacgatacgaaccctaanaagtggtcgcccactctgtatcgacacgtaagtaactttcgaacggacgtacggggtaccaccgagtcggaaccgagggacaccggtaccaactaccaacacgacggcctaacagtcggactgacgcgacgtccctacgacgtaccgtacggaaccggaccgtaccggggtaccgttaccttaacgttttccggtacggtaccgggtaccggtaaacgggttacccggtttaccccgtttaacggttccggggtttacccggggtaccccccgttaaaggggtttacccggggggttacccgtttttaacggggtaaaccccggg

SEQ ID NO: 1591 - DNA, 582 bp, Homo sapiens
  misc_feature: GYAE6OF01A8WW0.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcagtgaaggtctctgcaaggcttcgtggactacaccttcgaccggtctactatatacacgtgggtgcgacgacggcccctggacgagggcttggagtggagtgggacgatacgaaccctaagaagtggtcgcctactcgtgtatcgacacgagtaacttcgaggtacgacgggtcaccgtatacgaccgaggaccacgtacactacaacacgagactacagtacggacctagacgcacgtccctacgacgacctacgaaccgtacgaccgggtctaccgttattacgtggtacgacgtacgtcgttacccttaggttccggttcgggacccgtaacggttcgggtaccgtttcggtaaccgg

SEQ ID NO: 1592 - DNA, 576 bp, Homo sapiens
  misc_feature: GYAE6OF01DX7S5.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctcctgcaaggcttctggatacaccttcaccggtctactatatacacgtgggtgcgacgacggcccctggacgaagggtcttggaggtggagtaggggacgatacgaaaccctaagaagtggtcgaccactctagtatgacacagtaactttacgaggacagggtacaaccgagtacgacgagggaccacgtaccatacaacacgaggctacagtcggactgacgcacggccctacgacgtaccgtacgaccgaccgacgggtcgttacttacgtttcgtggtcggacgtacggtacgttcccgttagtcggttcgggaccctaaggtcgggtcgtttcggtaaccgg

SEQ ID NO: 1593 - DNA, 521 bp, Homo sapiens
  misc_feature: GYAE6OF01A3Y3K.43.5.A05.1.454.CMB.1.raw
  modified_base (332)..(332): a, c, t, g, unknown or other
  misc_feature (332)..(332): n is a, c, g, or t
  modified_base (458)..(458): a, c, t, g, unknown or other
  misc_feature (458)..(458): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttggagtggatgggacggatgaaccctaanaagtggtgccactctgtatgcacagaactttcaggacagggtcacgatgacagggacacgtcatcaacacaggctacatcggactgagcacgcctcagacctagacgacacgggctactatttccnggtcgacgaggcgttccctagtcgggttcgggaccctaaggtcgggtacgtttggtaacccgg

SEQ ID NO: 1594 - DNA, 680 bp, Homo sapiens
  misc_feature: GYAE6OF01BJOZ3.43.5.A05.1.454.CMB.1.raw
  modified_base (264)..(264): a, c, t, g, unknown or other
  misc_feature (264)..(264): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtgggcctcagtgaaggtctcctgcgaaggcttctggatacaccttcaccgntactatatacacgtgggtgcgacgacggcccctaggacaagggtcttggagtggagtggggacgtatacgaaaccctaagaagtcggtacgccctaacgtcgtagtaacgttcgacctaacgtaaacgttaaacgtttaccggaaagggtaaccgtacggggtacccaacccgtaagtacggaacccgtaacggggaacctaaccggtaccaactaccgaaaccaacgaacgggtacctaacgaacgtacgggtaacctcggaacgtaccgaacgtccctacgaacggtaaccctaggaaccgaccgtaccgggtccgttacgttacgtttcgtacggtcgacggtacggtacccgtacccgttaggtacggttaccgggacccgtaaaggtttcgggtaaccgttggtaaccggg

SEQ ID NO: 1595 - DNA, 590 bp, Homo sapiens
  misc_feature: GYAE6OF01DA64C.43.5.A05.1.454.CMB.1.raw
  modified_base (281)..(281): a, c, t, g, unknown or other
  misc_feature (281)..(281): n is a, c, g, or t
  modified_base (363)..(363): a, c, t, g, unknown or other
  misc_feature (363)..(363): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactactatacactgggtncgacaggccctggacaagggcttgagtgagtgggacggatgaaccctaacaagtggtgccactctgtatgacacagactttnaggacagggtcacatcgacagggacacgtccaagtcaacacgaggactaacgatacggtacccttagacgaccgacggacccttacgacgtaacccgttggaaccggacgaacggggtccgtacgttaacgttttcgtcggttcggacggtacggtaacggttccccctaaggttcggtttccggggaccccttaaagggttcgggggaactttttcggaaacccgg

SEQ ID NO: 1596 - DNA, 581 bp, Homo sapiens
  misc_feature: GYAE6OF01CF63K.43.5.A05.1.454.CMB.1.raw
  modified_base (349)..(349): a, c, t, g, unknown or other
  misc_feature (349)..(349): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacgacggccctggacaagggctttggagtggagtgggacggatagaaccctaacgaagtggtgaccntcgtgtatgacacgagtaactttcgaacggacgtagggtacaccgatcggaaccgacggggaccaacggtccaagtccaacgacgaggactacagtcggactgacgcagcctacacgacctacggaacgacgacgggtcgtaccgttatttcgtcgtacggcgtaacggtcgttacccgttagttcggttaccgggacccgtaaggtcgggggttagtttcggtaaaccggg

SEQ ID NO: 1597 - DNA, 587 bp, Homo sapiens
  misc_feature: GYAE6OF01DOV7F.43.5.A05.1.454.CMB.1.raw
  modified_base (333)..(333): a, c, t, g, unknown or other
  misc_feature (333)..(333): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggagtgggacgatacgaaccctaanaatggtgccactctagtatgacactacgtaactttcgacggacagggtaccaccagtcgacgagggacacgtaccagccaacacaggctacagttcggactgagcacggcctacgacgaccctagaccgacgaccggggtccttacgttagttttccgtggtacggaccggtacgtaccggttaccccttagttacggggtttaccggggacccccgttaaacggttcgggggtaccttttcgggtaaacccgg

SEQ ID NO: 1598 - DNA, 668 bp, Homo sapiens
  misc_feature: GYAE6OF01EX890.43.5.A05.1.454.CMB.1.raw
  modified_base (273)..(273): a, c, t, g, unknown or other
  misc_feature (273)..(273): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcgttggtggcagcagccacaggacgcccactcccaggtcgcagctggtgcagtcgtggggctggaggtgaagaagccgtggggcctcgagtaggacggtctccgtgcgaaggcttctggatacaccttcaccggntacctatatacacgtgggtgcgacgacggccctaggacgaagggcttggagtggagtgggacggatacgaaaccctaagaagtggtacgacctactcgtgtaagtggctaacgaacgtaaccgtttacgaaggtacggacgggtaccaacgtagtacgaaccgacggggaacctaacgtccaactaccgaacgacgacggacctaacgacgtcggtaactcgagaccgtaaccgccctagaaccgaccgttaccggaacgaaccggaccgggtacgttaccgtttaactttccggttacggtcggacggtaccggtaccggttaccccgttagttcccggggttaccgggtacccgtaaagggttcggggttaccggtttcggttaaacccgggg

SEQ ID NO: 1599 - DNA, 620 bp, Homo sapiens
  misc_feature: GYAE6OF01CKQQS.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcacggctactatatacacgtggtcgcgacacggccctggacgaaggtctgaggtggagtgggacggagtacgaaccgtaacaagtggtagcccacgtctagtatcgacacgtagtaactttcgacggacgtagggtaccaaccgactacggaaccgacgggacctaccggtaccaactaccaacaccgacggactacgacgtcggtaacgtacggacgacgacgacctacacgtaccgtacggaccggaacgaccgggtacgtacttacgtttcgtggtcggtacggtaggtaccgttacccgtacggttcgggttaccgggaccccgtaacgggttacggggttcccgtttcggtaacccggg

SEQ ID NO: 1600 - DNA, 758 bp, Homo sapiens
  misc_feature: GYAE6OF01CN8VV.43.5.A05.1.454.CMB.1.raw
tcagtgtgagtagtcacgaccggtgctcgatttagatagatagacagggctggcaccagggtcccttccaatatcagcaccatggcctggactcctctctttctgttcctcctcacttgctgcccagggtccaattcccaggctgtggtgactcaggacgccctcactgactgtcgtcccaggagggacagtcactctcacctgtcgctccagcacgtggaactgtaccaccgagtggtacattactccctacgtgttccagcgaagaacgccgtcggacccgaccggaccccccggactaacgttaactttaacgtacggtaactaacgaacgaacctaaaaccgttaaacctttacccgtaggtaacctaacccgtcggtaccccgtaacttccgtaccgaacggtacccgttcccgttaccggttacgggggactaaacgtccgtaccgtcccgttacggtaccccgttttcgggcgtcggacgtacgtcgtacgtagtacggagttcgggacggtaccttacggtaaccttaagtttaaccgtcggtcgttttaccggccttaccggtacccttaagtcgtaacgtccggtaccgttccggttccgggtttcgggaccgggtacggtaaccgtacgttccggacgttaccgtacgtccgaccgtacccgaacggtcctacccggcccccgtcggtccctacccgttccgttacccgttaccccctaccccgttcctacccttaacccgttaccc

SEQ ID NO: 1601 - DNA, 779 bp, Homo sapiens
  misc_feature: GYAE6OF01BV494.43.5.A05.1.454.CMB.1.raw
  modified_base (292)..(292): a, c, t, g, unknown or other
  misc_feature (292)..(292): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggacgccctcactgactgtcgtccccaggagggacagtcactctcacctgtgctccagcactggaactgtacaccgagtcggtcattactccctagtcggttccagcaagaagcctcggccaccggcccccgganactgtacttatgatacagactaactaactttcgagaccactcgaccgtatctacgacgtcctccgtcggttacggggactaaacgtctaccggtcccgtacgttaccccggtttcgggactccggccgtaacggcccgttagggaccgggtagtacgggtaacggtccttaacggtaaccttaacgttaccgtggttacccgttcggtccttacggaccgtttaagtcgtaacggttccggtccggtttacccggggtttaccgggggttttaccgggacccggggttaaaccggggtaacccgttaacgggtttccccggtaacccgggttacccgttaacgggtacccgtaaacccggtacccggtaaaccgggtccccgttaacccgggtacccccccggtttgggtaacccctacccggtttccggttcccccgggtttaccccccgtaccccttcccgttacccgtaacccgtttaaccccg

SEQ ID NO: 1602 - DNA, 820 bp, Homo sapiens
  misc_feature: GYAE6OF01CWULH.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatccttcttcttggtggcagcagccacaggacgcccactcccaggtgcagctggtgcagtcgtggggctggaggtgaagaagccgtggggcctcgagtgaaggtctcctgacaaggtcttcgtaggactacctacctttacgaccggtcttaactatactacgacgtggggtacgccggaacgaccggtccccgtaggaaccggtaaggggtccgtttaggagggttagggaaggtacgggggaacggtaacgttaacggaaaacccgttaaaccgaagttacggggtacgaccctaacgttccgttaggttaacgtgaaccgtaacgtaacggttaaacgttttaccggaaacgggtaccggaacgggttaccaacccgtaagtaccgggaacccggaaacgggtaaccgtaacccggttaaccaaccgtaaaccgaaacccgtaaccggaacggtaccctaacggtacgtaacccgggacgttacggaacggacccgtaaggtaccccgttaaaccgacggtaaacccgtgggaaaccccgtaaccgggtacgggtaccgtttaccgtttacgtttaccggtacggtaccggtaacggaacggttcccggtttacccgtacggttaccggggttaccggggaacccttaaggggtttaccggggttaccgtttcgggtaaaccccggg

SEQ ID NO: 1603 - DNA, 644 bp, Homo sapiens
  misc_feature: GYAE6OF01AJ9WP.43.5.A05.1.454.CMB.1.raw
tcagtgtgagtagtcacgaccggtgctcgatttagatagatagacgaagggggagcacgtcacccagctaaccacatctgtaccgtacggtagagaagtcccctggagaccgctcccgttcctcacctactgggtacttcggacctggaggatcctcttcttggtggcagcagccacaggacgcccacgtcccgtagggtgcgaggtcgttggttcgtcgtagttacgttagggggctcggagggtgaaggaagccgtggggcctcgaggtgacggtcggtccgtggtcgaaggtcttctgggactaccgacccttcgaccggtcctactactatacacgtgggtcgtcgacgacggtccctggacgtagggtcttgtagtggacgtgggacggatcggaacccgtaacgaacgtgggtcgacgacgtcgtggtagtgcacgtagtaacttcgaggtacgaggtacacagtacgacgacggacgacgtcactacgaacgacggacgtactacacgtcgtacctgacgacacgcctacgaacgacctacgaccgacgtcggtacgtacttacgttcgtacggtcgtacgacggtcgtacccgtagtcggtaccggacccgtaaccggtcgggttcgttcgtacgg

SEQ ID NO: 1604 - DNA, 548 bp, Homo sapiens
  misc_feature: GYAE6OF01E20KX.43.5.A05.1.454.CMB.1.raw
  modified_base (245)..(245): a, c, t, g, unknown or other
  misc_feature (245)..(245): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctcctgcaaggcttcnggatacaccttcaccggctactatatacactgggtgcgacgacggccccgtggacgaagggcttgagtggatggggacggatacgaaccctaacgaagtggtgccactctggtatgcacagtaacgtttcgaggacgagggtaccacagtcgaccgagggacacgtcataccaacacgacggtctaacacgtcggacctgacgcacgcctacgacgactgaccgacgtacggcgtcttacgtttgtggcgtgagtcgtcccgttagtcggttcgggaccctaaggttcgggtcttgtaaccgg

SEQ ID NO: 1605 - DNA, 585 bp, Homo sapiens
  misc_feature: GYAE6OF01DD4UU.43.5.A05.1.454.CMB.1.raw
  modified_base (456)..(456): a, c, t, g, unknown or other
  misc_feature (456)..(456): n is a, c, g, or t
  modified_base (468)..(468): a, c, t, g, unknown or other
  misc_feature (468)..(468): n is a, c, g, or t
  modified_base (534)..(534): a, c, t, g, unknown or other
  misc_feature (534)..(534): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaagggtcttcgtggactacacctttcacggtactactaatatacacgtgggtcgcggacacggtcccctaggacaacgggctttaggagtggagtggggaacggatacgaaaccttaacgaagtggtacgcccaacttctggtactcgcaacgaacgttaaactttcgaaggacgtacgggtaccaaccgatacgacgaaggacacgtacatacaacncgaaggctaacngtacggacctgacgccaacgtcctacgacaccgtagaccgacgacgggcttgtacttcgtggtcgngagcccgtcgtagttacggtccgggacctaagggtcgggtacttggtaccg

SEQ ID NO: 1606 - DNA, 707 bp, Homo sapiens
  misc_feature: GYAE6OF01DSQSH.43.5.A05.1.454.CMB.1.raw
  modified_base (252)..(252): a, c, t, g, unknown or other
  misc_feature (252)..(252): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtggggcctcgaggtgaaggtctccgtgacaaggtcttcgnggatacaccttcgaccggtactactatactacgacgtgggtcgaccggtaccgacgggtcccccgtagggaaccgaagggggtcctttagggacggtagggaggttgggggaaccggtaagtaccggaaaacccgtaagtaaacgtcgggttacgaccctacgttccgtagttacgtcggacaacgtaacgttaaccgtttacgaacgggaacgtacggggtaccaaccgtaacgtacggaaccggacggggaaccaccggtaccacgtaccaacacgacggtactacgtagtcggacctagacgacacgccctacgacgaccgtacgaccggaccgtaacgggtccttacgttacgtttgtcggtcgtaccggtaggtacccgttacccgttaggttaccggggttaccgggaccccgttaaacgggttcggggtaacctttcggtaacccggg

SEQ ID NO: 1607 - DNA, 614 bp, Homo sapiens
  misc_feature: GYAE6OF01CIXL4.43.5.A05.1.454.CMB.1.raw
tcagtgtgagtagtcacgaccggtgctcgatttagatagatagacagggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctatggttccagcagaagcctggccaggccccccgacactgatttatgatacaagcaacaaactttcctggacacctgcccgattctcaggcctccctccgttggggcaaagctgccctgtaccccgtttcgggttcgccgcgacgtccgtagaggagtaggaggactacggtactaattaacgtgtacttgcctcggcctatgatcgctcggtcgttccggggtttcgcgggacgggtacctaaggttcgtaaccggttccgttaggtccgtacggacccgtaacggtccgtacccggtcccccgtcgggttaccctaaccgtttcccgtaccgtttcccccgcccctttcccgtcccgtaaacccg

SEQ ID NO: 1608 - DNA, 576 bp, Homo sapiens
  misc_feature: GYAE6OF01EYWUU.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaggtctcctgcaggcttctggatacaccttcaccggtctactatatacactgggtgcgacgaggccccgtggacaagggcttggacgtggagtgggacggatcgaaacctagaatggtagccacgtctgtatgacacagtaactttgacggtacagggtacaccagtcgaccgagggactacgtaccatacgaacacacggactacgagtcggacctgacgcgacgtcctgaaccgtacctacggaccgacgtacgggtcgttacttacgttcgttacgtcggcggtaaggtccgtaccttaggttcggttaccggggacccttaagggtcgggttaccgtttgggtaacccgg

SEQ ID NO: 1609 - DNA, 608 bp, Homo sapiens
  misc_feature: GYAE6OF01A6HCY.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctcctgcaaggcttctggatacaccttcaccggctactatatacacgtggtgcgacgacggcccgtggacgaagggcttggagtggagtggggacggatacgaaccctaagaagtggtcgccaactcgtagtagtggacaacgagtaacctttacgaggtacgagggtaccaacagtcgaaccgagggaccacgtaccataccaacacgacgcacgtagacggtacctagacgcacgcctacgacgacccgtacgaaccggaccgtacgggccgttacttacgtttcggtacggtcggtaccggaaggtacccgttcccttaggttacggttccggggtacccgtaagggttcggggttacgtttcggtaacccggg

SEQ ID NO: 1610 - DNA, 617 bp, Homo sapiens
  misc_feature: GYAE6OF01CMDEI.43.5.A05.1.454.CMB.1.raw
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (330)..(330): a, c, t, g, unknown or other
  misc_feature (330)..(330): n is a, c, g, or t
  modified_base (364)..(364): a, c, t, g, unknown or other
  misc_feature (364)..(364): n is a, c, g, or t
  modified_base (470)..(470): a, c, t, g, unknown or other
  misc_feature (470)..(470): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaaggaagccgtggggcctnagtgaaggtctcngcaggcttcgtggatacaccttcaccggctactatatacacgtgggtgacgacgacggcccctggaacaagggtcttggaggtggagtgggacgngtacgaacctaacaagtggtcacacttcgtgtangacacaagtactttacgaggacgtaggggtaccaaccagtacggaaccgaggggaaccctacgtaccaataccgaacgaaccgtaacgacgtaacgagtcggaccnggaacgccacgtccgtacgacggtacctacggacgacgggtaccgggcgttactacgtttccggtaggttaccggcggtaagtccgttacccttaggtacgggttcccgggaccttaacggggtcgggttacttcggtaacccgggg

SEQ ID NO: 1611 - DNA, 624 bp, Homo sapiens
  misc_feature: GYAE6OF01DCQGA.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagaagcgtggggcctcgagtgaaggtctccgtgcaaggtcttcgtggaactacaccttcgaccggtctaactatatactacgtgggtcgcgaccacggcccctaggaacgaagggcttagaggtggagtgggacggatacgaacctaacaagtggcgccactcgtgtatgactacgaagtaactttcgaggacgtacgggtaccaaccgtataccggaacgacggggacctaaccggtaccaacgtaccaaccgacgacggtacctacgagtaccggacctggacgtaccgacgccctacgaaccgaccgtagaaccggaccgacgggtcttacgttacgttgtcgtcggacggtacgccgtttacccgtagttccgggttcgggaccctaagggttcgggttaacttcggtaacccgg

SEQ ID NO: 1612 - DNA, 790 bp, Homo sapiens
  misc_feature: GYAE6OF01AEGII.43.5.A05.1.454.CMB.1.raw
  modified_base (253)..(253): a, c, t, g, unknown or other
  misc_feature (253)..(253): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagaagccgtggggcctcgagtgaaggtctcctgacgaaggtcttcgnggaactacctacccttcgaccggtcttaactatactacgacgtgggtacgccgaacgaccggccccgtaggaccgtaacggggtcgttaggaggtggaggtcggggaacgacgtacgaaacctaaacgaagtcggtacgtacctacgtctagtacgtagacctaacgtaacgttaaccttacgaacgggtaccgtaacgggtacctaaccgaacgtaccggaaccggaacgggtaccctaaccggtaccaactaaccaaacccgtacgaacggacctaacgtaacggtaccggtaactaccccgggaagccctaaccggtcccgttaacgaccggtaacccgacggggtaaacccgtacccggtaccggggtaccttaccgtttaacggttttaccggtacggttccgggaacccggttaacgggttaaccccggttcccccgtttaagggttacccggggtttaccccggggtaaacccccggtttaaacggggtttaccggggggtttaaacccgttttaccgggtaaacccggg

SEQ ID NO: 1613 - DNA, 769 bp, Homo sapiens
  misc_feature: GYAE6OF01DJ1LR.43.5.A05.1.454.CMB.1.raw
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggcgccctcactgactgtcgtccccgaggagggacagtcactctcacctggtgctccagctacgtggaactcgtccaccgagtggtctacttactccctacgttcggttaccagcaagacgccgtcggacccgaccgggaccccccggaactacgtacgttacttttagtagaacgtaaccaaacgtaaccaaaccttaaaccttttccgtacggaaccctaaccgtccgtaacccgtactttccgtaccgaccggtcccctttcccggttccgggttacggggactaaacggtccgtccgtccccgttcggttaccccgggtttcgggccggtacgccgtaacggtcccggtagggaacgggtacgtcgggaacggttccttacggttaacgttaacgtttccgtgttacccggtcgtaccggtccttacgttagtccggtacgttccgggtcccgttccgggtttcggggttacgggaccgggtaacgggtaccgttacggttaccgtaccggtcggtacgtcgacccgtacggtaccggcccgttcccgaccccggttctacctaccgttcccgttcccctacccctacccttccctcgtacctacccg

SEQ ID NO: 1614 - DNA, 599 bp, Homo sapiens
  misc_feature: GYAE6OF01DRI3A.43.5.A05.1.454.CMB.1.raw
  modified_base (247)..(247): a, c, t, g, unknown or other
  misc_feature (247)..(247): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagaagccgtggggcctcagtgaaggtctctgcaggcttcgngatacaccttcaccggtctactatatacacgtgggtcgcgacgacggtccccgtaggacaagggtcttaggagtggagtgggacggtagtacgtaaaccctaagaagtggtcgaccctactctagttatgacacgaagtaacttcgaggacgtacgggtccaaccgtagtacggaccgaagggacaccgtaccaacgtaccaacgacgacggactaacgagtcggactggacgcacgccacgagaccgtcgacgaccgacgggtccttcgttacgttcgtggtcgcgtaacggtacgttaccgttagttcgggtacggtacccgagggttacgggttacgttcggtaaccgg

SEQ ID NO: 1615 - DNA, 723 bp, Homo sapiens
  misc_feature: GYAE6OF01E220K.43.5.A05.1.454.CMB.1.raw
  modified_base (244)..(244): a, c, t, g, unknown or other
  misc_feature (244)..(244): n is a, c, g, or t
  modified_base (554)..(554): a, c, t, g, unknown or other
  misc_feature (554)..(554): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccgaggtgcgagcgtggtgcagtcgtggggctggaggtgaagacgccgtggggcctcgagtgaacggtcctccgngacgaaggtccttcgtaggaacttaccgtacccgtttccgaacccgggtacttaaccttaattaactaccgacggttgggtcgacggaccgaccggccccgtaggaccgtaggggtcttgggaggtgggacggttggggaacggtacgtacggtaaaccctaagaagttcgggtcgacctacttcgtagttacgcgactaacgtaacgttaacttcggaacggtaacgtacgggtccaaccgtagaccgaacgacgggaactaccgtaccaataaccaacgacggacgtacctaacgacgtacggaccgngacgctaccggccctacggtaaccgaccggtaacgacccgtacgggaccggtcttaaccgtttccgttaccggtaggtacggtacgtaccggttccggtttaaccgtacgggtttacggtacccgggtacttaaaccgggacgggtttccggttacggtttaacccggg

SEQ ID NO: 1616 - DNA, 771 bp, Homo sapiens
  misc_feature: GYAE6OF01BV3RO.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggtcttctggatacaccttcaccggctactatatacactgggtgcgacacggccccgtggacgaagggtcttggaggtggagtgggacggagtacgaaaccctaacaagtggtcgcccacttcgtaggttaatcggacaaccgtaacgttaaccgttttacgaacgggtaaccgtaagggggtacccaacccgtaacgttacggaaaccccggagggggaaacccctaaccgggttaaccccaacgttaacccaaaacccgtaacccgaacgggtcccgtaaaccgtaacggtaccgggtaacccgtacgggaaccgacccgtaacgggtacccccgttaacgaccggtaacccgttacggaacccggaaccggtaacccgggggtaccgttaccgtttaacgttttcccggttgggttaccggtaccggtaacgggttacccggttacccccgtttaaaggtttccgggtttacccggggaaccccgttaaacgggttccgggggtttaaccgtttaccggtaaacccgggg

SEQ ID NO: 1617 - DNA, 590 bp, Homo sapiens
  misc_feature: GYAE6OF01BKC2Y.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggccctggacaagggcttggagtggagtgggacggatcgaaccctacaagtggtgccactctggttatggccacgacgtaactttacgacggtacgacggggtaccaccagtacgaccgaggggaccaaccggtccaactaccgaaaccacgtaacgggacctaacagtacgggacctaggtacgcacggcctacgacgacctggaccgacgacgggccgttcttacgtttcgtcggtcgacggacggtcgtacccgttagtcggttcgggacccgtaaggtcggggtacgtttggtaacccgg

SEQ ID NO: 1618 - DNA, 557 bp, Homo sapiens
  misc_feature: GYAE6OF01BPYMS.43.5.A05.1.454.CMB.1.raw
  modified_base (334)..(334): a, c, t, g, unknown or other
  misc_feature (334)..(334): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacgaagggcttgagtggagtgggacggatgaaccctaanaatggtcgccactctgtatgcacagtaactttcgaggacagggtcaccatcgaccgagggacacgtccataccaacacgacggctacagtcggacctgacgcacgcctacacgacctcgaaccgacgacgggtcgtacttagtttcgtggtcgtttacggacggtacgttcccgtagttcggttaccgggaccctaaggtcggggtaccgtttggtaacccgg

SEQ ID NO: 1619 - DNA, 710 bp, Homo sapiens
  misc_feature: GYAE6OF01EI1PI.43.5.A05.1.454.CMB.1.raw
  modified_base (321)..(321): a, c, t, g, unknown or other
  misc_feature (321)..(321): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggagatcctcttctggtggcagcagccacgaggagcccactcccaggtcgcagctggtgcagtcgtggggctggaggtgaagaagccgtggggcctgagtgaaggtctccgtgcaaggcttctggataccacttcaccggtctaactattaataccaacgtggggtgccggacgacggcccctggaacaacggggntttagaaggttggaagtggggacggaatacgaaacccgtaaacgtaagttggggtctacccggacttacgtgttaacgcggactaaccgaacggtaaaccttttacggaacgggaacgtaacgggggttccaacccgtaagtacggaaccgaacgggaccgtaaccggtacccaacttaaccgaacgtaaccgacgggactaaccgtaagtacggaccgtacggtaacgacgaccgtaccctaccgtaacgtacccgtaaggaacccggaaccggtacccgggaccgttccgtttaacgtttcgttacggttcggaccgtacggtacgttacccgtagttccgggttccgggacccgttaacggtcgggtaaccggtttggtaacccgg

SEQ ID NO: 1620 - DNA, 685 bp, Homo sapiens
  misc_feature: GYAE6OF01CAS4F.43.5.A05.1.454.CMB.1.raw
  modified_base (629)..(629): a, c, t, g, unknown or other
  misc_feature (629)..(629): n is a, c, g, or t
tcagtgtgagtagtcacgaccggtgctcgatttagatagatagacgagggggagcatcacccagcaaccacatctgtcctctagagaactcccctgagagcctccgttcctcaccatggactggacctggaggatcctcttcgttggtggcagcagccacgaggacgccccacgtcccgaggtgccagcgtggtgcagtcgtgggctgaggtgaagagccgtgggcctcgaggtgaacggtcctaccgtgacgtaaggtcttcgtaggtactactacccgttcgaccggtctaactatacgtacgtacgtgggtcgaccgacgaccggtccccgtaggaaccgaagggtcgttaggaggtacgggacggtacggggaacggtacgtaaccgtaaacccgtaaacgtaacggttacggtaccgtccctaacgttaccgtaggtacgttacggacctaaacgtaaacggttaaacgtttacggaaaggtaccgtaacggtaccgaaccgtacgtacggaaccgacggaaaccctaccgtaccgactaaccgaacgacgaacgcctaacgactcggaacgtgacgacgaccgtccacgaccgtacgacgacgacgccggtgtacttgttcgngtcgacgtacgccgttctaggttcgtaccggactaggttcggtacgttgtaaccgg

SEQ ID NO: 1621 - DNA, 713 bp, Homo sapiens
  misc_feature: GYAE6OF01EI5MY.43.5.A05.1.454.CMB.1.raw
  modified_base (260)..(260): a, c, t, g, unknown or other
  misc_feature (260)..(260): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatccttcttcttggtggcagcgagccacgaggacgccccacctcccgaggtgcagcgtggtgcgtagtcgtggggcgtggaggtagaagagccgtgggcctgagtagacgtctcgtgacgaggtcttcgnggactacctaccgttccgaccggtactactaatactactacggtgggtcgacgacgaccggcccgtaggacgaagggtctggaggtgggagtcgggacgtacgtaccgaacccgtaagtaacgtcggtacacctacgtcgtagtacgtcgactaacgtaacgttaaccgttaggaacggtaccggacgggtaccaacgtacgtacggaaccggacgggaccctacggtacaagtacccaacgacgtacggtacctacgacgtaccggtaccgtaggacgaccgaccggtaccctacggaccgttaccgtaccgggaaccgaccggtaaccggttccgttacgtttgttaccgtgggtaccgtacggtaaccggttccgttacccggttggttaccgggttacccgggtaacccgttaagggggttccggtttaaccgttacggtaaccccggg

SEQ ID NO: 1622 - DNA, 644 bp, Homo sapiens
  misc_feature: GYAE6OF01A4XVT.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctgggaggatcctcttcttggtggcagcagccacaggacgcccactcccaggtgcagctggtgcagtcgtgggctgaggtgaagacgccgtggggcctcagtgaggtctccgtgcgaaggcttcgtggactacctaccttcgaccggctactatactacacggtggtgcgacgaccggccctaggaccgaagggtcttaggacggtggagtggggacggtagtacgaaacccgtaagaacgtggtacgcctacgttcgtagtactcggacctaacgtaacgttaacttacgaacggtacgtacggtaccgaactacgtacgaccggtaaggacccgtaacgtaccgactaccgaaccaacgtacggactacgagtacggtacagacgcacggactacgacggactacgacgccgtaacgggtctacgttagttcgtcggtacggtacgtacgtacccgttaccgtagttccgggtaccggtaccggtaaccgggttggttaacccggttaggtacccgggg

SEQ ID NO: 1623 - DNA, 527 bp, Homo sapiens
  misc_feature: GYAE6OF01A4TM5.43.5.A05.1.454.CMB.1.raw
  modified_base (379)..(379): a, c, t, g, unknown or other
  misc_feature (379)..(379): n is a, c, g, or t
  modified_base (414)..(414): a, c, t, g, unknown or other
  misc_feature (414)..(414): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagcacaggagcccactcccaggtgcagctggtgcagtctggggctgaggtgaagagcctggggcctcagtgaaggtctcctgcaagcttctggatacaccttcaccggctactatatacactgggtgcgacaggcccctggacgaagggctgaggtggatgggacgatgaaccctaagaagtggtgccactctgtatgcacagtaactttcgaggacgagggtacacanagaccgagggaccacggtccatcaacacgagctanagtcggactgagccgagcctagacgaccgtagaccgacgcgggtcgtacttattcgtagtcgagacgcgtccctagtcggttcggacctaaggtcgggtgtttcggtaaccgg

SEQ ID NO: 1624 - DNA, 520 bp, Homo sapiens
  misc_feature: GYAE6OF01ESEAU.43.5.A05.1.454.CMB.1.raw
  modified_base (281)..(281): a, c, t, g, unknown or other
  misc_feature (281)..(281): n is a, c, g, or t
  modified_base (333)..(333): a, c, t, g, unknown or other
  misc_feature (333)..(333): n is a, c, g, or t
  modified_base (416)..(416): a, c, t, g, unknown or other
  misc_feature (416)..(416): n is a, c, g, or t
  modified_base (474)..(474): a, c, t, g, unknown or other
  misc_feature (474)..(474): n is a, c, g, or t
tcagtgtgagtagtcacgaccggtgctcgatttagatagatagacaggggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctcctgcaaggcttctggatacaccttcaccggctactatatacactgggtncgacaggcccctggacaagggcttggagtggatgggacggatgaaccctaanaatggtgccactctgtatgcacagtaactttcgaggacgagggtcaccatgacgacgggacacgtaccatacaacacagctanatcgacctgacgcacgcctcgacgacctggaccgacgacgggctcttattctggtcgngagtcgtccctagtcgttcggacctaagtcgggtacttgtaaccgg

SEQ ID NO: 1625 - DNA, 643 bp, Homo sapiens
  misc_feature: GYAE6OF01AV27G.43.5.A05.1.454.CMB.1.raw
  modified_base (379)..(379): a, c, t, g, unknown or other
  misc_feature (379)..(379): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctcgaggtgaggtctcctgacgaaggcttcgtggactacacccttcaccggtctactatactacacgtgggtcgcgacgccggcccgtaggacgaagggcttaggaggtggagtgggaacggataccgaaccctaagacgtggtacgcctactcgtagtanacgacactacgtacttagacggtacgacgggtcacgtactacggaccgaaggacccaaccgtaccctagtaacccaaccacggaacgtactaaccgacgtacggaacccgtgacgccgaactcccgagacccgtacctacggaaccggaccggtaccggtcgttccgtttacttcggttcggtacgaccggtaacggttccgttacccggtagttccgggttaccgggaccctaagggtacgggttcgtttacggtaacccggg

SEQ ID NO: 1626 - DNA, 612 bp, Homo sapiens
  misc_feature: GYAE6OF01CSKWW.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttgatggcagcagccacaggagcccactcccaggtgcagctggtgcagtcgtggggctggaggtgaagaagccgtggggcctcgagtgaaggtctaccgtgcgaaggtctttcgtggtactacctaccttccgaccggtcttaacctatatacacgtgggtcggccgacgacggcccgtggacgaacgggtctggagtgggagtggggacggatacgaaacctaactagtaggtcgaccactcgtagtatcgactaacaacggttaactttcggaacggacgtaacgggtccaacgtacgtagaaccgagggacaccgtacactacgaacacgaggacctactagacggtactggaacgcacgtccctgaacgtaccgacggaccgacgaccgggtcttacgttacttgtcgtacgcggtaacgttcgtaccttgttcgggtaccggtaccgaacggttcgggtactttacgg

SEQ ID NO: 1627 - DNA, 735 bp, Homo sapiens
  misc_feature: GYAE6OF01B7QVA.43.5.A05.1.454.CMB.1.raw
  modified_base (559)..(559): a, c, t, g, unknown or other
  misc_feature (559)..(559): n is a, c, g, or t
tcagtgtgagtagtcacgaccggtgctcgatttagatagatagacgagggggagcatcacccagcaaccacatctgtcctctagagaactccctgagagccttccgttcctcaccagtggactgggacctgggaggacttcccttctttcgttgggtcggcagcaacgcccaacgacgggacgccccaacctcccgaggtcgcaggcgtgggtcgcgtggtcggtggggctagggaggtagaaaggacggccggtgggcctagaggtcggtaacggtcctcgtaggacgtaaggtctttacgtaggacttacctaccttccgaaccgtctaactatactacgtacggtagggtcacggtaccgaccgggcccgtaggaacgagggtcgtaggacggttagggacggtaggggacgtacgtaacggaaacctaacggtaagtcggactaacccgtattacgtgaatcgaactaacgtaagttaccttaggaacggtacggtaggtaccacgtagtacgaacgacggactaccgacaactacgaacaacgtacgactacgngtaccggtacacggactacacggtccctaagtacccgaaccgtggaacccgtagggtaccgggttcttaaacgttcgtttacggtagtccggtaaccggtaggtacccggtttaccgaagggttcccggtaaccggaccggtaagggttaccgggtttaagtccgggtaacccggg

SEQ ID NO: 1628 - DNA, 810 bp, Homo sapiens
  misc_feature: GYAE6OF01C2HE0.43.5.A05.1.454.CMB.1.raw
tcagtgtgagtagtcacgaccggtgctcgatttagatagatagacagggggagcatcacccagcaaccacatctgtcctctagagaactcccctgagagctccgttcctcaccatggactggacctggaggactccttcttcgttggtggcagcacgccacgaggacgcccactcccgaggtgcagcgtggtcgcgtagtcgtggggctggaggtagaaggacgtccggtcggggccttcgaggtacggaacggttcctccgtggacgtaagggtcctttcgtaggtaaccttaccgtacccgttaccgacccggtacttaacttacgtaacgttaccgtacggtcgggggtcgaccggaaccgaccgggtaccccgtaggggaaccggtaacggggtctttagggacgggtgggtacgggtacggggtacggtaacgtaaccggtaaacctaaacgtacggtcgggtaccgtacctacgttcgtagtacgtacgacgtacgtaacgttaaccgtttacggaacgtaaccggtacggtccaaccgtacggtaaccgaaccggtacgggaaccctaccggtactaacgtaaccgaaccgtaccggtagtacccgaagtaccggtacggtaccgtacggaacgccgtacgtaacccgaccgtaacgtaccgacgggtaaccgtaccgggtaccgttccgtttacgttcgtttacggcggtcgggagtaaccggttccgttacccggttcgtttaccggggtcccggttaaccggttaggggtttccggttaacggttacggttaacccgggg

SEQ ID NO: 1629 - DNA, 699 bp, Homo sapiens
  misc_feature: GYAE6OF01A5DDV.43.5.A05.1.454.CMB.1.raw
  modified_base (254)..(254): a, c, t, g, unknown or other
  misc_feature (254)..(254): n is a, c, g, or t
  modified_base (268)..(268): a, c, t, g, unknown or other
  misc_feature (268)..(268): n is a, c, g, or t
  modified_base (579)..(579): a, c, t, g, unknown or other
  misc_feature (579)..(579): n is a, c, g, or t
  modified_base (643)..(643): a, c, t, g, unknown or other
  misc_feature (643)..(643): n is a, c, g, or t
  modified_base (654)..(654): a, c, t, g, unknown or other
  misc_feature (654)..(654): n is a, c, g, or t
tcagtgtgagtagtcacgaccggtgctcgatttagatagatagacagggggagcatcacccagcaaccacatctgtcctctagagaactcccctgagagctccgttcctccaccatggactggacctgggaggatcctcttcgttggtggcagcacgccacgaggacgcccacctcccgaggtgcagcctgggtcgctaggtcgtggggctggagggtagaagacgccgtggggcctgaggtgacggtctccgngacgacggcttcgnggactacctaccttcgaccgtctacgtatacgtacgacgttgggtcgaccgacgtcccgggtaccctacgggaacgaacgggtccgtaggtaagggtcggaacgggtacggggtaaccggagttaaccggaaacccgttaaaacggtaacgtcgggtaccggacccctacgttaccgtaggttaacgtacggaccgtaaacgtaacggttaactttaccggaaggtaacggacgggttacccacgtaacgtacggaaccgaacgggtaccaccggtaacctacgacgtaaccgaccgggacgtaaccttanacggtaccggacgtacgacggtcctaaccgcctaacgacgtaccgacgacgaccgccggtactntacttggacgngacgatccgctaggttcggcgtaaccgagttcgggtctgtaccgg

SEQ ID NO: 1630 - DNA, 764 bp, Homo sapiens
  misc_feature: GYAE6OF01AVOBE.43.5.A05.1.454.CMB.1.raw
  modified_base (249)..(249): a, c, t, g, unknown or other
  misc_feature (249)..(249): n is a, c, g, or t
tcagtgtgagtagtcacgaccggtgctcgatttagatagatagacaggggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctggaggtgaagacgccgtggggcctcgagtgaaggtctctgcaaggtctcnggactacacttcaccggctactatactacacgtgggtcacgacgacggcccctggaccgaagggtcttaggaacggttgggagttcggggaacggtacttaacggaaacccgtaacgtaacgtcgggtacggccttacgtaccgtagtaacgtcggccaaacgtacgttaaacctttcgaacgggtaacgtacggggtaccaaccgtaacgtacggaaccggtaacggggaacccaacggtaccgtaacgttaacccgaaaccgaacgtaaccgggtaaccttaacgtaacggtaaccggtaccgtaacggtacgtaacccgaacggtcccctaaccggtaccggtaaccgttaccgggaaccgacccggaaccggggtaccggttaccgtttaaacggtttccgttacgggttaccggacgggttaacggtaccgggttacccgttaacggttcgggttaaccgggaccccggttaaaccgggttacgggggttacctttacggggtaacccgg

SEQ ID NO: 1631 - DNA, 553 bp, Homo sapiens
  misc_feature: GYAE6OF01AZQQR.43.5.A05.1.454.CMB.1.raw
  modified_base (165)..(165): a, c, t, g, unknown or other
  misc_feature (165)..(165): n is a, c, g, or t
  modified_base (285)..(285): a, c, t, g, unknown or other
  misc_feature (285)..(285): n is a, c, g, or t
  modified_base (338)..(338): a, c, t, g, unknown or other
  misc_feature (338)..(338): n is a, c, g, or t
  modified_base (404)..(404): a, c, t, g, unknown or other
  misc_feature (404)..(404): n is a, c, g, or t
  modified_base (519)..(519): a, c, t, g, unknown or other
  misc_feature (519)..(519): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccaggtccaattcccaggctgtggtgactcaggagccctnactgactgtgtccccaggagggacagtcactctcacctgtggctccagcactggactgtcaccagtggtcattactccctactcggttccagcagaagcctggccacggcccccccgganaccgtgatttatgatacaagcaactaaactttcctggacacctgcccgattcncacgctccctcgtggggacaagctcgcctgacccgtttgggcgcgcgacgcctgagatgaggctanactattacgtgtcttgctcgtctatgtatcgccgtcgttcggggtttcggcgggtacgggtactaaggttcgaccgtcgtacggcacgtccgacggcctccgccccgtcgtcccncttccgtccttacccacccttccctctacctacc

SEQ ID NO: 1632 - DNA, 576 bp, Homo sapiens
  misc_feature: GYAE6OF01CS1SM.43.5.A05.1.454.CMB.1.raw
  modified_base (376)..(376): a, c, t, g, unknown or other
  misc_feature (376)..(376): n is a, c, g, or t
  modified_base (381)..(381): a, c, t, g, unknown or other
  misc_feature (381)..(381): n is a, c, g, or t
  modified_base (393)..(393): a, c, t, g, unknown or other
  misc_feature (393)..(393): n is a, c, g, or t
  modified_base (411)..(411): a, c, t, g, unknown or other
  misc_feature (411)..(411): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtcgtccccaggagggacagtcactctcacctgtggctccagcactggaactgtacacagtggtcattactcctatggttccagcagaagccgtggccaccggcccccggacactgatttatgatacaagacaaactaactttcacgacactcgccatctcacgctccgtcgtgggacaacgctcgcctcgacccgtttcggngcgcncgctggagtagngacgctagtactattacncgtctgctcgactgtcgatccgcgttcgttcggggtttaccggcgggtacgtacgtaacgttccgaccgttcgtacggcgtaccgacccgtacggtccgtcccgtccccgtcgtccctaccgttcccgttcccgttaccccgtcccttccctctaacccgttacg

SEQ ID NO: 1633 - DNA, 755 bp, Homo sapiens
  misc_feature: GYAE6OF01D0ZL8.43.5.A05.1.454.CMB.1.raw
tcagtgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctcagcacgtggaactgtcaccagtggtcattatccctatggttccagcagaagcctggccacggccccccggacacgtgatttatgatacaagcaactaaactttcctaggactacctcgcccgtattcctcgacgtcctccccgttccggttcgggggacctaaacggctcggtaccccgttcgtaccccgtttcggggttcgccgacgacgtccgtggaagggtacgtcgggaacgggtcgttacggtaactttaacgtttaaccgttcgtcgtttcggtaccgtaccgtacccgttaagtcggtaacgttcggtcttcgggttccggtttccggggggttttcccggggtacggggtaacggggtaacccgttaacgggtttaccggtaaccccggtttaccggttaccgggtacccgtaaccggtacccccggtaaacggggtccccttacccgggtcccccccggttacgggtacccctaacccggtttccgttccccggtttacccccctacccctttaccccgtacccttaaaccccg

SEQ ID NO: 1634 - DNA, 741 bp, Homo sapiens
  misc_feature: GYAE6OF01CFA5M.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctgggaggatcctcttcttggtggcagcagccacgacggacgcccactcccgaggtgcagctgggtcgcgagtcgtggggctggaggtgaagacgccgtggggcctacgagtgaacggtctccgtgacgaacggtcttcgtacggtaactacctacccgtttacgacccggtactaactaataactacgacggtggggtcgaccgaccgacggtccccgtaggaacggacgggtcttaggaggtagggtaggtacggggacggtacgtaaccgtaaacccgtaacgaagtcggtacgtacctaacgttcgtacgtagtcgtaccacgtaacgtacgtttacgacggtacggtacggtaacctaccgtacgtacgggaaccgacgggaacctacccgtaccgaactaacgaaccgtaacgtacgggtactaaccgttacggtaacggtacccgtaggaacgtaccgtaaccggccctaacgtaccggtaacccgaccggtaaccggtaccgggaccggttccgttacgttaacggtttcgtacgggtacgacgggttacgtccggttacctaggttcggtacggtacccgtacgggttggtaaccgttggtaacccggg

SEQ ID NO: 1635 - DNA, 556 bp, Homo sapiens
  misc_feature: GYAE6OF01DD4D3.43.5.A05.1.454.CMB.1.raw
  modified_base (388)..(388): a, c, t, g, unknown or other
  misc_feature (388)..(388): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtggggcctcgagtgaaggtctcctgcaaggcttcgtggataccaccttcaccggctactatatacacgtgggtgcgacacggcccctggaccgaagggtcttggaggtggagtgggacggatcgaaccctaacaagtggtcgaccactctagtatcgacacagtaacttcaggacgngggtacaactgacgacgaggacacgtcatcaacacacggactacagtacgacctgacgcgacgcctacgagacctcgaccggacgacgggtcttacgtcgtttcgtgtcgacgacgtacggtccctagtcggttccgggaccgtaaggtcgggtcgtttaggtaccgg

SEQ ID NO: 1636 - DNA, 669 bp, Homo sapiens
  misc_feature: GYAE6OF01DE79V.43.5.A05.1.454.CMB.1.raw
  modified_base (237)..(237): a, c, t, g, unknown or other
  misc_feature (237)..(237): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggagatcctcttcgttggtggcagcagccacgaggacgcccactcccgaggtgcagctggtcgcagtcgtggggctggaggtagaagacgcgtgggcctgagtgagtctcgngcagtctgtggactacacctcgaccgtctactatactacgacgtgggtgacggaccgacggcccgtaggacggaagggtcgttaggaggtagggaggcggggacgtagtaccgaacctaacgtagtacggtcgacctacgttcgtagtagtcgacacgtacgttaacgtttacggaacggtacgacggggtacaaccgacgtaccggaaccggacgggacctaccgtaccaacgtaaccgaaccgacgacggtaacctacgtacggtaccggactacggacgaccgacggtctacgtacgacccgtacgaacccggtacggaccggttcgttcgttacgtttcgtcggtaccggtacgtacggtccgttaccgttacggttaccgggttacccgggacccgttagggtcgggttaccgttaggtaacccggg

SEQ ID NO: 1637 - DNA, 742 bp, Homo sapiens
  misc_feature: GYAE6OF01CMC0K.43.5.A05.1.454.CMB.1.raw
  modified_base (187)..(187): a, c, t, g, unknown or other
  misc_feature (187)..(187): n is a, c, g, or t
  modified_base (346)..(346): a, c, t, g, unknown or other
  misc_feature (346)..(346): n is a, c, g, or t
tcagtgtgagtagtcacgaccggtgctcgatttagatagatagacgtaggggggtagccatcacccaggtccaaccacatcttgtcctctagagaatcccctgagagctccgttcctcaccatggacgtggacctgggaggatcctcttcttggtggcagcagccacaggacgcccactcccaggtncagtctggtgcagtcgtggggctggaggtgaagagcgtgggcctgagtgagtctctgcagcttcgtggatacgacttcgaccgtactactatactacacgtgggtcgacggacgacggtcccctaggaaccgaggtcttaggagtggagtagggacganaacggaaccctaagtaagtcggtacacctaacgttcgtagtactcggaaccaagtaacgtaaccgtttacggaacggtaacgtaccggggtaccaaccggttacgtaccgggtaacccgaacggggtaaccctaccgggtaacctaacgtaccgaaaccgacgtaacgggttaccctaacgtacggtacggtaaccgtagggacgtaccgtaacggtcccgtaaccggtaccgtacccggtacggaaccgtacccgggtaaccggggttcccttaccgtttaccgtttaccgtacgggtacggtaccggtaaccgttacccggttaccccgtaagggtttcccggtacccgggtacccgttaaccgggttccgggttaccgttccggtaacccggg

SEQ ID NO: 1638 - DNA, 828 bp, Homo sapiens
  misc_feature: GYAE6OF01EFDUE.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcacgccacgaggacgccccacctcccgaggtgcagtcgtgggtgcgtaggttcggtagggggtctgggaagggttaggaaacggaacggtcccggtcgggggccctacgaggttacggtaacggttccttccgttggacgtaacgggtccttttacgagggtaactaccctacccgtttccgaacccgggtacttaacctttaagtaacttaccgacggttgggggtccgaccggaaccgacccgggtccccgtagggaacggaagggtcgtttagggagtgggtagtacgggggacgtaagttaccgaaaccccttaaagacgttcgggtacgaccctagtacgtttacgtagtaccgactaaccgtaacgttaaaccgtttcggaaaccgggtacgttaaccggggtacctaacccgtagtacccgggaaccggaacgggtaccgtacccgtaactaaccgaccgtaaacgacggtaacgtccgtaaacgtaccggtacggtacctgaacgacgtacgacccgttacgaccggtaaccgcggaaccggtaccggtaccgggttctacgtttacgttaccggtagggtacggacggtaacggtcccggttaccgttcgggtaacgggtttcccggaacccggttaggggtaccggtttcgttcccgggtaacccgggg

SEQ ID NO: 1639 - DNA, 593 bp, Homo sapiens
  misc_feature: GYAE6OF01BYZ8O.43.5.A05.1.454.CMB.1.raw
  modified_base (430)..(430): a, c, t, g, unknown or other
  misc_feature (430)..(430): n is a, c, g, or t
tcagtgtgagtagtcacgaccggtgctcgatttagatagatagacaggggctggcaccaggggtcccttccaatatcagcaccatgggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattactccctactggttccagccagaacgccgtaggccacggccccccggacacctggacttttatgaactacaaagccaaactaaacctttccagaacctacctcgcccgacttcctcgacggtcctcccctcgttcgggggcaaaggtcctcgcccgtcgtacccgtttgggcgccgcagcctgacggtntgaggctgacttattactgtcttgctcgcctatcgatgccgtcgttacgggtttcggcgggtacgggacctaggttcgaccgtcgtaggtcacgcccgaaggtcctcgcccccgttcggtcctaccttccgtccgttcccccacccttccctcacccgttacc

SEQ ID NO: 1640 - DNA, 657 bp, Homo sapiens
  misc_feature: GYAE6OF01BUZU0.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagagccgtggggcctcaggtgaggtctcctgacaggtcttctggatacaccttcacggtctacctatactacacgtgggtcgcgacgacggtcccgtaggacgaagggcttaggaggtggagtggggacgtactacggtaaaccctaagaagttcgggacgccctaacttcgtagtatcggaccgtaacgaagttaaccttttaggaacgggtacgtacggggtcccaaccgtagtaccggaccggaacggggaccaccggtaccataccgaacacgacgacctacgtacgtggacctgggacgacacgtccgtacgacgaccgtacgacgggaccgtacgggtccgttacgttacgttacgtcgggtcgacggtacggtacccgttaccgttagttccgggttaccgggtaacccgttagggttaccggggttactttcgggtaacccggg

SEQ ID NO: 1641 - DNA, 650 bp, Homo sapiens
  misc_feature: GYAE6OF01DWO0P.43.5.A05.1.454.CMB.1.raw
  modified_base (251)..(251): a, c, t, g, unknown or other
  misc_feature (251)..(251): n is a, c, g, or t
  modified_base (558)..(558): a, c, t, g, unknown or other
  misc_feature (558)..(558): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtcgcagtcgtggggctggaggtgaagaagccgtggggcctcgagtgaaggtctcctgcaaggcttcgnggtactactaccttcgaccggactactatactacacgtgggtcgacggacgacggccccgtggacgaagggtcttaggaggtgggagtggggacggtagtacgaaaccgtaacaagtcggtacgaccctactcgtagtatcgacacgtaacgtaactttacgaacgggacgtacgggtaccaacgtacgtacgaaccggtaacgggtacccacgttacccaataaccaacgacgacggacctaacgacgtcggaactgacgcgacgtcctacgacgtaccgaggaccggacgacgggtaccccgttnttacgtttcgtggtcggtacgtacggtaccgttaccgtaggttacgggttaccggacccggttaacggtcgggttacgtttcggtaacccgg

SEQ ID NO: 1642 - DNA, 760 bp, Homo sapiens
  misc_feature: GYAE6OF01B2HM8.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtgggctgaggtgaagacgcgtgggcctcgagtgaacgtctcgtgcgaaggtcttcgtaggataccgtaaccttcgacccggtacttaacttaataactaccgtaacgttggggtacgcgaaccgaccgggtccccgtaggaaccgaaggggtcctaggaggtcgggaggtagggaccgaagtaccgaaaccctaaagtaagtcggtacgacctacgtacgtacgtacgtacgacctaacgtaacgtaacgtttacgacggaacggtacgggtaccaaccgtaggtacgaaccggacgggtaactaaccggtaccaacgtaacccgaaacgaacgtacgtacgttaaccgacggtaccgtacgtcgaacgcgtacccgtacgtaccgaaccgtaccggttacgaacccggtaaccgggtaccgggttacccggtttaactttacgttttacggaccggttacggaaccggttaacggtacccgtttacccgttaagggtttcccgggttaacccgggtaccccggttaaacgggtttacgggttaacccgtttcggtaaaaccccggggg

SEQ ID NO: 1643 - DNA, 670 bp, Homo sapiens
  misc_feature: GYAE6OF01DNVBC.43.5.A05.1.454.CMB.1.raw
  modified_base (292)..(292): a, c, t, g, unknown or other
  misc_feature (292)..(292): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggacgcccactcccaggtgcagctggtgcagtcgtggggctgaggtgaagacgcgtgggcctcgagtgagtctcctgacaggtcttctggactaccaccttcgaccgtctactatacactctgggtcacgaccncggccccgtggaccgaagggtcctggtaggtagggagtacggggacggtactaccggtaaacccgtaaagtaacgttggggtaccaccccgtaacgttccgttaggttaaccgtaggaccctaacgtaaagtttaacccgtttacgaacgggacgtacggggtaccaaccgtagtaccggaaccgtaacggggactacccggtacacgtaaccccaagaccgaacggtcgtaacctaggttaacgggacctaggacgtacccgacgtacccacgtacgaaccggtcgaacggaccgcggtacttactcgttctaggtcgagtacgtccgttacctaggtcggttccgggaacctacgggttgttccggttggacccgg

SEQ ID NO: 1644 - DNA, 846 bp, Homo sapiens
  misc_feature: GYAE6OF01DT4ST.43.5.A05.1.454.CMB.1.raw
tcagtgtgagtagtcacgaccggtgctcgatttagatagatagacagggggagcatcacccagcaaccacatctgtcctctagagaactcccctgagacgctccgttcctcaccatggactggacctgggaggtactcctctttcgttggtggccagcagccacgaggacgccccactcccgaggtgacagtcgtggtgcgtggtcggtggggtcgtaggagggtagaaggtaaccggccggtcggggtcctacgtaggtacggtaacggttcctaccgtcggtacgtaacgggtccttacggtacggtaactaaccgtaacccgtttccggaaccccggttcttaactaattacgtaacgtacggttacgggggtcgaccggaccggtacccgggtacccggtacggggtaaaccggacggggttacgttagggaacgggtgggaaggtacggggtacggtaacgtaacccgtaaaccgtaagaacggttcgggactaccgtaacgttacgtagtaacgtcgaaccgtaaacgtaacgttaccgttaaacggcggtaaccgtacgggtaacaaccgtagtaaccggaaccgtacgggaaccgtaccgtaccgtaacgtaaccgaacctaacggaccggtaactaccgacgaccgggtacgtaacgccgtaacgaccgttccgaaaccccgtacggacgtacccgaaccgggtaccggaccggttacttacgtttaccggttacggccgggttacgtacccgggacggttcccgtacggttacggttacccgggttaccggaaacccgtttaggggttaaccggttaacgttcggtaaacccgggg

SEQ ID NO: 1645 - DNA, 621 bp, Homo sapiens
  misc_feature: GYAE6OF01BW5JE.43.5.A05.1.454.CMB.1.raw
  modified_base (251)..(251): a, c, t, g, unknown or other
  misc_feature (251)..(251): n is a, c, g, or t
  modified_base (352)..(352): a, c, t, g, unknown or other
  misc_feature (352)..(352): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcaggtcgtggggcgtgaggtgaagaagccgtggggcctcgagtgaaggtctcgtgcgaaggcttcgnggactacctaccttcgaccggtctactatactacacgtgggtcgacgacacggccctggacgaagggtctggagtggagtgggacgtatacgaaccgtaanagtggtacacctacgtctagtactcgacactacgtactttacgaagggtaccacggggtaccacgtaagtacggaaccgaagggaccaaccgtaccaactaccaacacgaggaacctacaacgtcggacctacggacgacgccgacctacgaccgtaccgtacggaccgtaaccggacggtcgtttacttagttacgtgtacgcggtaacgtccgttacccgttagtcggttacggaccgtaacgggttcgggttaccttgggtaaccg

SEQ ID NO: 1646 - DNA, 757 bp, Homo sapiens
  misc_feature: GYAE6OF01D8TQV.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcagtgaaggtctcctgcaaggcttctggatacaccttcaccggctactatatacacgtggtgcgacgacggcccgtggacgaagggtcttggagtggagtggggacgtagtacgaaaccctaaagtaagtgggtacgaccctaacgttcgttagttaagtcgacctaacgaacgttaaactttacgaaagggtaccgtaacggggttaccaaccgtagtacgaacccgtaacggggaaccctaacggtacctaacgtaaccgaaaccgaacgtaacggtacctaaacgtacgtacggtaaccgttaggacgacgaaccgtaccctacgaaccggtaacccgtacggtaaccggaacccggtaaccggggtaccgtttaccgttaaacggttttccgttcggggttaccgggtaccgggttaaccggtaaaccggtttaccccgttaacgggtttaccgggggtttaacccgggtaaccccggttaaacccggggtttacgggggggtttaacccttttacggggtaaacccccgggg

SEQ ID NO: 1647 - DNA, 625 bp, Homo sapiens
  misc_feature: GYAE6OF01B6IVZ.43.5.A05.1.454.CMB.1.raw
  modified_base (368)..(368): a, c, t, g, unknown or other
  misc_feature (368)..(368): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcgtgggcctcgagtgaaggtctcctgcgaaggcttctggatacaccttcaccggctactatatacacgtgggtgcgacgacggccccgtggacgaagggtcttgaggtggagtggggacgagtcgaaacctaacgagtcggtacgcctacttcgtgtancgactacgaacgtaactttcgagtacgacggtaccactagtacgaccggtaacgggactaccggtactaactaccaacaccgaacgtactaacacggttacgaacgtacggacgcgaccgtaccctacgtacgaacccgttcggaaccgaccgggaccggtcgttccttagtttcgtggtacggacggtaacggtccgtaccgttaggttccggtacgggtacccgtaacgggttcggttaccgttggtaacccggg

SEQ ID NO: 1648 - DNA, 708 bp, Homo sapiens
  misc_feature: GYAE6OF01BM5MH.43.5.A05.1.454.CMB.1.raw
  modified_base (308)..(308): a, c, t, g, unknown or other
  misc_feature (308)..(308): n is a, c, g, or t
  modified_base (366)..(366): a, c, t, g, unknown or other
  misc_feature (366)..(366): n is a, c, g, or t
  modified_base (427)..(427): a, c, t, g, unknown or other
  misc_feature (427)..(427): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggacgccctcactgactgtcgtccccgaggagggacagtcacctctcacctgtgctccagcactggaactgtccaccgagtggtctattactccctacgtggttcccagcagaacgccgtaggcccacggcccccggacacctgtatttangaactacgaacgaccaaactaaacctttcctacggacctaccctcggcccactttccncacggtcctcccgtcgttagggggaccaaagtcctcgccctcggtacccgtttcggggtcnccggacgtacgtcccgtaggtacggtactacgggacggtctacgtacgttaacttacgttggtccgttcgtaccgtccgtaccttagtcgtacgtccggtccgttacgggttccgggtttaccgggacgggtaacgggtaccgttaacggttccggtaccggtaaccgttacggacgtacccgtacccggtaacggtcccgtacccgtacccccggttcggtaccctacggttcccttaccggtttccccccaccctttccccgtcctacggttaaccccc

SEQ ID NO: 1649 - DNA, 786 bp, Homo sapiens
  misc_feature: GYAE6OF01C7GTB.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggaccgtggaggatcctcttcttggtggcagcagccacgaggacgcccacctcccgaggtgcagcgtggtgcgagtcgtggggctggaggtgaagagccggtcgggctcgaggtaggtaacggtccttccgtgacgtaacggtctttcgtaggtactacctaccttcgaccggtactacttataactacgacggtagggtcaccgacgaccggtccccgtaggaacgtacgggtccgtttaggacggtggtacgggtaggggaacgtacgtaaccgaaacccttaagaacggttcggacgtacccgtacgttcgtacgtcgcgacctaacgtaacgttaacgttacggaacggtaaccggtacggtaccaaccgtacgtaaccggaaccggacggtaaccgtacccgtaccgtaactaccgaaacgtaccgaagtaccctaacgacggttaccgacggtacgaacggtcaacccggtcccgtaacgtaaccgaacccggttaggaacccggtaccgggtaccccgggttacgtttacgtttacccggttcgttagggtacccggtacggggtaccgttacccgttttcccggaaggtttttcccgggttacccgggtaaacccggttacgggtttccgggtttaaaccgttccgggttaacccgggg

SEQ ID NO: 1650 - DNA, 708 bp, Homo sapiens
  misc_feature: GYAE6OF01ASTUY.43.5.A05.1.454.CMB.1.raw
  modified_base (288)..(288): a, c, t, g, unknown or other
  misc_feature (288)..(288): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttgggtggcagcagccacaggacgcccactcccaggtgcagctggtgcagtcgtggggctggaggtagaagagccgtgggcctgagtgaggtctcgtgcgaggtcttcgtaggactaccgtaccttcgaccggtactactattactacncgtgggtgacgacgaccggcccgtagggacgaacggggtcttaggaggtagggaggtcggggaaccggtagtaccgaaaccctaacgaagtacgggtaccacctactgtcggtaatcgacacgtaaagttaaccgtttggaacggtacggtaccgggtaccaacgtacgtacggtaaccggacgggaacctaccgtacaacgtaaccaaccgtacggaacggtacctaaccgtaacggtaccggtaactccggaagacccgtaacgtcccgtaacgaaccggtaccgttaccggaaccgacgggtccgggtaaccgttctttaccgttcggtacggtacggtaccggacggtccgttacccggttagtaccgggttccggacccgtttaacgggcgggtttaccgttacggtaacccggg

SEQ ID NO: 1651 - DNA, 682 bp, Homo sapiens
  misc_feature: GYAE6OF01COVFG.43.5.A05.1.454.CMB.1.raw
tcagtgtgagtagtcacgaccggtgctcgatttagatagatagacagggggaggcatcacccagcaaccacatctgtcctctagagaactcccctgagagctccgttcctcaccatggactggacctgggaggatcctcttcttggtggcagcagccacgaggacgccccacctcccgaggtgcagcgtggtgcaggtcgtggggctggaggtagaaggacgccggtggggcctgacgtagaacggtctccgtgacgaaggtcttacgaggtactaccgtaccttaccgaccggtactaactactatacacggtgggtcgccgacgacggtcccgtaggacgacgggtcgtgaggtggagtgggacgtacgtaaccgaacctaagtaagtcgggtacacccgtacttcgtagtacggtacgacctaacgtaacgttaaccgtttacggaaacggtacggtacgggtacccaacgtaaggtaccggaaccggaacgggtaacctaccgtaaccaaactaccgaaccgaacgacggtacctaacgagttccggactggacgaaccaccgtccgacacggtaccacggaccgtacgaccggtgttaccttagttcgagttcgacggacgtccgttaccgtggttaccgtccggaaccgttaggtacgggttcttcggtacccggg

SEQ ID NO: 1652 - DNA, 771 bp, Homo sapiens
  misc_feature: GYAE6OF01ARGYL.43.5.A05.1.454.CMB.1.raw
  modified_base (306)..(306): a, c, t, g, unknown or other
  misc_feature (306)..(306): n is a, c, g, or t
  modified_base (359)..(359): a, c, t, g, unknown or other
  misc_feature (359)..(359): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtgcagtcgtggggctgaggtgaagagccgtggggcctcaggtggaaggtctcctgcaaggtcttctggataccaccttcgaccggctactatactacacgtgggtcgacgacgacggccccgnggacgtaagggcttaggaggtcggagtggggaacggtagtacggaaccctaanaagtggacgccacgttcgtagtagtcgacacgtaagtaaccgtttacgaacgggtaacggtacgggtaccaacccgtaggtaccggaaccggaacggggaacccgtaaccggtaccgtaactaaccgaaccgaacggtaacggtacctaaaccgaacgtcgggtaaccgttacgaacggtaccgaaccgtacccgtaccggtaacggtaacccgtacgggaacccgggaaccggtaccgggggttacccgtttacgtttaaccgttttaccggtcggggttacgggacccgggttaaaccggttacccggtttacccccgtttaagggtttccggggttaccccggggtaaccccggttaaaccgggggttcgggggtttaaacccgttttacgggttaaacccccgggggg

SEQ ID NO: 1653 - DNA, 665 bp, Homo sapiens
  misc_feature: GYAE6OF01BJB97.43.5.A05.1.454.CMB.1.raw
  modified_base (164)..(164): a, c, t, g, unknown or other
  misc_feature (164)..(164): n is a, c, g, or t
  modified_base (258)..(258): a, c, t, g, unknown or other
  misc_feature (258)..(258): n is a, c, g, or t
  modified_base (382)..(382): a, c, t, g, unknown or other
  misc_feature (382)..(382): n is a, c, g, or t
  modified_base (392)..(392): a, c, t, g, unknown or other
  misc_feature (392)..(392): n is a, c, g, or t
tcagtgtgagtagtcacgaccggtgctcgatttagatagatagacagggggagcatcacccagcaaccacatctgtcctctagagaatcccctgagagctccgttcctcaccatggactggacctgggaggatcctctttcttggtggcagcagccacaggacncccactcccaggtgccagctggtgcagttcgtggggctaggaggtagaagagccgtgggcctgagttgacggtctaccgtgacaaggtcttcgnggacttaccacccttcgaccggtacttactataactacacgtgggtgaccgacgccggtccccgaggacgtaacgggtctaggaggtggagtggggacgtataccgaacccgtaagacgtggcncctacgttcngtatcggactacgtaagttacttagaacggtacgtacgggtaccaacgagtaccgaacggacgggtaccctaacgtacccaataccgaacacggaacgtcctaacgagtcgaacgtcgacgacgaccggactaccgaacgtacgacggaaccgacgtcccggggtactacttagttccgtaggtacggtaccggtacggtaccgtaccgttaacggttcgggtacccggtaacccggttaacgggttcgggtaaccgtttccgggtaaccggg

SEQ ID NO: 1654 - DNA, 845 bp, Homo sapiens
  misc_feature: GYAE6OF01C7NRA.43.5.A05.1.454.CMB.1.raw
  modified_base (250)..(250): a, c, t, g, unknown or other
  misc_feature (250)..(250): n is a, c, g, or t
tcagtgtgagtagtcacgaccggtgctcgatttagatagatagacagggggagcatcacccagcaaccacatctgtcctctagaagaactcccctgagagcctccgttcctcaccatggactggacctggagatcctcttcgttggtgcagcagccacgaggacgcccactcccgaggtcgcagtcgtggtgcgtagtcggtgggctggaggtagaagacgccgtgggcctagagtacgacggtcctcgngacgaacggttcttacgtggtaactaccgtaccgtttaccgaccggttacttaactacttaacgtaaccgtacggttgggggtccgaaccggtaccggacccgggtaccccggtaagggtaaccgggtaacgggttccggtttagggtaacgggttaggggaacgggttgggggaaacccggtaagttaaaccccggtaaaacccgttaaacggtaaacggttcgggttacccgtaacccgttacgtttaccggttaggttacgtaacgacctaaaccggttaaacgtttacctttaacggggaaacgggttacggtaacccgggtaacctaacccgtaaggtaaaccggtaacccgggaaaccggtacccgttaaaccgtacctaaacggtaaccaacgtaaccgacggtaacctagacgttacgtacgacgacgtaccgaccgtaccctaacggtaacgaccgtaccggaaccgtacgggacccggttcttcgttaccgttggaccggttgacgtacggtacccgttaccggttgtacccgggttaccgggtacccgttagggtttaccgggtaccgtttcggtaaacccggg

SEQ ID NO: 1655 - DNA, 729 bp, Homo sapiens
  misc_feature: GYAE6OF01BALUQ.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggagcccactcccaggtgcagctggtgcagtcgtggggctggaggtagaagaacgtccgtggggcctcgagtcgaacggtcctccgtgaccgaaggtcctttcgtgggtaactaaccgtacccttaccgacccggtacttaacttagtataaccgtaccgtgggtcgaccggacgacggtccccgtagggacggtaacgggtcgttaggtacggtgggaaggtcggggaacgggtactaacggaaacccgtaacgtaagttcggggtaccgaccgtacgttccgtagttacgtacgaccgtaagaacgttaaccgtttagaacggggtaccgtacgggttaccaaccgtaacgtacggacccggagggaaccctacgtaccacaccaacacgacgactacgagtacggtacacggcgacgacgtacctacggacgtaaccgtacgaaccgtaccggaacgggtcgttacgttacgttacgttggtccggtaggtaccgtacggttaccgttacggttccgggttaccgggtacccggtaacgggttcgggttacccggttcggtaaccggg

SEQ ID NO: 1656 - DNA, 726 bp, Homo sapiens
  misc_feature: GYAE6OF01D8AWT.43.5.A05.1.454.CMB.1.raw
tcagtgtgagtagtcacgaccggtgctcgatttagatagatagacgagggggagcatcacccagcaaccgacatctgtcctctagagaatcccctgagagctccgttcctcaccatggactggacctggaggactcctcttcttggtggcagcaggccacgagagcccactcccaggtgcagctggtgcagtcgtggggctggaggtgaagaacgcccgtggggcctcgagtgaacggtctccgtgcaaggtcttcgtaggactaccgtaccttcaccggtctactatactacacgtgggtcgcgacgacggtccccgtaggacgaagggtcttggagtggagtgggacgagacgtaaccgtaacgaggtcggtcgccgactcgtagtagtcacgacgtacgttaaccgtttacgacggtaaccgtaacgggtacccaaccgtacggtacgaaccccggtacgggaacccgtaccgtaaccctacgttaacccaaccgaacgacgtacgtacgtacggtaccggtaaccgtacggacgtccaccggtacccgtaccgaaccggtaacccgtcggaaacgggtacccgggttacgggtacccgtttacgttaccgtttccgttaccgggtcgtaacccggtaaggttcccggtacccggtttagggtaccggggtttcccggaaccccggttaaccggtttacggggttaccttccgggtaaccggg

SEQ ID NO: 1657 - DNA, 598 bp, Homo sapiens
  misc_feature: GYAE6OF01D5TU4.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctgggaggatcctcttcttggtggcagcagccacaggagcccactcccaggtgcagctggtgcagtcgtggggctggaggtgaagaagccgtgggcctcagtgaaggtctctgcaaggcttctggatacaccttcaccggtctactatatacacgtgggtgcgacgacggtccccgtaggacgaacgggtcttggaggtggagtggggacggtatacgaaaccctaacgaagtggtacgaccactcgtgtatcgacacgacgtaactttcgagggacgtacggggtaccaccgtagtcggaaccgacgggaaccacgtaccataccaacgacgacgactacgagtcggactgacgcgacgccgacgacgccgtaggaccgacggaccggtcctacgttacttcgtggtcgtacggtacgtccgtacccgtagttccgggtaccggaccctaaggttcgggtacgttcgtaaccgg

SEQ ID NO: 1658 - DNA, 742 bp, Homo sapiens
  misc_feature: GYAE6OF01A6NQV.43.5.A05.1.454.CMB.1.raw
tcagtgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattactccctactggttccagcagaagcctggcccacggcccccccggacaccgtgtatttatgaatacaagaccaaacctaaaccttttcctagggaacctaccctcgccccgtaattcctccgacgggtccctccccgttccgttacgggggggcctaaaacggccgttcggtccccgttacggttaccccgttttcggggtcgccggccgacggtcccgtggaacgggactgggaacgggtcttacggaactttacgttaaccgtcgttaccgtttgtcccgttcccggtccttaggtacggtactcggtcgtttcgggtccgggttttccgggggttttaccgggaccggggggttaacgggtaaccgttaacgggttacggtaccccggttaccgtacggtaccgaccgggtacccgaacgggtccccgttcccggccccccggttcggtcctaccgttccgttacccgttcccccgtcccttcccgtaccttaccccg

SEQ ID NO: 1659 - DNA, 668 bp, Homo sapiens
  misc_feature: GYAE6OF01ACLWZ.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggacgcccactcccaggtgcagctggtgcagtcgtgggctgaggtgaagacgccgtgggcctcgagtgaacggtctcctgacaggtcttcgtaggactaccgtaccttcgaccggtcttaactataactacgtacggtgggtcgacggaaccgtaccggccccgtaggaaccggtaaggggtccttagggaacggttgggacgtacggggaacgtacgtaccgaaacccgtaagtacggtcggtcctaccgtacttcgtagtactcgacgaactaagttaaccgttcgaacggtacgtacgggtaccaaccgtagtaccggaacggacggacctaccgtaccactaacgaaccacgacgactacgacgtacggactacgacgtcgaccgaccgtacgacccgtacgtacgaccggaccgtacggtcttacgtcgttacgcggtcggacgtacgtccgtttaccgtggttcggtacccggaccgtacgggttcggttattcggtaacccgg

SEQ ID NO: 1660 - DNA, 788 bp, Homo sapiens
  misc_feature: GYAE6OF01BS9SH.43.5.A05.1.454.CMB.1.raw
tcagtgtgagtagtcacgaccggtgctcgatttagatagatagacagggggagcatcacccagcaaccacatctgtcctctagagaactcccctgagagctccgttcctcaccatggactggacctggaggatcctcttcttggtggcagcagccacgaggacgcccacctcccgaggtgacgagcgtggtgcaggtcgtgggctggaggtagaaagagccggtgggcctacgagtacggaagtctccgtagacgtagtcgttacgtggtaactaccgtaccttaccgaccggtacttaactatacgtacgtacggtgggtcgaccgacggaccggtaccccggtaggaccggtaagggtctttagggaacgggttagggtaacgtacgggggtaaccgtacgttaaaccggtaaaccctaaaggtacggttacgggtccggaaccccttacgttccgtaacggtagtacgtaccgaaaccgttaaacgtttaacgtttaccgggaagggtaacggtaccgggtaacaaaccggtacgtaacggaacccgggaacgggtaacccgtaacccgtaaccgtaactaaccgaaacccgtaacggtaaccgaaccgtacgtaacggtacggaaccgtacgaacgccgtaacgcccgttacgacgtaccgtacgaaccgaaccggtccggtacgttcgttacgttccggtagtaccgaggacggttcccggttacgttacggtcgggttacccggtaccgtaacgggtttaccggtaggttccgtaaccgggg

SEQ ID NO: 1661 - DNA, 581 bp, Homo sapiens
  misc_feature: GYAE6OF01AXPSE.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctcagtgaaggtctccgtgcaaggtcttctggatacaccttcaccggctactatatacactgggtgcgacacggcccctggacgaagggtcttggagtggagtgggacgagtacgaaccctaacaagtggtacgccactcgtgtatcgcaacgtacgtaaccgtttcgaacggacgtaggggtaccaccgtagtacgaccgacgggactaccggtaccataccaacacgacggtacctacgatcggacctggactccgacgtccctacgaccgacctagaccgacggacgggtctcgttacttcgcggtcgcgacgtccgtacccgtagttcggtcgggaccctaggtcgggttcttggtaccgg

SEQ ID NO: 1662 - DNA, 605 bp, Homo sapiens
  misc_feature: GYAE6OF01C9PGC.43.5.A05.1.454.CMB.1.raw
  modified_base (258)..(258): a, c, t, g, unknown or other
  misc_feature (258)..(258): n is a, c, g, or t
  modified_base (290)..(290): a, c, t, g, unknown or other
  misc_feature (290)..(290): n is a, c, g, or t
  modified_base (541)..(541): a, c, t, g, unknown or other
  misc_feature (541)..(541): n is a, c, g, or t
  modified_base (548)..(548): a, c, t, g, unknown or other
  misc_feature (548)..(548): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtgggctgaggtgaaggagccgtggggcctcgaggtgaacggttctcctgcaaggcttcgtggattacnccttcaccggtctactatactacactgggtcncggacgacggccctaggacgaagggtcttgcggtaggtagtggggacgattacgaaacccttaacgaagtggtcgacctactcgtagtactgcgactagtaactttgaaggacgtaggtacacctacgtacgaccgtacgggaaccacgtacctaataccgaacgtacgacgactacgagtcggacgttgacgacgacgacctacgacgtaccgtacgtaccggacgtaccgggtacgttccgtatttcgnggttcgngtacggacgttccctagttcggtacggtaccgtaagtcggggtacttcgggtaaccg

SEQ ID NO: 1663 - DNA, 806 bp, Homo sapiens
  misc_feature: GYAE6OF01COCO5.43.5.A05.1.454.CMB.1.raw
  modified_base (410)..(410): a, c, t, g, unknown or other
  misc_feature (410)..(410): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggagatcctcttcgttggtggcagcagccacaggacgcccactcccgaggtgcagcgtggtgcagtcgtgggctggaggtagaagaacgccgtgggcctcgagtggaacggtctccgtgacaacggtcttcgtggaactacaccttcgaaccggtctaactaatatacgacgtggggtcgacgaccacggccccgtagggaacgaacgggtcgtttaggaggtagggagtaggggaacggactacgaaacctaagtaagtcgggtacacctaacgtcgtagtacncgtacgaacgtacgttaaccgtttagaaacgggtaaccgtacggggtaacctaaccgtaacggtaccggaaccggaaaccgggaaccgtaaccgacccgtaaaccgtaccaaaccgaaccgtaaggtaccctaaacgtaacggttacccgggtaaccgttacgggaaccgtaccgacccggtacccgtaaccgtaaccggaaccgttaccgggaaacccggtaaccgggaacccgggggttctttaacccggtttacttttccggttacgggttaccgggaccgttaacgggttaccccgtttaacccccgtttaagggtttaccgggtttaaccccggggaacccctttaagggggttacccgggttttaaccggtttaccgggtaaaccccggg

SEQ ID NO: 1664 - DNA, 743 bp, Homo sapiens
  misc_feature: GYAE6OF01C48TY.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaaggaacgccgtgggggcctcgagtaggaacggtcttccgtgacgaaggtctttacgtggaacttaccctacctttccgacccggtacttaacctataactaacctacgtggggtgccgaaccgaccgggcccccgtaggaaccgaacggggtcttaggaggtagggagtacggggacggtaactaaccggaaaccctaaacgaacggttggtcgaccctaacgttcgttaagttacgacggactacgtaaagttaacctttacggaacgggtaaccgtagggtaccctaaccgaacgtaccggaaccggaacggggaaccctacccgtaacccgtaactaacccgaacctaacgaaccggtacctaacgacggtacgaccgtagacgtaccgaccgtaccgtacgacgccgtaacggaccgaccggtacgggtaccgttacgtaccgtttcgcggtacgtacggtacgtccggttacccgtggttacccgggtcgggtaaccccggtacggttacgggtcgtttcgggtaacccggg

SEQ ID NO: 1665 - DNA, 809 bp, Homo sapiens
  misc_feature: GYAE6OF01CH3R5.43.5.A05.1.454.CMB.1.raw
tcagtgtgagtagtcacgaccggtgctcgatttagatagatagacgagggggagcatcacccagcaaccacatctgtcctctagagaactcccctgagagcctccgttcctcaccagtggactggacctgggaggactccttcttcgttggtggcacggcacgcccaacgagggacgccccaccgtcccgagggcggccaggtccgtgggtcgcgtaggtccggtgggggcgtggaggtaggaaggacggccggtcggggcctagaggtggaacggttcctccgtacgacgtaaggtcctttcgaggtactaaccctcccgttaccgaacccggtactaactatacctacgtacggtgggtacgccggaccgaccggcccgtaggaaccggttaacggcgtttaggaggtacgggtaacggtcggggtaacgacgtaaccggtaaaccctaaggtagtacgggtaccgtccctaagttcccgttaggtaactacgaaccgtaacgtaaacgttacgttaaccggaaacgggacccgggtaaccgtaccgaaacccgttacggtaaccgggaaccggtaaccggtaaccccgtaccgtaacctaccgtaaccgaacccacggaacgtaacgtaacggtacgtaccggtacgtacggaacctccggaaccgtccgacgtaccgtaccggtacggaccgggtaccgggtaaccgttcgttaccgttagtcggttacggcggtacgaccgggtccttacgttacgggtaccggtaccgggtccgttagggtcggttaccctgggtaacccggg

SEQ ID NO: 1666 - DNA, 679 bp, Homo sapiens
  misc_feature: GYAE6OF01CB8QE.43.5.A05.1.454.CMB.1.raw
  modified_base (136)..(136): a, c, t, g, unknown or other
  misc_feature (136)..(136): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctnttcttggtggcagcagccacgaggacgcccactcccaggtgcagctggtgcagtcgtgggctggaggtagaagaacgccgtgggcctcgagtgacggtctccgtgcgaaggtcttcgtaggaactacctaccttaccgaaccggtaccttaacttaataacgtaccgtacgttcgggtcgaccggaaccgacgggcccccgttagggaaccgtaaggggtctttaggaacggttgggaaggtcggggaacgtagtaaccgaaacccgtaaacgagttacgggacgaccgacttcgtgtactcgactacgaagttaccgttacgaggaacgtacgggtacaaccgtagtacggaaccgtaacgggacctaccgtaacacgtacaacgacgacggactaacgacgtcggacctggacgtcgaacgcccgtagaaccgtacgtacgaaccgtacgaccggtacttcgttacgttcgtacgtcgacgtacggtaccgttcgtacgttacggtccggtaccgtaagggttcggttacgttcgaaccgg

SEQ ID NO: 1667 - DNA, 625 bp, Homo sapiens
  misc_feature: GYAE6OF01DL30E.43.5.A05.1.454.CMB.1.raw
  modified_base (301)..(301): a, c, t, g, unknown or other
  misc_feature (301)..(301): n is a, c, g, or t
  modified_base (365)..(365): a, c, t, g, unknown or other
  misc_feature (365)..(365): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggagatcctcttcttggtggcagcagccacaggacgcccactcccaggtgcagctggtgcagtcgtggggctggaggtgaagacgcctggggcctcgagtggaacggtctccgtgcgaaggtcttctggaactaccacctttaccgaccggtctaactaatactacacgtggggtnacgtacgacggcccgtaggaacgtaacgggtctggaggtggagtgggacgatacgaaccctaanagtgacgtcacgtctgtagtcgacacgtagtaactttacgacggaacgtacgggtaccaacctagtaacggaccgaaggaccctacggtacaacgtaccaacgcgaacgtactacgagtacggactaggacgcacggtcctacgacgtaccgcggaacgccggacgggtcttcgttagtttcggtacgtacgacggacggttaccgtcccgttagttccggtaccggtaaccgaggttaccgggttattccggtaaccgg

SEQ ID NO: 1668 - DNA, 662 bp, Homo sapiens
  misc_feature: GYAE6OF01A49S3.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctggaggtgaagaacgccgtgggggcctcagtgaaggtctcctgcaaggtcttctggatacaccttccaccggtctactatataccacgtgggtgtaccgacgacggccccgtaggacgaagggtcttagaggtgggagtcggggacggatacgaaccctaaacgaagtggtacgcccactcgtagtactcgacaactaacgtaacgtttacgaacggacgtaacggggtaccaacgtactacggaaccgaacggggaccaaccggttacccaacgtaccaaaccgacgaacgggactaacgtacgacgggactcgaacgccgacgcccgtaccgtacgacccgtcgaaccgaccggtaccgggtcttacgttacttcggtaggtcgaccggaggtaccgttaccccgttaggttccggttacccgggtaacccaacggggttcgggttaccgtttcggtaacccgg

SEQ ID NO: 1669 - DNA, 716 bp, Homo sapiens
  misc_feature: GYAE6OF01EAURN.43.5.A05.1.454.CMB.1.raw
  modified_base (244)..(244): a, c, t, g, unknown or other
  misc_feature (244)..(244): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggagcccactcccaggtgcagctggtgcagtcgtggggctgaggtgaagacgccgtgggcctcagtgagtctcctgcaggcttcgnggactacctaccttcgaccggtctaactatacgtacacgtgggtcacgtacgacggtcccgtaggacgaacgggtcttggagtggagtcggggacgtatacggtaaaccctaagaacgtcggtacgacctacgtactagtatcgacaacgtagtaaccgtttacgagggtaaccgtacgggtaccaaccgtgttaaccggaaccgaacggggtaaaccaccggttaaccaagtaaccaaaccgacgaaccggtacttaaccgtacggtaccggtaccgtacgggacgtaaccgtaccggtacccttaacgaccgttaacccggttaaccggaaccggtaccgggtaccggggtccgtttaaccgtttacgtttacgttacgggtacgtaccggtacggttacccgttacccgttaggttccgggttaccggtaacccgtaagggttccggggttacttcggttaaacccggg

SEQ ID NO: 1670 - DNA, 723 bp, Homo sapiens
  misc_feature: GYAE6OF01CHBMT.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccagtggactcggacctgggaggacttccttcttcgttggtggcagcacgccacaggacgcccacctcccagggtcacgcgtcgtgggtcgcgtacgtcggtggggtctaggaagggtgaaagacggtccggtggggcctacgaggtgtaacggtctccgtagacgacggtcttcgagtaactaccgtaccttaccgaccgtactaactattaactaccgtacggtggtacggtaccgaccgaccggtccccgtaggaaccggtacgggtgttaggacggtagggtagaggggacgtacgtaaccggtaaccctaagaacggttcggcaccgtaacttcgtaacgtgtacgaccgtaaactaacggttaaaccgttcggtaacggacggttaacggtaccaccgtaaggaccgtaacggaaccggtaacgtaaccgtacgaactaccgaaacacgtaacgtactactacgggtacctaacgccgtagcccgacgtaccgacgtaccgacgtaacgaccgtacggtaacgtcgttacgttacgtcgtacggtcgaacgacgtaccgttcgttggtaccggaccgttaacctgggttacgtgttccgtaaccggg

SEQ ID NO: 1671 - DNA, 697 bp, Homo sapiens
  misc_feature: GYAE6OF01BI60X.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggagggtagaaggaaaggccgtaggggcctcgagtggtaaggtcctccgtgacgaaaggtcttcgtggataccaccttcaccggactactatactactactgggtcgcggacgacggccccgtggacgaaggcgttaggagtggagtggggacggagtacgaacccgtaaactaagtggtcgaccgtactacgttgtacgtgtacaacgtaacgtaacgttacgtacggaacgtaacgggtacctaacgtacgtacgaccgaacggggacaacggtaccaacgacaaccacgtaacggactaacacgtagacctaggtacaccgtacgcccgtacgaacgtaccgtacggtaaccggaccgtaccggggtacgtaccgtttacgttccggtttagtcgggtacggtaacggtaccgttaccgttaaccggtttacggtttaaccggggaccccggttaaccgggttacggggttacccggtttaacgttaaaccccgggg

SEQ ID NO: 1672 - DNA, 789 bp, Homo sapiens
  misc_feature: GYAE6OF01BKHRJ.43.5.A05.1.454.CMB.1.raw
  modified_base (138)..(138): a, c, t, g, unknown or other
  misc_feature (138)..(138): n is a, c, g, or t
  modified_base (162)..(162): a, c, t, g, unknown or other
  misc_feature (162)..(162): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggagatcctcttnttggtggcagcagccacgaggacnccccactcccgagggtgcagcgtgggtgctaggtcgtggggctggaggtgaaagacgccgtcggggcctcgaggtcggaacggtctccgtagaccgaaggtcttcgtaggtactacctacccgttaccgaccggtacttaacgtaatactacgtacggtgggtcgaccggacgaccgggtccccgtaggaacccggtaagggtacgttagggtaggtacgggacgggttacggggaaccggtaagtaacccgaaaacccgttaaacggaacggttcggtaacgggtacccctaacgttacggtacggtttaataccggtaactaaccggtaaacgttaaacccgtttacgggaaaccgggtaaccggtacgggtaaccctaccggtaacgtaaccgggaaccggtaaacggggacccctaaacccggtaccaaaccgtaaccgtaaacccgaccggtaacggtaccctaacgtacggtacggtactacgacgcgaaccgtacctaccggactaccgtacggaccggacgacgggtcccttagttacgttcgtaggtaccgtacgacggttacccgttaccggtagttacgggtacgaccttacggacgggttacgtccggttaacgg

SEQ ID NO: 1673 - DNA, 975 bp, Homo sapiens
  misc_feature: GYAE6OF01AZS7W.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttgggtggcagcagccacgaggacgccccactcccgaggtgcagcgtggtgcagtcgtggggctggaggtgaagacgccgtggggcctcgaggtggaacggtcctccgtggacgaacggtcctttacgtacggacttaacctacccgttaccgacccgggtcttaaccgttaataactaccgtaacggttcggggtagacccggaaccgaccgggtcccccggttagggaacggtaacggggtacgttagggtaacgggtggtaggtacgggggaaccggtacggtaaccgaaaccccggttaaagtaaacgttacggtccgacccgttaccttaccgttaggttacgtaccggtaaccgtacgtaaacggtttaacccgtttacggaaacggggtacggtaaccggggttacccgaaccggttaacggtacccggtaaacccgggtaaacccggggaaaccccgttaaacccgggtacccgtaaacctaaacccgtaacccgaaacggtaaccggtaaccttaacccgtaacggtaacggtaccccggtacggtaacgggacgtaaccccgggtacccgtaaccgggtaacccggtaacccgtttaccggggaaacccggttacccgggtaacccgggggttaccgtttcccggttttaaccggttttaccggttacggggtcccgggtaacggttaaccccggggttaaccccggtttacccgggtttaaacccgggtttacgggggttaacccccgggggtaaccccggtttaaaaacccggggggtttcccggggttttaaacccgttaacccggggggtttaaaccccggg

SEQ ID NO: 1674 - DNA, 732 bp, Homo sapiens
  misc_feature: GYAE6OF01C7SBI.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggacgcccactcccgaggtgcagctggtgcgagtcgtggggctggaggtagaaggaacggccggtcggggcctcgaggtaggaacggttcctccgtagcgtaacggtctttacgtaggaacttaccgtaccctttcccgaacccggtaccttaacttaatactaaccgtacggtcggggtcgaccggtaccgaacgggtcccccgtagggaaccggaaggggtccgtttaggacgggtgggtagggtacggggaacggtacgtaaccggtaaacccgtaaacgtacggtttcgggccgtaacccgtacgtttaccgtaggttacgtcgtaaccgaacgtaacgttaacgtttacgaacgggaaccgtagggtaccaaccgtacgtacggaaccgacgggtactaccgtacaacgtaccaactacggacgtaccgtaacgtacgtacgtacctagacgtcaccgtaccacgacgaccgtacgacgacggtaccggtcttactacgtttcgcgtcgtagtacgtcgttaccttggttcggtaccggtaccgtagggtaggtccgtttaggtaccgg

SEQ ID NO: 1675 - DNA, 811 bp, Homo sapiens
  misc_feature: GYAE6OF01AOEQB.43.5.A05.1.454.CMB.1.raw
tcagtgtgagtagtcacgaccggtgctcgatttagatagatagacaggggctggcaccaggggtcccttccaatatcagcaccatggcctggactccctctctttctgttcctcctcacttgctgcccagggtccaattcccaggctgtggtgactcaggagccctcactgactggtcgtccccagggagggacagtcactctcactggtgcctcagcacgtggactgtcacgagtgtctattactcctacttcggttaccagacagaacgccgtacggcccaccgggcccccgactacgtgtaactttatagactaacaacgactaaactaacttccgagaccaccgtcgcccgtattcctacgacggtcccttcccgtccgggttaggggacctaaacgtccgtaccgtcccgttaccggtacccgtttgggacgtaccgaccggtacgtacccgtaggtaacggtacgtacgggacgtaccgttaacgtacgtttacgttaccgttacggttctttccggttacccgtaccgtaccgtacggtttacgacggttcccgggttcccgggtttccgggtttttacccggggggtttaccgggggtaacggggttaacccggggtaaccgtttaacggggtttaccccggtacccgtttaaccgggtaccgggttcccgaacccgggttaccccgggaacggttccccggtaccccggttaccccccgggttcggttaccccggttaccctttaccggttcccccgttaccccccgtacccctttcccggttaaacctccccggttaaccc

SEQ ID NO: 1676 - DNA, 750 bp, Homo sapiens
  misc_feature: GYAE6OF01AH6G7.43.5.A05.1.454.CMB.1.raw
  modified_base (175)..(175): a, c, t, g, unknown or other
  misc_feature (175)..(175): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtncagcttggtgcagtcgtggggctggaggtgaagaagccgtggggcctcaggtgaaggtcctccgtgcgaaggtcttcgtaggatacctaccttccgaccggcttactatactacacgtgggtgcgacgacggccccgtaggacgagggtcttaggaggtgggagtgggacggtatacgaaccctaacagtggtcgcctacgttctagttacgcgacaacgtaggtaacctttcgaacgggtaccgtacgggttaccaaccgtacgtacggaacccggaacggggtaccctaacccggttacccaacttaacccgaaccgtaaccggaaccgggtaccttaacgaccgttacgggtaacccgtacggaacgtaccgaaccgtcccgtaacgaacccggtaaccccgttacgggaacccggtacccggtaaccggggttccgttacgtttacccgtttcgttacggttcgggaccggttaacggtaccggtttaccccgttaggtttccggggttacccggggtaaccccggttaagggttacccgggggtttaaccgtttacgggtaaaccccggg

SEQ ID NO: 1677 - DNA, 693 bp, Homo sapiens
  misc_feature: GYAE6OF01BGOWU.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctgggaggatcctcttcgttggtggcagcagccacgaggacgcccactcccgaggtcgcagcgtgggtcgccgtaggtcgtggggctggaggtaggaaaggacgccgtggggcctcgaggtcggaacggtctccgtggacgaacgggtcttcgaggtaactaccgaccttccgaaccggtctaactagtactacgtacggtggtcgaccgtacgaccggcccgtaggacgaggtcttaggagtggagtcgggagagtacgaaaccgtaagaacgtcggtcgaccgtacgtgttacgtagtacgacctacgtaacgttaacttacggacggtacgtacggggtacccaacgtagtaccggaaccggacggtaacgaccgtaccaactaacgaaccgacgaacgactaacgacgacggtaacgtcgaacgaccaccggcctacgaacggacctaggacccgacggtacgggtccttcgttacgttcgcggtcgtacgtacggtccgttaacccgttggttaccggttaccgggaacccgtagggttacgggttacgttacgggtaacccggg

SEQ ID NO: 1678 - DNA, 845 bp, Homo sapiens
  misc_feature: GYAE6OF01C5Y95.43.5.A05.1.454.CMB.1.raw
tcagtgtgagtagtcacgaccggtgctcgatttagatagatagacagggggagcatcacccagcaaccacatctgtcctctagagaactcccctgagagcctccgttcctcaccatggactggaccgtggagatcctcttcgttggtggcagcagccacgaggacgcccacctcccgaggtcgacgagcgtgggtcgcgaggtcggtggggcgtaggagggtaggaaggacggccggtacggggcctacgaggtaggaacggttcctcgtgacgtaacggtcttcgtagactactccttacgaccggtctactaatactacgaggtcgggtacgacgaccgccggtacccgtacgggaacgtagggtcgttaggagggtaggtacggtaggggtaccgaacgtaaccgtaaaccctaaggacgttacggtaccgaccctaacggttacgttacgtacgtacgtacgtaaacgttaacggttaacctttaacgggaacgggtaaccgttaccggggtaacctaaccgacggttaaccggaacccgggtacgggtaaacccgtaccgtaaccgtaaaccaccgaaaccgtaaccggtacgtaaccgtaccgtacggttaaccggacggtaagaccggtacgtaaccgtcccgtaaacgaccggtaacccgtaccggtaaccggtacccgggtacgggttccgtttaccgttacggttaccgttccgggttaacggtacccgggtaaaccgtttcccggttaacccggttaaggtttccccggggtacccgggtaaacccgggttacgggtttaaccggggttacccggttacggtaaaccccggggg

SEQ ID NO: 1679 - DNA, 586 bp, Homo sapiens
  misc_feature: GYAE6OF01BAFDJ.43.5.A05.1.454.CMB.1.raw
  modified_base (328)..(328): a, c, t, g, unknown or other
  misc_feature (328)..(328): n is a, c, g, or t
  modified_base (333)..(333): a, c, t, g, unknown or other
  misc_feature (333)..(333): n is a, c, g, or t
  modified_base (352)..(352): a, c, t, g, unknown or other
  misc_feature (352)..(352): n is a, c, g, or t
  modified_base (358)..(358): a, c, t, g, unknown or other
  misc_feature (358)..(358): n is a, c, g, or t
  modified_base (362)..(362): a, c, t, g, unknown or other
  misc_feature (362)..(362): n is a, c, g, or t
  modified_base (368)..(368): a, c, t, g, unknown or other
  misc_feature (368)..(368): n is a, c, g, or t
tcagtgtgagtagtcacgaccggtgctcgatttagatagatagacgagggggagcatcacccagcaaccacatctgtcctctagagaatcccctgagagcctccgttcctcaccatggactgggacctggaggatcctcttcgttggtggcagcagccacaggacgcccactcccaggtgcagcgtggtgcagtcgtggggctgaggtgaagaggccgtggggcctcgaggtgaggtcctcctgccgaaggtccttcgtgtatacctacctcgaccgctaactatatacacgtgggtgcgacgcggcccgtggacgagggctggaggnggagngggacgatacgaaccctanagtggngccnctcgtntgtgcaacgagtaacgttagacggacgacggtacacgtacgtacggaacgagggaacctccgtacctaactaccaacacgacgactacgaacgtcgaccgtagacgcgacgccgtacacgtaccacgaaccggacgcggtcgtcttagttccgtggtcgtagacgtccggttacctagttcggtaggacgtaacggtacggttcgggtaacgttacgg

SEQ ID NO: 1680 - DNA, 986 bp, Homo sapiens
  misc_feature: GYAE6OF01AQBYN.43.5.A05.1.454.CMB.1.raw
tcagtgtgagtagtcacgaccggtgctcgatttagatagatagacgagggggagcatcacccagcaaccacatctgtcctctagagaatcccctgagagctccgttcctcaccatggactggacctggaggactccttcttcgttggtggcagcagccacgaggacgccctaacctcccgaggtcgaccgagcgtgggtcgcgtaggtcggtggggtctggagggtagaacggacgccggtcggggtacctacggaggtacggtaacggttccgtaccgtacgacgtaacggttccgttacgtacgggtaaccttaacccgttaccccgtttaccggtaaccccggttaccttaaaccgttaaacgttaaccgttaaccggtaaccgggttacgggttaccgggaaccccggttaacccggacccgggttaccccggtaacggggtaaaccggtaacgggggtttacggtttacgggtaaacggggttaggggtaaccgggtacggggggtaaaaccggtaaacggttaaccccgggtaaaaacccggttaaacggttaaacggttccggggttaaccgtaacccgtaaccggtttacgttaacggtaacgtacgtaacccgtaaacgaacggtttaaccgttaccggaacgggtaaccgtacggggtaacctaccggtacgtaccgggaaccggacggtacccgtaaccgtactaacgtaaccgaaccgtaagtaccggactacgaacggtcgtacgacgtaacgccgacttacccggactaacccgggttacgaccggttaaccccgggaaccggtttaccggtacccgttttacgtttacccggtttacgggacccggttaaggtaacccgggttaccgggtacccctttaccgggtttaacgggtccccgggggtttaaaccccggtaacccggttacggggggtttaaccccggtttaagggtttaaccccggaccggggg

SEQ ID NO: 1681 - DNA, 824 bp, Homo sapiens
  misc_feature: GYAE6OF01EZ7QI.43.5.A05.1.454.CMB.1.raw
  modified_base (234)..(234): a, c, t, g, unknown or other
  misc_feature (234)..(234): n is a, c, g, or t
tcagtgtgagtagtcacgaccggtgctcgatttagatagatagacagggggagcatcacccagcaacacatctgtcctctagagaatcccctgagagctccgttcctcaccatggactggacctggaggatcctcttcttggtggcagcagccacaggagcccactcccaggtgccagctggtgcagtcgtggggctgaggtgaagagccgtcggggcctcgagtggaaggtcncctggacaagggtcttcgtggaactacctaccgttccgaccggtcttaacctatactaaccgacgttgggtcgacgacggaccggccccgtaggaccgaagggtcttagggtacggtagggtaggttacggggacggtaacgtaaccggaaaacccctaaacgtaacgttcggggttaccaccccgtaacgttccgtagttaccgtacgtaacccgtaacgttaaacgttaacccgtttaaccggaacgggtaaccgtaaccgggggttacccaaacccggtacgtaaccgggaacccgaaccgggggtaaaccccgtaacccgttaacccgaacgtaaacccgaaaaccgaccgtaacgggtacccgttaaacgtacggttaccggtaaccccgtaaggacccgacccgtaccggtaccccttaacggaaccggtacccgttacgaacccggtaccgggtaacccgggttcgttacgttttacgtttaccggtaggtacgggacccgtaacggttccgttaaccccggttgttccgggtaccgggtaccccggttaaggttacgggtttccgttaacggtaaccccggg

SEQ ID NO: 1682 - DNA, 615 bp, Homo sapiens
  misc_feature: GYAE6OF01BCJ7U.43.5.A05.1.454.CMB.1.raw
  modified_base (292)..(292): a, c, t, g, unknown or other
  misc_feature (292)..(292): n is a, c, g, or t
  modified_base (348)..(348): a, c, t, g, unknown or other
  misc_feature (348)..(348): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtcgcagcctggtgcagtcgtggggctgagggtgaagaagccgtggggcctcgagtgaacggtctcctgcaaggcttctggactacgtaccttcgaccggctactatactacacgtggngcgacacggccctggaacagggtcttgagtggagtgggacgtatacgaaccctaanaagtcggacgccactcgtgtatgacacgagtaaccttgacggactacgggtcaccagtacgaccgagggacctacgctactaccaacgacgacgactacgagtacggactagagaccgacgtaccctacgacgtaccgtaggaacccgacgtcgggtaccgttcgttaccgttcgtggttaccgacggtaacggtccgttacccgtaggttacggttaccgggaccccggtaaccgggtttacgggtcccgtttaaggtaacccggg

SEQ ID NO: 1683 - DNA, 656 bp, Homo sapiens
  misc_feature: GYAE6OF01AB44T.43.5.A05.1.454.CMB.1.raw
tcagtgtgagtagtcacgaccggtgctcgatttagatagatagacagggggagcatcacccagcaaccacatctgtcctctagagaatccctgagagctccgttcctcaccagtggactggacctggaggactccgtcttcttggtggcagcagaccaacgtaggaccgacccacgtacccagggtgacagcgtggtcgcaggtcgtggggctggaggtgaagacgccgtgggcctgagtgacggtctcgagtacacggtcttcgaggtactacctaccgttacgaccggttctaacttacgtactaccgacgtacgggtgtccgaacgccggaccgtaggaacgtacggtcttaggcgtagacggtacggggactacgttacgaaaccctaagtagtcgtaccgtccacggttcaaggttcacggtaccaaacggtacttaaccggtagtacggacggttaccgacgtactacggtaccgaacggacgtaacccgcacgtaacgtaccgaacgacgacggtactaacgtcgtacggcgtacgacgtgaccgtacgactacggctacggacgacgtacgtcgacttagtcgtagcggtaccgacgttccgtacgtacgtcgggttacccacggtacggttacgtcggtgtacccgg

SEQ ID NO: 1684 - DNA, 738 bp, Homo sapiens
  misc_feature: GYAE6OF01DX1IT.43.5.A05.1.454.CMB.1.raw
  modified_base (198)..(198): a, c, t, g, unknown or other
  misc_feature (198)..(198): n is a, c, g, or t
  modified_base (360)..(360): a, c, t, g, unknown or other
  misc_feature (360)..(360): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagcgtggtgcagtcgtggggcngaggtagaagacgccgtggggcctacgaggtaggaacggtcctccgtgacgtaacggtctttcgtacggtaactacccgtacctttaccggacccggtaccttaaccgttaatatacgtacgtgggtcgacgacggaccggtcccaggacgagggtctaggnggtaggagtggggacgtaacgtaccgtaaacccgtaagtacggttggtaccggaccttacgttcggttagtaacgtgtaacccacggtaaaccgttaacgtttaccggaagggaaccgtacggggttaacccaacgtaacggtaccggaaccggtaacggggaaccttaacccgtacgaaactacccgtaaacgacgtacgtaccaagtacggttaaccgtacgtagacgtcctaacggtcctaccgacggtaccacgggaacgtaccggtacgggttccttagttacctttcgtaggtcggaaccggtacggttccgttaccgttaggttccggtaccggaaccgtttagggtcgggttaacttcgggtaaaccggg

SEQ ID NO: 1685 - DNA, 711 bp, Homo sapiens
  misc_feature: GYAE6OF01A0TFI.43.5.A05.1.454.CMB.1.raw
  modified_base (198)..(198): a, c, t, g, unknown or other
  misc_feature (198)..(198): n is a, c, g, or t
  modified_base (385)..(385): a, c, t, g, unknown or other
  misc_feature (385)..(385): n is a, c, g, or t
tcagtgtgagtagtcacgaccggtgctcgatttagatagatagacagggggagcatcacccagcaaccacatctgtcctctagagaatcccctgagagctccgttcctcaccatggactggacctgggaggactcctctttcgttgggtggcagcagccacgacggacgcccactcccgagggtcgcagcgtgggtcncgaggtcgtggggctaggagggtagaacggaggccggtcggggtcctacgaggtaggaacggtcctcgtcgacgaaggtcttcgtaggaacttacctaccttcgaccggtctactatactacgtacggtgggtgaccgacggaccggtcccgtagggaaccggtaagggtcttaggaggtggacggnggggaacgtagtaacgaacccgtaacgagttcggtacgacccgtacgtacgtacgtaagtcgacgtacgtaacgttaacttaggaacggtaacggacggtaccaacgtacgtaacgaccggtaacgggtaacccgtaccgtaccgaacgtaacccgaaaccgacgtaccggaactacggtacgtacggtcagtcgaacgtaccgaccgtaccgaccgtaccttggaacccgcggtaccggtactcgttacttcgtaggtcggacggtcgttacgtaccgttaggtccgttaccggtaccggtaggttacggtaggttcgtaccggg

SEQ ID NO: 1686 - DNA, 754 bp, Homo sapiens
  misc_feature: GYAE6OF01C3BBH.43.5.A05.1.454.CMB.1.raw
tcagtgtgagtagtcacgaccggtgctcgatttagatagatagacgagggggagcatcacccagcaaccacatctgtcctctagagaatcccctgagagctccgttcctcaccagtggactggacctgggagactccttctttcgttgggtggacgacgcacggccacgaggacgcccctaccgtcccgaggtcgcgacggtccgttgggtacgcgtacggtcggtcggggcttaggaacgggtaggaaacggaacggtccggtcgggggtcctacggtaggttacggtaacggttcctccgtcggacgtaacgggtctttacgtaggtactacctaccgttaccgaccggtacttacgttaatactaacgcgggtcggtacgccggacgtaccgggcccgtagggaacgtaacgggtcgttgggaggtacggacggacgggtaacggacgttaaccgaaaacccgttaagtaggtccgggtaccgacccgttacgttacgtagttacacgacgtaacgtaacggttaaaccgttccggaagtaccgggtacggtacctaccgacgtaacggacgacggaacctacgacgtacgaccacgacgacgacgtacgacggtacgacgtacgcggtacacgtcgacgtacgacgacggacgccggtacggtccttacgttcgttgtacgggtcgacggtaccgtcgttaccgtaggttccggtacgtaccggttagggtacggtcgttcggtaccggg

SEQ ID NO: 1687 - DNA, 682 bp, Homo sapiens
  misc_feature: GYAE6OF01BI8AE.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagcacgaggacgcccactcccaggtgcagctggtgcagtcgtggggctggaggtgaagaacgccgtggggcctcagtgaacggtctccgtgcaaggtcttctggactaccaccttccgaccggtctaacgtatacgtacacgtgggtcgcgacgacggcccgtggacgaacgggtcttggaggtaggagtaggggaccgtagtaccgtaaacccgtaacgtaaacggtcgggtacctaccgtaaccgttacgttacgtacgttcgaccgaacgtaagttaaccgtttacgaaacgggtaccgtaacggggttacccaaccgacgttaacggaacccgtaacgggacccgaaccgttaccaacgtaccgaaccgaacggaacggtactaacgacgtacggaccgagtacgccgacgtcctacgacgaccgtaccgaaccgtacggacccggtcgtacgttacgttcgtaggtccgtacgacggtacgtacccgtgtacggtccggaccgtaggttcggtacgttcgtaacggg

SEQ ID NO: 1688 - DNA, 610 bp, Homo sapiens
  misc_feature: GYAE6OF01DW75Z.43.5.A05.1.454.CMB.1.raw
  modified_base (187)..(187): a, c, t, g, unknown or other
  misc_feature (187)..(187): n is a, c, g, or t
  modified_base (222)..(222): a, c, t, g, unknown or other
  misc_feature (222)..(222): n is a, c, g, or t
  modified_base (235)..(235): a, c, t, g, unknown or other
  misc_feature (235)..(235): n is a, c, g, or t
  modified_base (393)..(393): a, c, t, g, unknown or other
  misc_feature (393)..(393): n is a, c, g, or t
  modified_base (491)..(491): a, c, t, g, unknown or other
  misc_feature (491)..(491): n is a, c, g, or t
  modified_base (510)..(510): a, c, t, g, unknown or other
  misc_feature (510)..(510): n is a, c, g, or t
  modified_base (524)..(524): a, c, t, g, unknown or other
  misc_feature (524)..(524): n is a, c, g, or t
  modified_base (544)..(544): a, c, t, g, unknown or other
  misc_feature (544)..(544): n is a, c, g, or t
  modified_base (551)..(551): a, c, t, g, unknown or other
  misc_feature (551)..(551): n is a, c, g, or t
  modified_base (563)..(563): a, c, t, g, unknown or other
  misc_feature (563)..(563): n is a, c, g, or t
tcagtgtgagtagtcacgaccggtgctcgatttagatagatagacgagggggagcatcacccagcaaccacatctgtcctctagagaatcccctgagagctccgttacctcaccatggactggacctggagatcctcttctggtggcagcagccagaggacgcccactcccaggtgcaggctggacncgagtcgtgggctggaggtgaagagcgtgggcctnagtgaggtctcgnggcaggtctcgagactacctcctcgaccgtctaactatactacgacgttggggtcgaccgtacgaccgggtcccgtacgggaacggaacgggttggttaacggtagggtaggtacggtggggtaacctaagtaccgaaaacctacgaagtcgggtacnccgtaacgtgtacgtagaccgtacacgacgttaacgttacggaacggtacggtacgactaacgtcgaaccggtacggacgggtaacaccgtccgtaanaaccggacacgacgactanagtacgatacgacncacgcacgataccgcgaacngaccgtntcctagtcgcgnggaagctcgtccgttaggcgtaccggtaccgtagcggtatcgtaggg

SEQ ID NO: 1689 - DNA, 726 bp, Homo sapiens
  misc_feature: GYAE6OF01EBJJ2.43.5.A05.1.454.CMB.1.raw
tcagtgtgagtagtcacgaccggtgctcgatttagatagatagacgagggggagcatcacccagcaaccacatctgtcctctagagaatcccctgagagctccgttcctcaccatggactggacctggaggactcctcttcgttggtggcagcagcccacaggacgcccctactccccagggtgcagcttggtcgcaggtcgtggggctggaggtagaaggagccggtggggcctcgaggtggaacggtctccgtggactaagtcttacgtggtaactacctaccgttaccgacccggtcttaaccttaatactaacgacggttgggtcgcgaccggaccggcccgtacgggaacgtaacgggtcgttaggacggtggtacggtcgggaacgtagtaccgtaaacccgtaaagtagtcggtctacccgtactcgtatacgtacgtacgtaactacgttaacttacggacggtaccggtacggtaccacgtacgtaccggaacgggaacgggtaaccccgaccgtaaccaacgtacccaacgacggtaaccgactacggacgtaccggtacgtgaacgccgacgtaccctaggaacccgtacgaccggtaaccgaccggtaccgtcggttactttcggttacgtcggtcggtataacggtccgtaaccgttgtaccggggtaccggtacccggttaagggttccgggttagttacccggtaccgggg

SEQ ID NO: 1690 - DNA, 924 bp, Homo sapiens
  misc_feature: GYAE6OF01A0W2B.43.5.A05.1.454.CMB.1.raw
  modified_base (907)..(907): a, c, t, g, unknown or other
  misc_feature (907)..(907): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccaggtcctaattcccaggctgtggtgactcgaggtacgccctcactcgacgttggtccgtacccgagggacgggtacacgtacaccgtcctccgccgttttgcgggcctccgacgacctacgtacgggtaaccttcgtacctaacccggtaggttacggtaccttaacgtttaccttaccccgtttaccggttcgggttaccaacggtacgtaacggaaccgtccggtacccgggaccccgacccggggacccccccggacttaccgtaacgtttaagtttaccgtaacgtaacttaacgaaacctaaccgtaaacctttaaccgttaccgtaccgtacgtacccgtacgtaccccgtacttaccgtaccgtaccgtcccgttccccggttacgggtacggggtaacctaaccggccgttacccggttcccgtacccgggtttaccccggttaggggtcccgtaccggacgttacggtacccgtaaggggcgtaccgggttacggacggtacgttaacgttaaaccggtttaactcgtttacccggttcgtaccggttacccgttaccgttacgtacgggttaacggtccgttaaccccgggttccggggttttaacgggtttccgggggttaacgggaaccggtaacggggtttacccgttcggtaacccgtaccgttacgggtccccgtaagaccccggttacgtccggttcccgtacccccggtcgggtacccctacgttacccttccccttacccccgttacccgacccgtttcccncccgttaaccgtacccg

SEQ ID NO: 1691 - DNA, 820 bp, Homo sapiens
  misc_feature: GYAE6OF01BJFOO.43.5.A05.1.454.CMB.1.raw
tcagtgtgagtagtcacgaccggtgctcgatttagatagatagacgagggggagcatcacccagcaaaccacatctgtcctctagagaactcccctgagacgctccgttcctcaccagtggactcggacctgggaggactccttctttcgttgggtggcagcagccacgaggacgcccactcccgaggtgcgagcgtggtcgacgtaggtcgtggggctggaggtaggaacgacggtccggtcgggtcctacgtaggttacggtacggttcctccgtaggaccgtaacgggttctttacggtaggtaactaacccgttacccgttaccgaaccggttacctaacgtttaactaacgtaaccttacgggtcgggggtacgtaccgaaccggtacccggtccccgtaacgggaacggtacgggtacgttggtacgggtggacgggtacgggacgtaataaccggtaaacccgtaacgtaaggttcggtaccgacctaccgtcgtagtacgtacgacctaacgttaacggtaacgttacgggaacggtaccggtaacgggtaccgaaccgtaacgtaccgggtaaaccggacgggtaaacctaccgtcctaaacgaacctaacgaaccggtaacggtcctaacggtacgtaccggtacgaacgtacaccggtccaccgtaccggacggtaacccgtacggtaacggacccgggttcggtaccgttacgtttaggtaccggttgtaccggaccgtaccggttaacgttccggtacggttccgggtaaccgtaccgttagggttcccggtacgttggtacccggg

SEQ ID NO: 1692 - DNA, 829 bp, Homo sapiens
  misc_feature: GYAE6OF01B9HUO.43.5.A05.1.454.CMB.1.raw
tcagtgtgagtagtcacgaccggtgctcgatttagatagatagacagggggagcatcacccagcaaccacatctgtcctctagagaactcccctgagagcctccgttcctcaccagtggactggacctgggaggtatccttcttcgttggtggcagcagccacgaggacgccccactcccgaggtcgcgagtcgtgggtcgcgtaggtcggtggggtctagggagggtaggaaacggaacggccggtacgggggtccctagtaggtacggtaacggttcctaccgtacggacgtaacggtcgttacggtaggtaaccttaccgtaccttaccgaccgtaccttaactaatacgtacgacgttagggcgaccgacgtaccggcccgtaggacgtaggtacgtgaggtagggaggtacggtacggtagtaccgaacctaagagtcggtacgaccgtaagttcgtagtacgtacgaacctaacgtaacgttaacgttcggaacggtaacggtacggtaccaagtacgaacggaaccggtacggaacccgtaaccgtaaccgtaaccgttaaaccgaaccgtacggaaccggtacctaacgtacggtaaccgacgttaacgaaccggtcgaaccgggtaccctaaccggtaaccgtaaccggtacccggtaaaccgggaccggtaaccgggttacgtttaaccgttaccgtttggtaccgggttacgtaccgggaacgttcccggttaccggttaacgggttacccgggttacccggggtaacccggttaaggtttacccggggttaaccggttcgggttaaacccccggggg

SEQ ID NO: 1693 - DNA, 851 bp, Homo sapiens
  misc_feature: GYAE6OF01B3A9L.43.5.A05.1.454.CMB.1.raw
tcagtgtgagtagtcacgaccggtgctcgatttagatagatagacgagggggagcatcacccagcaaccacatctgtcctctagagaatcccctgagagctccgttcctcaccatggactggacctggaggtactcctcttcgttgggtggcagcacgccacgacggacgccccactcccgaggtcgcagcgtggtcgctaggtcggtgggcgtggaggtagaagacgccggtcgggctcgagtagacgtcctcgtgacgtacgtctacgtacgtaactaccgtaccgtaccgtaccgttactactaactacgtacgtacggtcggacgaccggtaccggtacccgggtaccggtacgggtaacggtacgggttacggtagggtacgggtagggtacgggtacggggtaaccggtaaccgtaaacccggtaaaaccgtaacggtacggtacggtaccgtacccgtacgttacgttacgtacgtacgaactaaccgtaacgttaaccgtaacggaacggtaccggtaccggtaacctaccggtaacgtaaccgggaaccggtaaccggtaaccccgtaaccgtaaccgtaacgtaacccgaaccgtaaccggtaccgtaaccgttaacggtaccggtaaccgtaccggtaacgacggtacccgtaaccgtacccggtaccggtaacccggttaccggtaaccggaccggtaccggtacgggttaccttacgttacggttacggtaccggtacggtaccggttaccggttccggttacccggttacgggttacccgggtaaccggttaccgggttaaccgggtttccgggttaccggttaacgggtacccggg

SEQ ID NO: 1694 - DNA, 599 bp, Homo sapiens
  misc_feature: GYAE6OF01BW3FL.43.5.A05.1.454.CMB.1.raw
  modified_base (463)..(463): a, c, t, g, unknown or other
  misc_feature (463)..(463): n is a, c, g, or t
  modified_base (486)..(486): a, c, t, g, unknown or other
  misc_feature (486)..(486): n is a, c, g, or t
  modified_base (491)..(491): a, c, t, g, unknown or other
  misc_feature (491)..(491): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagaacgccgtggggcctcgaggtagaacggtcctcgtgcgaaggtcttcgtggactacctacccttacgaccggtacttactatactactacggtgggtcgccgaacgcggcccgtaggacgaagggtcttggaggtggagtgggacgagtacgaaccctaagtacgtggacacctcgttagtagtatcgacgacgagtaacgttcaacggtcacgggtaccacgagtacgacggacggacacgtaccactacaacncgtaacgctaacgagtacggacnggacncgtacgtccacgagtaccgtaggaccgacggtacgtcgtcgttagttcgtgcgagtacggtccgtacgtggttccggtccggacgttacggcgggttactggtaccgg

SEQ ID NO: 1695 - DNA, 786 bp, Homo sapiens
  misc_feature: GYAE6OF01DIAYB.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcacctatggactggactggaggatcctcttcttggtggcagcagccacgacggacgccccactcccgagggtcgcagcgttggtgcgtaggtcgtgggggctaggagggtaggaagacggtccggtcgggggcctcgaggtggaacggtcctccgtgacgaggtcttcgtaggtactacctaccttccaccggtctaacttatactactccggtagggtcgtaccggacgaccgggcccgtggaaccggtaacgggtcgttacggagggttgggacggtacggggaaccggtaactaaccggaaacccgttaaacgaacggttcgggtacgtacccttacgttacgttaggttaacgtcggtaacccgaacgtttaacggttaaccgtttaccggaaacggggtaaccggttaaccggggtacctaaccggtacggtaaccggaaccgggtaacccggggtaaccgtacccgttaaccgaaccgttaacccgaaacggtaaccggtaacggtaccctaacggtaacggtacccggtacgacggtacgacgtaccgtacccgtacgtaccgtaaccgtcgaacgggtaccggtcggtaccgttcgttcttacggtcgtacggacgtagtcgtccgttaggtcggtacggtacgtaaggtacgtagggtttcgtaccggg

SEQ ID NO: 1696 - DNA, 723 bp, Homo sapiens
  misc_feature: GYAE6OF01CDSBZ.43.5.A05.1.454.CMB.1.raw
  modified_base (368)..(368): a, c, t, g, unknown or other
  misc_feature (368)..(368): n is a, c, g, or t
  modified_base (383)..(383): a, c, t, g, unknown or other
  misc_feature (383)..(383): n is a, c, g, or t
  modified_base (539)..(539): a, c, t, g, unknown or other
  misc_feature (539)..(539): n is a, c, g, or t
tcagtgtgagtagtcacgaccggtgctcgatttagatagatagacgagggggagcatcacccagcaaccacatctgtcctctagagaactcccctgagagccttccgttcctcaccatggactggacctggaggtatcctcttcttggtggcagcacgccacaggacgccccacctacccgaggtgccagccttggtagccgtaggtcgtcggggctggaacggtagaaacgaaggccgtggggcctgaggtcgaagggtcctacgcgacgaaggtcttcgaggtactaactaccttcgaccggtccttaactataacgtactaacggtggtacgacggacgaacggtccccgtagaacgaacgggtnttgaggtaggtacgnggggtaacgataacgaacccgtaagaagtgggtcacctaactcgtagtagtcgacgaactaacgttaacgtttaaccgaaggtaccggtaacggggttcccaaactacggtaacgaaccggtaaccgggacgaacccgttacaaccgtaccaaacncgaacgactaaacgtacgacgtaccgaggactaccgacgtaccctacgaacgtaccgtacgggaaccaccgggacggtcgtttaccgttaagtttacgttgggtacgagggtaccgtcgtaccccttagggttacggttaccgggacccgtaaacgggttcgggttaccgttgggttaaacccg

SEQ ID NO: 1697 - DNA, 753 bp, Homo sapiens
  misc_feature: GYAE6OF01DTTJV.43.5.A05.1.454.CMB.1.raw
  modified_base (155)..(155): a, c, t, g, unknown or other
  misc_feature (155)..(155): n is a, c, g, or t
  modified_base (200)..(200): a, c, t, g, unknown or other
  misc_feature (200)..(200): n is a, c, g, or t
  modified_base (367)..(367): a, c, t, g, unknown or other
  misc_feature (367)..(367): n is a, c, g, or t
tcagtgtgagtagtcacgaccggtgctcgatttagatagatagacagggggagcatcacccagcaaccacatctgtcctctagagaatcccctgagagctccgttcctcaccatggactggactggaggatcctcttcttggtggcagcagccanaggacgcccactcccgaggtgcagctggtgccaggtcgtggggcnggagggtagaaggaacgccgtggggcctcaggtgaacggtctcgtggacaggcttcgtggaactccgtaccttcgacccggcttaactatatacacgttgggtcgacgtacgacggcccgtaggacgagggtcttggagtaggagcgggacgtataccgaaacctanaacgttggcgtacctacgtgtagttagcgaccgtacgtacgtaaacgtttccggaaaggtaaccgtacgggtacctaaccgaggttaaccgacccggtaacggggaaccctaccgttaacccaataaccccgaacgtacgtaacggtaccgtaaccgaacggttccgaaaccgtcggtaacgacccgttaacgcccgtaacgtaaccgttcccggtaacggtaacccggacccgtaaccgggttcgttaacccgtttcgttttaccggtacggtcggtaacggggtacctaacccggtttacccgtttaacgggttaccgggttaacccgggaacccccgttaggggtttaaccccgggggtaccttttccgggggtaaaccccgg

SEQ ID NO: 1698 - DNA, 964 bp, Homo sapiens
  misc_feature: GYAE6OF01BEI8T.43.5.A05.1.454.CMB.1.raw
  modified_base (794)..(794): a, c, t, g, unknown or other
  misc_feature (794)..(794): n is a, c, g, or t
tcagtgtgagtagtcacgaccggtgctcgatttagatagatagacagggtctggcaccaggggtcccttccaatatcagcaccatggcctggactcctctctttctgttcctcctctacgttgctcgcccgtagggtcctaacttcccgaggtcttggtgggtcgacctacgaagggccgcccctactacgttagaccgttcgttaccggtaccccgaaggggagggtaactacggtaccctaaccttccttacccgtaccggttggtccggtaccctacccgaagtcccaacgttacggaaaccttcgtaccgaaccgttacggtacggtaccttaactttaccttaccccggttaccgtttacgggttaaccaacgtacggaaacggaccggtccggtccggacccggaccccgggaacccccgtacgaacgttaccgttaatttaccggtaactaaccgtaaacgtaaaccgtaacccttaaaaccgtttaaaacccccgttttccgggtaaccggaaaccccgttcccgtaaccccggttaccgttaaaccgtttccctacccggtacccggggttaccccttaccccgggttaaccgggggttaacggggaacctaaccgggcccgtttccgggtaacccccgtttacccgggtttccccgggtttacgggcgtacccggaaccgtacggttacccgggtaagggtaaccggtaacggtagtaacggggtaccttaacggttaacgttaacgttaccgtacgttaccgtgtacccgtacgtactcggtntacgtcgttacggttcggttacggttcggtacggggaccggtaccggtaacgttaccgggtccgtaaccggtccgtacgtaccgacgtacccggaacggtcccgtacccggttccaccggttccgtaaccgttccgttaccccgtccctacccttccgtaaaccgtaccg

SEQ ID NO: 1699 - DNA, 874 bp, Homo sapiens
  misc_feature: GYAE6OF01DQ1Z4.43.5.A05.1.454.CMB.1.raw
  modified_base (724)..(724): a, c, t, g, unknown or other
  misc_feature (724)..(724): n is a, c, g, or t
tcagtgtgagtagtcacgaccggtgctcgatttagatagatagacgagggggagcatcacccagcaaccacatctgtcctctaagagaactcccctgagacgtccttcccgtttcctccaccagtcggtacgtacggaccgtggggacggtctttcccttctttcggttggtagggccaaggccgaacgccccaacgaaggggacccgaccccctaaccgttccccgaagggtccgccgaacgggtcgttgggtacggccgttacgggtcgggttcgggggacttagggaacggggttaacggaaacggaaccggggtccgggttaccgggggtaccgttacggtaagggtacggtaaacggtttcccgcgttacggaaccggttaaacgggtcctttacgggtaacgtaacttaacccgttaccccgtaccggtaacccggttaccttaaaacgttacttaaaccgttaccggttaacgggttacgggggttaccaaccggtaaccggacccggttaccccgggttaacgggaaacggtagggttacgtttagggaggacggggtaggttacggggaacagtacccgaaaactaagtacgtcggtacaccttaactcgtagaccgtaatacgtaacgtacttaaccgtgggaaactccggacgtaccgactacggtacgacggaacggccgtaaccgtacactaacgactacgacgtacgtanacgcggtacagacggacacctccaacggtacctaccgtacgaccgagggtaaccgttcttacggttacttagggtccgtacgtacggtaactcggttacgtacggttaccgggtaccggtacgacggtttcggtaccggttacgtacggg

SEQ ID NO: 1700 - DNA, 771 bp, Homo sapiens
  misc_feature: GYAE6OF01AZC7J.43.5.A05.1.454.CMB.1.raw
  modified_base (169)..(169): a, c, t, g, unknown or other
  misc_feature (169)..(169): n is a, c, g, or t
  modified_base (182)..(182): a, c, t, g, unknown or other
  misc_feature (182)..(182): n is a, c, g, or t
  modified_base (193)..(193): a, c, t, g, unknown or other
  misc_feature (193)..(193): n is a, c, g, or t
  modified_base (426)..(426): a, c, t, g, unknown or other
  misc_feature (426)..(426): n is a, c, g, or t
tcagtgtgagtagtcacgaccggtgctcgatttagatagatagacagggggaggcatcacccagcaaccacatctgtcctctagagaactccctgagacgctccgttcctcaccatggactcggacctggaggactcctctttcgttggtggcagcacgccacaggacncccactccaggtncagcgtgtgcngtcgtgggctggagtgaagacgccgtgggctgagtgacgtctcgtgacgtaagtcttcgagtactactccgtacgaccgtactacgtactactacgtacgtggcgtccgacggaccggtcccgtacgggaacgtacgggtacgttacggaacggtgggtacggtacggggaacgtacgttaaccggaaccctaaggtaacgtcggtaccgacgtaaccgttcgtacggttacncggtaaccgtacgtaaattacccggtttacggaacgggtaccgacggttaccgaacgtacgtaacggtacggaacggttaaccctaacggtaccaaacttaaccgaaccgtacgaacggttaccgaaagtaccggttaacggtaccctagggtaccgaacccacggtaaccgtaccgtaacggaccccggtttaaacggaaccgggaaccggttccgggttaacgttaccgttacggttacgttacggtaaccggtaccggttaacgggtacccttaccgggttagtttcccgggtaaccggttaccgggtttaacgttcgggttaccgtttcgtaaacccgggg

SEQ ID NO: 1701 - DNA, 504 bp, Homo sapiens
  misc_feature: GYAE6OF02FZJUS.43.5.A05.1.454.CMB.1.raw
  modified_base (450)..(450): a, c, t, g, unknown or other
  misc_feature (450)..(450): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaacctaacaatggtgccactctgtatgcacagaactttcaggacagggtcacatgaccagggacacgtccatcaacacaggctacatgacctgagcagcctcagacctgacgacacgggctctattcngtgcgagtagtccctagtcggttcgggaccctaacgtcggggtactttggaccg

SEQ ID NO: 1702 - DNA, 500 bp, Homo sapiens
  misc_feature: GYAE6OF02I6EO9.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaacctaacaatggtgccactctgtatgcacagaactttcaggacagggtcaccatgaccagggacacgtccatcaacacaggctacatgacctgagcagcctcagacctgacgacacgggctctattctgtgcgagagtccctagtcgttgggccctaacgtggggtacttggtaccg

SEQ ID NO: 1703 - DNA, 555 bp, Homo sapiens
  misc_feature: GYAE6OF02JRJA2.43.5.A05.1.454.CMB.1.raw
  modified_base (285)..(285): a, c, t, g, unknown or other
  misc_feature (285)..(285): n is a, c, g, or t
  modified_base (327)..(327): a, c, t, g, unknown or other
  misc_feature (327)..(327): n is a, c, g, or t
  modified_base (335)..(335): a, c, t, g, unknown or other
  misc_feature (335)..(335): n is a, c, g, or t
tcagtgtgagtagtcacgaccggtgctcgatttagatagatagacaggggctggcaccaggggtcccttccaatatcagcaccatggcatggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaacgcctggccacggccccccgganactcgatttactgatacaagcaacaaactttccagacacctncccgatcncagctcctcgtggggcaaagctcgccctgtacccttcgggtcgcgcgacgccgtggacggatggacggctgacttatactcgcgttgctcgcctatcgatcgtccgtcgttcgggtttcgcgggtacgggtaccgtaaggtcgtaccgtcgtacggtcacgacccgaaggtcctcgtccccgtcggtcctacttcctccgttcccaccctcctccgtacc

SEQ ID NO: 1704 - DNA, 513 bp, Homo sapiens
  misc_feature: GYAE6OF02I8UT5.43.5.A05.1.454.CMB.1.raw
  modified_base (329)..(329): a, c, t, g, unknown or other
  misc_feature (329)..(329): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacgatgaacctaanaatggtgccactctgtatgcacagaactttcaggacagggtcaccatgaccgagggacacgtccatcaacacaggctacatgacctggagcagcctacgacgacctgacgacacgggcgtctattcgtgtcgacgagtacgtccgtatcggttcggaccctaagtcggggtactttggtaaccg

SEQ ID NO: 1705 - DNA, 531 bp, Homo sapiens
  misc_feature: GYAE6OF02GUHYW.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatggggacggatcgaacctaacaatggtgccactctgtatgcacagaactttcaggacagggtcaccatgaccagggacacgtccatcaacacaggctacgatcggacctgacgcacgccctcgacgacctcgaaccgacgacgggcgtacctatttcgtggtcgcgagtacgttccctagttcggttcgggccctaacggtcggggtactttggtaccgg

SEQ ID NO: 1706 - DNA, 593 bp, Homo sapiens
  misc_feature: GYAE6OF02GIJGV.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatcgaaccctaacaatggtgccactctgtatgcacagaactttcaggacagggtcacatcgacagggacacgtcatcaacacaggctacatcggacctgacgacacgccctcgaacgacccgtagaaccgaccgaaccgggggtccgttaccgttacgttttccgtaggttcgggaccggtaacggtaccggttacccccgtttaagttccgggtttacggggaccccccgtaaacgggtttcggggggttaaccttttcgggtaaaccccggg

SEQ ID NO: 1707 - DNA, 508 bp, Homo sapiens
  misc_feature: GYAE6OF02HSHV7.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaaccctaacaatggtgccactctgtatgcacagaactttcaggacagggtcacatgacagggacacgtcatcaacacagctacatggactgagcacgcctcacgacctcgaacgacgacgggcgtctactttctgtcgcgagtcgtaccctgtcggttcgggccctacgtcggggtacttgtaacg

SEQ ID NO: 1708 - DNA, 508 bp, Homo sapiens
  misc_feature: GYAE6OF02IOUPB.43.5.A05.1.454.CMB.1.raw
  modified_base (331)..(331): a, c, t, g, unknown or other
  misc_feature (331)..(331): n is a, c, g, or t
tcagtgtgagtagtcacgaccggtgctcgatttagatagatagacaggggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacgatgaaccctaanaatggtgccactctgtatgcacagaacttcaggacagggtcacatgacagggacacgtcatcaacacaggactacatcgactgagcagcctcacgacctcgacgacgacgggtcgtactattcgtggtcgacgagtacgtccctagtcgttcggacctaacggtcgggtacttgacg

SEQ ID NO: 1709 - DNA, 522 bp, Homo sapiens
  misc_feature: GYAE6OF02H2XZB.43.5.A05.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (339)..(339): a, c, t, g, unknown or other
  misc_feature (339)..(339): n is a, c, g, or t
  modified_base (354)..(354): a, c, t, g, unknown or other
  misc_feature (354)..(354): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatgggacggatgaaccctaanaagtggtnccactctgtatgcanagaactttcgaggacagggtcaccatgaccgaggacacgtccatcaacacaggctacatcgactgagcacgcctcacgacctgaaccgacgaccgggctacttatttcgtggtgcgtagacgttaccctagtcggttcgggccctaacggtgggtactttgtaaccgg

SEQ ID NO: 1710 - DNA, 569 bp, Homo sapiens
  misc_feature: GYAE6OF02GHWV2.43.5.A05.1.454.CMB.1.raw
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (380)..(380): a, c, t, g, unknown or other
  misc_feature (380)..(380): n is a, c, g, or t
  modified_base (394)..(394): a, c, t, g, unknown or other
  misc_feature (394)..(394): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccacggccccccggacactgatttangatacaagcaacaactttccnggacacctgcccgattctcaggcctccctccgttgggggcaaagctcgccctgaccctttcgggngcgcacgctgaggntgaggctgactattactgcttgcctcgtcctatgatcggccgtcgttcggggttttcggcgggtacgggtacccgtaaggttcgaccggttccgtagggtccacggcccgaaggcctccggcccccgtcggtcccacgttccgtccgttccccacccttccctaccaccttaccc

SEQ ID NO: 1711 - DNA, 515 bp, Homo sapiens
  misc_feature: GYAE6OF02HEHWJ.43.5.A05.1.454.CMB.1.raw
  modified_base (331)..(331): a, c, t, g, unknown or other
  misc_feature (331)..(331): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaaccctaanaatggtgccactctgtatgcacagaactttcaggacagggtcaccatgacagggacacgtcatcaacacaggctacatgacctgagcagcctacgagacctgacgacgacgggcgtctactttctggtcgcgtagacgtcccgtagtcggttacgggaccctaggtacgggtactttggtaccg

SEQ ID NO: 1712 - DNA, 581 bp, Homo sapiens
  misc_feature: GYAE6OF02IX66Y.43.5.A05.1.454.CMB.1.raw
  modified_base (393)..(393): a, c, t, g, unknown or other
  misc_feature (393)..(393): n is a, c, g, or t
  modified_base (407)..(407): a, c, t, g, unknown or other
  misc_feature (407)..(407): n is a, c, g, or t
  modified_base (426)..(426): a, c, t, g, unknown or other
  misc_feature (426)..(426): n is a, c, g, or t
tcagtgtgagtagtcacgaccggtgctcgatttagatagatagacagggggacgtggcaccaggggtcccttccaatatcagcaccatggaccctggactcctctctttctgttcctcctcacttgctgcccagggtccaattcccaggctgtggtgactcaggagccctcactgactgtgtccccaggagggacagtcactctccacctgtggctccagcactggaactgtcaccagtggtcattatcccctactaggttccaagtcgagaacgccctggccacggccccccggacactgtactttatgatacaagcaacaactttcctggacacctgaccgattctcaggctcctcgttggggctaaggctcgcctgaccctttcgggtcncgcacgcctgagtntgaggctgacttatacgtncttagtctgcctagtgactgtccgattccggggtttcggccggtagggtacccgagttcggaccggttccgtaggtccgtagacccaaggtcctaggtccccgtggtacctacggttccttacgttccccggtccctaccgttccctattacccg

SEQ ID NO: 1713 - DNA, 511 bp, Homo sapiens
  misc_feature: GYAE6OF02HQ1AO.43.5.A05.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
  modified_base (424)..(424): a, c, t, g, unknown or other
  misc_feature (424)..(424): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatgggacggatgaaccctaanaatggtgccactctgtatgcacagaactttcaaggacagggtcacatgacagggacacgtcatcaacacaggcacagtgacctgagcagcctnacgacctagacgacacgggctctacttctgtgcgtagcgtccctagttcggttcgggaccctaacggtcggggtactttggtaaccg

SEQ ID NO: 1714 - DNA, 504 bp, Homo sapiens
  misc_feature: GYAE6OF02G4RB5.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaaccctaacaatggtgccactctgtatgcacagaactttcaggacagggtcaccatgaccagggacacgtcatcaacacaggctacagtggacctgacgcacgcctcacgacctgaccgacacgggctctatttctgtgcgagcgtcctagtcgttcgggacccaggtcgggtacttgtacg

SEQ ID NO: 1715 - DNA, 549 bp, Homo sapiens
  misc_feature: GYAE6OF02IAA47.43.5.A05.1.454.CMB.1.raw
  modified_base (337)..(337): a, c, t, g, unknown or other
  misc_feature (337)..(337): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctcctgcaaggcttctggatacaccttcaccggctactatatacactgggtgcgacaggcccctggacaagggcttgagtgagtgggacggatgaacctaacaatggngccactctgtatgcacagaactttcagggtacagggtcaccatcgaccgagggacacgtaccatacaacacaggctaacagtcggacctgacgcaacgcctacgacgtacccgtgaaccgacgtaaccgggcgtacttattcgtgtcggacgtaggtacgttcccttagttcggttccgggaccctaacggttcgggtactttggtaaccgg

SEQ ID NO: 1716 - DNA, 733 bp, Homo sapiens
  misc_feature: GYAE6OF02IT2HJ.43.5.A05.1.454.CMB.1.raw
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattactccctactggttccagcagaacgccctggcccacgggcccccccggacacctggttaatttagagtaactaacgaacgaaccaaacttaaacctttccgacggaaccctaccgtccggaccgttacttccgtacgacggtcccttcccgtcggggtcggggaacaaacgtcgtccgtccgtaccgtttacccggttgggccgcgccgtacgtccgtaggaacggtagtagggacgtcgacgttaactaacttcgtacgtcgttacgcgttccgtacgttagtacgtcgtacccggccggttccggggttttaccggggtttcggggaccgggtaaccgggtaacgttaacggttaccgtacccggttaaccggtacggtacgtacccggaaccggtaacggtccgttacccggtcccccggttagacccgttaccttcccggttccccgtttccccgtccccctttacccgttacccttaaccttaacccg

SEQ ID NO: 1717 - DNA, 507 bp, Homo sapiens
  misc_feature: GYAE6OF02HSZ6W.43.5.A05.1.454.CMB.1.raw
  modified_base (280)..(280): a, c, t, g, unknown or other
  misc_feature (280)..(280): n is a, c, g, or t
  modified_base (331)..(331): a, c, t, g, unknown or other
  misc_feature (331)..(331): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatgggacggatgaaccctaanaatggtgccactctgtatgcacagaactttcaggacagggtcaccatgaccagggacacgtccatcaacacaggctacatggacctgagcagcctcagacctgaccgacacgggcgtctatttctgtgcgagacgtccctagtcgttcgggccctaagtcggggactttgtaaccg

SEQ ID NO: 1718 - DNA, 508 bp, Homo sapiens
  misc_feature: GYAE6OF02IS5EW.43.5.A05.1.454.CMB.1.raw
  modified_base (333)..(333): a, c, t, g, unknown or other
  misc_feature (333)..(333): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacgaagggcttgagtggagtgggacggatgaacctaanaatggtgccactctgtatgcacagtaactttcaggacagggtcacgatgacagggacacgtcatacaacacagctacatgactgagcagcctcgacgacctagacgacgacgggctacgttattctggtgcgagtacgtccctagtcggtcggccctaggtcgggtacttgtacg

SEQ ID NO: 1719 - DNA, 504 bp, Homo sapiens
  misc_feature: GYAE6OF02JBPB5.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttgagtggatgggacggatgaacctaacaatggtgccactctgtatgcacagaactttcaggacagggtcaccatgaccagggacacgtccatcaacacagctacatgacctgagcagcctcagacctgacgacacgggcgtctatttctgtgcgagtacgtccctagtgttcgggccctaagtcgggtactttggtaaccg

SEQ ID NO: 1720 - DNA, 544 bp, Homo sapiens
  misc_feature: GYAE6OF02IDJQI.43.5.A05.1.454.CMB.1.raw
  modified_base (343)..(343): a, c, t, g, unknown or other
  misc_feature (343)..(343): n is a, c, g, or t
  modified_base (359)..(359): a, c, t, g, unknown or other
  misc_feature (359)..(359): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagcctggggcctcagtgaaggtctcctgcaaggcttctggatacaccttcaccggctactatatacacgtggtgcgacacggcccctggacgaggctgagtggagtgggacgatacgaacctaacgaagtggtcnccactctgtatgacanacgtactttcgaggactacgggtacacgagtcgacgaggactacgtcataccaacacgagctacgatcggacctagacgcacgtcctacgacgacctagaccgacgacgggtcgttacttactttcgtgtcggacgtacgtacgttcctagttcggtcggacctacggtcgggtacttggtaccg

SEQ ID NO: 1721 - DNA, 573 bp, Homo sapiens
  misc_feature: GYAE6OF02IRYQZ.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagcctggggcctcgagtgaaggtctcctgcaaggcttctggatacaccttcaccgctactatatacactgggtgcgacaggcccctggacaagggcttggagtggatgggacgatagaaaccctaagaagtggtacgccactcgtagtatgcacagtaactttcaaggacagggtcaccatcgaccgagggaccacgtccataccaacacaggacctacagtcggaccctggacgcgacgtcctacgaacgaccgtagaaccgacggaaccgggtccttacgttacgttcgtcggtcggtacggacgtaaccgttccgtaagttcggtcgggacccgtaacgggttcgggtactttcggtaaccgg

SEQ ID NO: 1722 - DNA, 565 bp, Homo sapiens
  misc_feature: GYAE6OF02H3GG8.43.5.A05.1.454.CMB.1.raw
  modified_base (286)..(286): a, c, t, g, unknown or other
  misc_feature (286)..(286): n is a, c, g, or t
  modified_base (399)..(399): a, c, t, g, unknown or other
  misc_feature (399)..(399): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaagggcttctggatacaccttcaccggctactatatacactgggtgcgacnggccctggacaagggctgagtggatgggacggatcgaacctaacaatggtgccatctgtatgcacagaactttcaggaacgtagggtcaaccatacgaccagggacacgtcanacaacacaggctacgacgtcggactagacgtacagcctacgacgacctggaaccgaaccgacgggcgttaccgtacgttttctggtcggtagtaacggtaccggtacccgttagttcgggttacgggccctaaaccgggtcggggttaaccgtttggtaacccggg

SEQ ID NO: 1723 - DNA, 798 bp, Homo sapiens
  misc_feature: GYAE6OF02IPLON.43.5.A05.1.454.CMB.1.raw
tcagtgtgagtagtcacgaccggtgctcgatttagatagatagacagggggagcatcacccagcaaccacatctgtcctctagagaactccctgagagctccgttcctcaccatggactggacctggaggatcctcttcttggtggcagcagccacgaggacgcccacctcccgaggtcgcacgtcgtggtcgcacggtccgtgggggcctaggaggtgaaagacgccgtacggggcctcgagtcgaaggtcctccgtgacaaggtccttctaggactacctacccttacgacccggcttaactataactccaacgttgggtacgcgaccgtaccggtcccctaggaacgtaacggtcgttggagggtaggacggttaggggacgtaagaccggtaaacccgtaacaaggttcggggtaccacctacgttcgttaacgtacgtacgtacctaacgaacgtttaaaccgtttccgggaacgaccggttacgggtaccctaaccggtaaggtaccgaaccgggtaccggaacccgtaaccgtacctaaccggtaaccgaaaccgaaccgttaaaccgggtaccttaaacccggtagaccggtaaccggttacggaaacggtacctaccgtaccgtaccgaaccggtacccgttaaccgggaaccggtaaacccggtacccgggtactttaccggttacttccggtaacggtccggtaacgtaccgggtaaccgttccgttacggttacggttaccccgggacggttaccggtaagggttaccgttcccgttaacccgggg

SEQ ID NO: 1724 - DNA, 555 bp, Homo sapiens
  misc_feature: GYAE6OF02GBR1Z.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggaccaagggcttgagtggatgggacggatgaaccctaacaagtggtcgccactctgtatgacacagactttcaggacagggtcacatgaccgagggacacgtccactcaacacgagctacatcggacctgacgacacgccctacaacgtaccgtacgaccgaccggacgggtcgtccttacgtttccgtggtcggacggtacgtacgttccctagttcggttccggggaccctaacgggtcggggttaccttggtaacccgg

SEQ ID NO: 1725 - DNA, 516 bp, Homo sapiens
  misc_feature: GYAE6OF02IEXJX.43.5.A05.1.454.CMB.1.raw
  modified_base (280)..(280): a, c, t, g, unknown or other
  misc_feature (280)..(280): n is a, c, g, or t
  modified_base (452)..(452): a, c, t, g, unknown or other
  misc_feature (452)..(452): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtncgacaggcccctggacaagggcttgagtggatgggacggatgaacctaacaatggtgccactctgtatgcacagtaactttcgaggacagggtacacatcgaacgagggacacgtcatcaacacgaggctacatggacctggagcagcctcacgacctgacgacacgggctntactttctggtgcgagacgttccctagttcggttcggccctaacggtgggtacctttgtaccgg

SEQ ID NO: 1726 - DNA, 571 bp, Homo sapiens
  misc_feature: GYAE6OF02HENTQ.43.5.A05.1.454.CMB.1.raw
  modified_base (281)..(281): a, c, t, g, unknown or other
  misc_feature (281)..(281): n is a, c, g, or t
  modified_base (371)..(371): a, c, t, g, unknown or other
  misc_feature (371)..(371): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagcctggggcctcagtgaaggtctcctgcaggcttctggatacaccttcaccggctactatatacacgtgggtncgacacggcccctggaccaaggggcttggagtgggagtggggacggatacggaaccctaagaagtggtacgaccactcgtagtatgacanagtaactttcgaggacagggtccacgtatacgaccgagggacacgtacacacaacacgacggactaacagtacgacctagacgacacgcctacgacgtacctaggaccgacgacgggtcgttaccgttatttcgtgtcggcgacggtacgtacccttaggttcggttacgggaccctagggtacgggttacttcgtacgg

SEQ ID NO: 1727 - DNA, 744 bp, Homo sapiens
  misc_feature: GYAE6OF02IU46V.43.5.A05.1.454.CMB.1.raw
  modified_base (285)..(285): a, c, t, g, unknown or other
  misc_feature (285)..(285): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtgcagctggtgcagtctggggctgaggtgaagaagcctggggcctcgagtgaaggtctcctgacaaggcttcgtggatacgaccttcaccggctactatatacactgggtncgacacggccctggacgaaggcttgacgtggagtcggggacgagtacggaaaccctaaacgaagtcgggttagccgtaacttcgtaggttaactcggtaccgtaacgtaacggtaaccttttacggaacgggtaacgtaacggggttacccaaaccgtacgttaacggaacccggaagggggtacctaaccggttaccgtaaacgtaccaaaccgttaaccgacgggtaccttaacgaacggttacgggaacctaggaacgtaccgtaaccggacccttaacggaaccgtacccgttacggaaccggaaccggtaaccggggttacgttaccgttaaccgtttttcggtacgggtttacgggaaccgttaacgggtaaacccggttcccgttaaggttaccggggtttacccggacccggttaacggtttccgggggttacctttacggttaacccggg

SEQ ID NO: 1728 - DNA, 731 bp, Homo sapiens
  misc_feature: GYAE6OF02JSRNN.43.5.A05.1.454.CMB.1.raw
  modified_base (291)..(291): a, c, t, g, unknown or other
  misc_feature (291)..(291): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggtgaggtgaagaagccgtggggcctcgagtgaaggtctcctgcgaaggcttctggactaccaccttcgaccggtctaactatactacactggggtancgaacgacggccccgtaggaaccgaaaggggtcctttggaacggttgggaagtcggggaacggagttacggaaacccgtaaagaagtcggtacgaccctaactcgtaggttactcggacaacgtaacggtaaacttttcggaaaggaccgtaacggggttaccaaccgaagtaccggtaaacccggaacgggggtaacccaaccggttacccaacgttaaccgaaaccgaaccgtaacgggacctttaaaccgacgttaccgggtaaccctggaaacggtcgaaccggtaccttaccgaaccggtaaccgtacggaacccgaacggtaaccgggtacgtttacttaacgtttcgtagggtcgtacggtaacgtcggttaccctaaggttggttaccgggaccctaagggttcggggttaactttacggaccgttaacggg

SEQ ID NO: 1729 - DNA, 601 bp, Homo sapiens
  misc_feature: GYAE6OF02IFY07.43.5.A05.1.454.CMB.1.raw
  modified_base (281)..(281): a, c, t, g, unknown or other
  misc_feature (281)..(281): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggagatcctcttcttggtggcagcagccacaggagcccactcccaggtgcagcgtggtgcagtcgtggggctggaggtgaagagccgtgggcctcagtgaggtctcctgcaggcttcgtggatacaccttcaccggctactatatacacgtgggtncgacacggcccctaggacaggctgagtggatgggacgatacgaacctaagaagtcggtacgacctactcgtagtatcgcaacgaacgttaactttcgaagggaccgtacggggtaccaccgtaagtccggaaccgaacggggactaaccgtccgaactaccgaacacgaggtacctacgacgtcggacctagagccgacgccctacgacgtacctagaaccggacgccgggtacttcgttacgttcgtcggtcgacggagtaccgttccgtaggttcggttaccgggacccgttaacggtcgggtaccttaggtaaccgg

SEQ ID NO: 1730 - DNA, 558 bp, Homo sapiens
  misc_feature: GYAE6OF02GE3V6.43.5.A05.1.454.CMB.1.raw
  modified_base (332)..(332): a, c, t, g, unknown or other
  misc_feature (332)..(332): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacacggcccctggacaagggcttgagtggatgggacggatgaaccctaanaatggtgccactctagtatgcacagtaactttcgaggacgaggggtcaaccgatcgaaccgagggactacgtaccatacaacacgagactacatcgacctgacgcagcctacgacgacctgacgacgacgggtctacgttactttcgtgtcggacgtacggtacgttaccccgtagttacgggttcgggaccccgtaacggtcggggttaccttttggtaacccgg

SEQ ID NO: 1731 - DNA, 761 bp, Homo sapiens
  misc_feature: GYAE6OF02HQNUM.43.5.A05.1.454.CMB.1.raw
  modified_base (267)..(267): a, c, t, g, unknown or other
  misc_feature (267)..(267): n is a, c, g, or t
  modified_base (285)..(285): a, c, t, g, unknown or other
  misc_feature (285)..(285): n is a, c, g, or t
  modified_base (296)..(296): a, c, t, g, unknown or other
  misc_feature (296)..(296): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtcggctccagcactggaactgtcaccagtgtcattactccctactggttccagcagacgccnggccacggccccccgganactcgatttangactacaagacaactaaacctttccaggaccacctcgacccgtattccgtcgacggtccctccccgttccggttacgggggacctaaacggtctccggtaccccgttcggtaccccgttttcgggggtcgtccggtacgtacggtacccgtaggtaagggacgttacgggaacgggtccgttaacggtaacctttaacgtttacgtcggttaccgttacggtcccgttccgtacccgttaagtcgtaagttcccgggtcccgttccgggtttccgggggttttaccgggcggggacgggtaaccggttaaacggtttccggtaaacccggttccgttaacgggtaccgtaccgggtaacccgtaacgggtcccctccgggtacccccgttacgggttccctaccgttccccggtttcccggttcccccggtacccctttaccccgtacccgtacccgttaacccg

SEQ ID NO: 1732 - DNA, 627 bp, Homo sapiens
  misc_feature: GYAE6OF02HKTZS.43.5.A05.1.454.CMB.1.raw
  modified_base (344)..(344): a, c, t, g, unknown or other
  misc_feature (344)..(344): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtcgtccccgagggagggacagtcactctcacctgtggctccagcactggaactgtcaccagtggtcattactccctactcggttccagcagaacgcctggccgacggccccccggacactgtacttatgatacgaagacaactaacttccaggaccacctcgccgattcncgacgcctcctcggttggggacaacgctcgccctcgtacccgttcgggtgccgcacgccgtggacggtagtggacggtcgtacggtacttaagttacgtacgtcgttgtccgttcggtaccttagtgactcggccggttcgttcggggtttcggcgggtacgggtacgtacggttcgaccgttccgtaggtccgacgaccgtaacgggccgtaccggccccgtacggtccctacgttcccgttccgttaccccctacccgttacccgtcctacccgttacccg

SEQ ID NO: 1733 - DNA, 601 bp, Homo sapiens
  misc_feature: GYAE6OF02HJBIQ.43.5.A05.1.454.CMB.1.raw
  modified_base (286)..(286): a, c, t, g, unknown or other
  misc_feature (286)..(286): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcagtgaaggtctcctgcaaggcttctggatacaccttcaccggctactatatacacgtggtgcgacncggcccctggacaagggcttggagtggagtgggacggagtacgaaaccctaagaagtggtcgccactctgtatgcacagtaactttcgaggacgtacgggtcaaccgtatacgaaccgaagggaccaaccggtccaacgtaccaaacgaacgtacggacctaacgacgttacggacctaggacgacgacgccctacgacggacctacggaccgacgaccgggtcgttacgttacgtttcgtggtcgacgtaggtaccgttaccttaggttcggttccggacccgttaacgggtcgggttacgtttcggtaaccgg

SEQ ID NO: 1734 - DNA, 558 bp, Homo sapiens
  misc_feature: GYAE6OF02JEHDT.43.5.A05.1.454.CMB.1.raw
  modified_base (284)..(284): a, c, t, g, unknown or other
  misc_feature (284)..(284): n is a, c, g, or t
  modified_base (294)..(294): a, c, t, g, unknown or other
  misc_feature (294)..(294): n is a, c, g, or t
  modified_base (315)..(315): a, c, t, g, unknown or other
  misc_feature (315)..(315): n is a, c, g, or t
  modified_base (469)..(469): a, c, t, g, unknown or other
  misc_feature (469)..(469): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattactccctactggttccagcagaagcctggccaggccccccgganactgatttangatacaagcaacaactttccnggacacctcgcccgattctcacggcctccctccgttagggggacaaacgctcgcccgtcgtaccccgtttcgggtcgccgccgacgccgtagacggatcggaggctgactattactgcttgctcgctatgactcgccgtcgttcgggtttcggngggtacggacgtagttcgaccgtcgtaggtcacgccgaacggctccgcccgtcggtccactccgtcgttcccgccctcctctacctacc

SEQ ID NO: 1735 - DNA, 549 bp, Homo sapiens
  misc_feature: GYAE6OF02GD6IC.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactggtgcgacaggcccctggacaagggcttgagtggatggggacggatcgaacctaacaagtgggtgccactctgtatgcacagtaactttcgaggtacagggtcaccatcgaccgagggacacgtcatcaacacagctacagtcgactgacgcacgcctacacgacctagaacgacgacgggtccgtacgttattcgtagtcggaccgtagtaccgttcccttagttcggttacgggtacccgtaacggttcggggttacctttaggtaacccgg

SEQ ID NO: 1736 - DNA, 567 bp, Homo sapiens
  misc_feature: GYAE6OF02HO1PP.43.5.A05.1.454.CMB.1.raw
  modified_base (333)..(333): a, c, t, g, unknown or other
  misc_feature (333)..(333): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggcccctggacaagggcttcgagtggagtgggacggatgaaccctaanaaagtggtgccactctgtatgcacagactttcaggacgagggtcaccatgaccagggacacgtaccatcaaactacacggctaacacgtacggacctggaacgcacgccctacgacgtaccctagtacacgaaccgcggggtcttaccgttattttccgtggttccggacgtaaggcggttaccctagttacggtttccgggacccgtaacggttggggtaccttttaaccggg

SEQ ID NO: 1737 - DNA, 741 bp, Homo sapiens
  misc_feature: GYAE6OF02JLKHJ.43.5.A05.1.454.CMB.1.raw
tcagtgtgagtagtcacgaccggtgctcgatttagatagatagacagggggggagcgatcacccagctaaccacgatctcgttccgtcttagagaatcccctgagaggctccgttcctcaccatggaactaggacctgggaggactcctctttccttcgggtcggcagcgaggcccacacgggagcccacgtccccagggtcgcgagcctgggtgcagtcgtggggcctggagggtgaaggaacgccgtcgggggcctacgacggtgaacggtcctccgtggccaaggtccttcgtggtatacctaccgttacacccggtctaacctaatactacgtaacgtgggtacgcggacgacgggtccccgtagggaccgaagggcccttagggaacggtggaggtaggggaccggtagtacggaaacccttaaagacgttagggttacgaccgtacgttacgcgtaacgtcggactaacgtacggtaaacctttcgaaggtaaccgtacggggtaccaacctacgtacgaacccgtaacggggaactaccgtaccgaacttaccgaaaacgaccgaaggtaccctacgtaaggaccggtacctaggacgaccgtagcccctagaccgaccgtacgaaccgtacgacgggtcgtaccttacgtttcgacggtacggtcgtacggtaaccgttccgttaaggtcgtaccgggtaccctaagggttcggtaaccggtttggaacccgg

SEQ ID NO: 1738 - DNA, 653 bp, Homo sapiens
  misc_feature: GYAE6OF02J3BRG.43.5.A05.1.454.CMB.1.raw
  modified_base (290)..(290): a, c, t, g, unknown or other
  misc_feature (290)..(290): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggcctcagtgaaggtctcctgcaggcttctggatacaccttcaccggctactatatactacgtcgggtcgccgaacgnggtcccccgtaggacgaaggggtccttagggacggttgggagttcggggaacggtactacggaaaccccttaaacgaagtcgggttacgccgtactacgttggttaacgtcggtaccaacgaagttaaccgtttacgacggacgtacgggtacaaccgagtacgtaaccgacgggtactaccggtaccataccaaaccgacgacggtacctaacgacgtaggtcctacggaacgcgtaaccgcctacgtaaacgcccggttaacgaccggaccgacggggtaccgttacttacgttcggtacgtcgtcgacggtacgttacccgtgtcggtaccggccgtacgtcgggtacttacggtaccgg

SEQ ID NO: 1739 - DNA, 835 bp, Homo sapiens
  misc_feature: GYAE6OF02F6PIA.43.5.A05.1.454.CMB.1.raw
  modified_base (294)..(294): a, c, t, g, unknown or other
  misc_feature (294)..(294): n is a, c, g, or t
tcagtgtgagtagtcacgaccggtgctcgatttagatagatagactagggggtaggcatcaaacccaacgcaacctaccactctagtacctcctaggagaatcccctgagagctccgttcctcaccgatgggacctgggaccttcggaggtatccgtcgttcttggtggcagtcaggccacaggacgcccgactcccgtagggtgcaagctgggtgcgagtcgtaggggctcggagggtcgaaggaagccggtcgggcctcgagtaggaggtcctccgtgacaacggtcttcgnggactactacctttcgaaccggtcgtactagtacgtacctacgttggggtacgaccggacctacgggccccgttagggaacgtaagggggtaccgtttggacggttcgggtaagttcggggtaacggacgtaacgaaaacccctaaacgtaacgtcgggtacgaccgtaacttccgtaggtactaggacctaacgaacgttaaacgtttaccggaacgggtaaacgtaacggggttaacccaaaccgtaacgtaacggaaaccgtacgggtaaccgtaaccgtacctaacgtaaccaaacgtaccgtaacggacctaacgtacgtacggaccgtacggaaccggtacctaacgtcctacgtaacggtaccgtacggaaccgtaacgtaaccgggttaccgttaacgttaccgtttaccgtagggttaccgtaccggtttaaccggtaacccgtttaccccgtttaacggttaccgggtttacccgggtaaccccggttaaccgggttacggggtttaacccgtttaccgggtaaccccggg

SEQ ID NO: 1740 - DNA, 680 bp, Homo sapiens
  misc_feature: GYAE6OF02IWWDH.43.5.A05.1.454.CMB.1.raw
  modified_base (251)..(251): a, c, t, g, unknown or other
  misc_feature (251)..(251): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatccttctttcttggtggcagcagccacgaggacgcccactcccgaggtcgcagcgtggtgcagtcgtgggctggaggtgaagagcgtgggcctcgagtgaggtctcgtgcgaggcttcgnggactacctaccttcgaccggactactatactacgacgtgggtgcgacgacggtcccgtaggaacgagggcgttggacggtggagtaggggacgacgtacgaaccctaaagaacgttggtacgacctacgttcgtagtactggacaactagttaactcgagacgtacggtacaacctagtacgaaccgagggacctaacgtaccgaatacgaaccgaacgaacggtactaaccgacgtacggtaccgtaggacgccgaacgtccgtaaccgaacggtacccgtacgggaaccgaccggttaccgggacgttaccgtttactttaccggttaggtcggtaccggtaacggttaaccgttccccggttaggttacccgggttccggaaccccggttaacggttacggggttacccgtttcgggtaaaccgg

SEQ ID NO: 1741 - DNA, 503 bp, Homo sapiens
  misc_feature: GYAE6OF02FK3ZZ.43.5.A05.1.454.CMB.1.raw
  modified_base (376)..(376): a, c, t, g, unknown or other
  misc_feature (376)..(376): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactggtgcgacaggcccctggacaagggcttgagtggatggggacggatgaacctaacaatggtgccactctgtatgcacagaactttcaggacagggtcaccntgacagggacacgtcatcaacacagctacatggacctgagcagcctcagaccgtgaccacgacgggctcttacttcgtagtcgcgagacgttcctagtgttcggacccacgtgggactttgtaaccg

SEQ ID NO: 1742 - DNA, 594 bp, Homo sapiens
  misc_feature: GYAE6OF02GMXOH.43.5.A05.1.454.CMB.1.raw
  modified_base (353)..(353): a, c, t, g, unknown or other
  misc_feature (353)..(353): n is a, c, g, or t
  modified_base (452)..(452): a, c, t, g, unknown or other
  misc_feature (452)..(452): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaaggtctcctgcaaggcttctggatacaccttcgaccggctactatatacacgtgggtgcgacgacggccctggacgaagggcttggaggtggagtgggacggatacgaacctaactaagtggtcncctactctagtatcgacacgagtaacttacgaggaacgagggtaccaacctagtcgaaccgagggacctacgtacccaataccaaacacgacgacctanagtacgacctgacgacacgtcctacacgtacctacgaccgacgaccggggtcttcgttacgtttccgaggtcggacgacggtaccgttcccgtagttcggttaccgggtacccgtaacggtcggggttacttcggtaaccgg

SEQ ID NO: 1743 - DNA, 505 bp, Homo sapiens
  misc_feature: GYAE6OF02GQ7ZO.43.5.A05.1.454.CMB.1.raw
  modified_base (282)..(282): a, c, t, g, unknown or other
  misc_feature (282)..(282): n is a, c, g, or t
  modified_base (332)..(332): a, c, t, g, unknown or other
  misc_feature (332)..(332): n is a, c, g, or t
  modified_base (362)..(362): a, c, t, g, unknown or other
  misc_feature (362)..(362): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (425)..(425): a, c, t, g, unknown or other
  misc_feature (425)..(425): n is a, c, g, or t
  modified_base (443)..(443): a, c, t, g, unknown or other
  misc_feature (443)..(443): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaaccggctaactatatacactgggtncgacaggcccctggacaagggcttgagtggatgggaggatgaaccctaanaatggtgccactctgtatgcacagaacttnaggacagggtcacatgacagggacacgtccatcaacacagctacatgacctgancagcctnanacctgacgacacgggctnttatttcgtgtgacgtaagacgtcctagtcggttcggaccccaagtggggtacctttgaacg

SEQ ID NO: 1744 - DNA, 641 bp, Homo sapiens
  misc_feature: GYAE6OF02GZKSW.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcgagtgaaggtctcctgcaaggcttctggatacaccttcaccggctactatatacactgggtgcgacaggcccctggacgaagggcttgagtggagtgggacggagtacgaacctaacgaagtggtgcctactctagtatgacacagtaactttcaggacgtagggtaccaccatcgaaccgagggaccacgtacccataccaaacacaacggcctaacagtacgaccgtggacgtcgacgtccctacgacgtacccgtacgaaccggaccgtaaccggggtaccgttaccgtttacgttttccgttcgggtacggtaccggtaagggtaacccgtttccccgtttaaggttccggggttttacccggggacccccgttaacgggtttaccggggggttaccttttaccgggtaaccccgggg

SEQ ID NO: 1745 - DNA, 575 bp, Homo sapiens
  misc_feature: GYAE6OF02JFQL0.43.5.A05.1.454.CMB.1.raw
  modified_base (282)..(282): a, c, t, g, unknown or other
  misc_feature (282)..(282): n is a, c, g, or t
  modified_base (484)..(484): a, c, t, g, unknown or other
  misc_feature (484)..(484): n is a, c, g, or t
  modified_base (509)..(509): a, c, t, g, unknown or other
  misc_feature (509)..(509): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttcgtggatacaccttcaccggtctactatatacactgggtncgacaggcccctggacgaagggtcttgaggtggagtggggacggtatcgaaaccctaaagaagtgggtcgaccctacgtctaggtactgacaactaacgtaacctttcgaagggtacgacggggtaccaccagtcgaaccggaggaccacgtccaatacaacacgagtctacacgtcgacctgacgcacgcctacacgaccnggaccgacgacgggctcttattcgnggtcgaccggtagacgttaccgtagttacgggtccggaccctaggttcgggtactttacgtaacgg

SEQ ID NO: 1746 - DNA, 655 bp, Homo sapiens
  misc_feature: GYAE6OF02FSC18.43.5.A05.1.454.CMB.1.raw
tcagtgtgagtagtcacgaccggtgctcgatttagatagatagacgagggggagcatcacccagcaaccacatctgtcctctagagaatcccctgagagctcccgttcctcaccatggactggacctggaggatccgtcttcttggtggcagcagccacaggagcccactcccaggtgcagctggtgcagtctggggctggaggtgaagaagccgtggggcctcgagtgaaggtcctctgcaaggcttctggatacaccttcaccggctactatatacactgggtgcgacacggcccctaggacgaaggggcttaggagtgggagtggggacggatacggaaacccttaacgaagtggtacgacctccttacgttgtagttcgaccacaaggttaaaccgttttcgaacgggtaacgaacggggtaccaaccgtagtacggaaccgtaggggaaccctaccggtacccaacgtaccaaaccgtacgaacgggaccttaacgtacgtacgtaccgtaggacgaccgacgtccctacgaacgtacccgtaggacggaccggacgggtaccgttcgttacgtttcgtcgtcgggacgtacgtaccgttaccttagttcggttccgggaccctacgggtgggttaccgttggtaaccgg

SEQ ID NO: 1747 - DNA, 730 bp, Homo sapiens
  misc_feature: GYAE6OF02JPSNJ.43.5.A05.1.454.CMB.1.raw
  modified_base (238)..(238): a, c, t, g, unknown or other
  misc_feature (238)..(238): n is a, c, g, or t
  modified_base (241)..(241): a, c, t, g, unknown or other
  misc_feature (241)..(241): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcgttggtggcagcagccacgaggacgcccacctcccgaggtcgcagcgtggtgcagtcgtggggctggaggtgaagaagcgtgggcctgagtgacggtcnccngcaaggctcgtggatacaccttcaccggtctactatatacagtggtgccgacgacggtccccgtggaacagggtcgttaggagtaggagtgggagacgtacgaaaccgtaaacgaagtcggtacgaccgtacgttcgtacgttagacggtcctaacgacgttaaaccgtttcgaacgggtaacgtacgggttaccgaaccgtaacggtaccgaaaccgggtaacggggtaccgtacccggtacccaacgtaaccgaaaccgacgtaacggtaaccgtaaccgtaaggttacccgggtaaccgtaacggacgaaccgtaccgtacccgtaccggaaccggtaaccgaaccggaacccgggacggtaaaccggggttccttaacgttacgtttaacggtcgtacggtaccggtaagtaccgtttaccccggtagttccggtttaccgggacccgttaaccgggtacgggttaccgttacggttaacccggg

SEQ ID NO: 1748 - DNA, 616 bp, Homo sapiens
  misc_feature: GYAE6OF02JA8GN.43.5.A05.1.454.CMB.1.raw
  modified_base (288)..(288): a, c, t, g, unknown or other
  misc_feature (288)..(288): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtgggcctcagtgaaggtcctctgcaaggcttctggatacaccttcgaccggctactatatacacgtgggtgacgacncggccccgtaggacgaagggctggagtggagtgggacgtagtacgaaacctaagagtcggtcgacctactctagtatcgacaacgagtaacttcgaaggacgtagggtaccacagtacgaacgagggacacgtacacacgaacacgacgctacagtacgactagacgacgacgcccgtacgacgtaccgtacgaaccggtaaccgacgggtaccttacttacgtttcgtcgggtacgtacggtacgtaaccggtttcccgttaggttaccggggtaccggtaccccgttaacgggttccggggtttaaccgtttcggttaaacccggg

SEQ ID NO: 1749 - DNA, 677 bp, Homo sapiens
  misc_feature: GYAE6OF02GQXMC.43.5.A05.1.454.CMB.1.raw
  modified_base (186)..(186): a, c, t, g, unknown or other
  misc_feature (186)..(186): n is a, c, g, or t
  modified_base (244)..(244): a, c, t, g, unknown or other
  misc_feature (244)..(244): n is a, c, g, or t
  modified_base (342)..(342): a, c, t, g, unknown or other
  misc_feature (342)..(342): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcngtcgtgggctgaggtgaagaagccgtgggcctcgagtgaaggtctcctgcaggcttcnggatacaccttcaccggctactatactacacgtgggtgcgacgacggcccgtggaacgagggcttggagtggagtggggacggtatacgaaacctaanagtacggtcgaccgattcgtgttaactggaacctaacgaagttaccgttagacgggtactacggggtaccaacgtaagtccggaacgacgggtaaccgtaccgtaccaacggtaacaaccgaacgacggtacctacgaacgttacggacttacgggaacgaccgtacgtacccgttaacgaccgtaacccggttagaacccggtaacggaacccgggttacgttacctttacgttcggtacggtccggtaacggtcggtaaccggttacccgttagttcgggttccggggtaaacccgtacggggttacgggtttacggttaccgttaacccggg

SEQ ID NO: 1750 - DNA, 620 bp, Homo sapiens
  misc_feature: GYAE6OF02I9W4R.43.5.A05.1.454.CMB.1.raw
  modified_base (247)..(247): a, c, t, g, unknown or other
  misc_feature (247)..(247): n is a, c, g, or t
  modified_base (339)..(339): a, c, t, g, unknown or other
  misc_feature (339)..(339): n is a, c, g, or t
  modified_base (363)..(363): a, c, t, g, unknown or other
  misc_feature (363)..(363): n is a, c, g, or t
  modified_base (481)..(481): a, c, t, g, unknown or other
  misc_feature (481)..(481): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagcgtggtgcagtcgtggggctgaggtgaagagccgtggggcctcgagtgaaggtctcctgcaaggcttcnggatacaccttcaccggctactatatacacgtgggtcgcgacgacggccccgtaggacgaaggggtcttggagtcgggagtcggggaacgtntacggaaccctaacgaagttggcncctacgtctgtactcgactacacgtactttcgaacggacgaggtaccaccagtcgaaccgacggacaccgtacactaccgaaccgacgaacggctaacgagtccggactaggaccganaccgtactaccgacgtaccgtacgaaccgaccgtaccgggtacttacgtttacgttcgttggtacggacggacgtacgttcccgttaggttcggttacccggaacccgttagggttccggggttacttcggtaacccgg

SEQ ID NO: 1751 - DNA, 511 bp, Homo sapiens
  misc_feature: GYAE6OF02ICSIH.43.5.A05.1.454.CMB.1.raw
  modified_base (219)..(219): a, c, t, g, unknown or other
  misc_feature (219)..(219): n is a, c, g, or t
  modified_base (280)..(280): a, c, t, g, unknown or other
  misc_feature (280)..(280): n is a, c, g, or t
  modified_base (330)..(330): a, c, t, g, unknown or other
  misc_feature (330)..(330): n is a, c, g, or t
  modified_base (354)..(354): a, c, t, g, unknown or other
  misc_feature (354)..(354): n is a, c, g, or t
  modified_base (396)..(396): a, c, t, g, unknown or other
  misc_feature (396)..(396): n is a, c, g, or t
  modified_base (404)..(404): a, c, t, g, unknown or other
  misc_feature (404)..(404): n is a, c, g, or t
  modified_base (411)..(411): a, c, t, g, unknown or other
  misc_feature (411)..(411): n is a, c, g, or t
  modified_base (422)..(422): a, c, t, g, unknown or other
  misc_feature (422)..(422): n is a, c, g, or t
  modified_base (445)..(445): a, c, t, g, unknown or other
  misc_feature (445)..(445): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctnagtgaaggtctcctgcaaggcttctggatacaccttcaccggctactatatacactgggtncgacaggcccctggacaagggcttgagtggatgggacgatgaaccctaanaactggtagccactctgtatgcanagaacttcaggacagggtcacatgacaggacacgtcatcaanacagctanatggacngagcagcctanacgacctgaaccgacaccggggntctattccgtgtgccgtagacgtccctagtcggttacggaccctaacggtgggtacttggtaaccg

SEQ ID NO: 1752 - DNA, 693 bp, Homo sapiens
  misc_feature: GYAE6OF02GK5II.43.5.A05.1.454.CMB.1.raw
  modified_base (305)..(305): a, c, t, g, unknown or other
  misc_feature (305)..(305): n is a, c, g, or t
tcagtgtgagtagtcacgaccggtgctcgatttagatagatagacagggggctggacaccaggggtcccttccaatagtcagcaccatggcctggactcctctctttctgttcctcctcacttgctgcccagggtccaattcccaggctgtggtgacttcaggagccctcactgactgtgtccccaggtagggacgagtcacgtctcacctgtggctccagcactggaactgtacaccagtcggtacattatcctaactggttccagcagaagacctggaccaggccccccggatactgacttangatacaagcaacgaaactttccgagacaccgtgcccgtattctcgaacgtctaccctcggtttcggggactaaagctcgtccctacgtacccgtttcgggtcgtacgtccgaacggtcctagggaacggtaatcgggtaacggggtcctttaacgggaaactttaacgtttaaccgttacggtaccgtttacggttacttccgtaccgttatacggaacttcgggtacccgttcgtttaccgggggtttttccggaccgggttacgggtaaccgtaaggtttccggaacccggttcggttacggttacgacgtacccgaagggtctaccggcccccgttgggtacctacgtcgttacccgttcccgtccctacgttccaacttacccg

SEQ ID NO: 1753 - DNA, 559 bp, Homo sapiens
  misc_feature: GYAE6OF02HVJ1X.43.5.A05.1.454.CMB.1.raw
  modified_base (337)..(337): a, c, t, g, unknown or other
  misc_feature (337)..(337): n is a, c, g, or t
  modified_base (345)..(345): a, c, t, g, unknown or other
  misc_feature (345)..(345): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacactgggtgcgacaggtcccctggacaagggtcttggacgtggagtgggacggatcgaaccctaanaagtggtnccactctagtactgacacagtactttcgaggactagggtcacctagtgaccgagggacacgtcatacaacacgagctacgtatcggacctgacgcacggcctacgacgacctagaccgacgacgggtctacgttactttacgtcggtgtaccggagtaccgttacccttagtcggttacgggaccctacggtcgggttaccgtttcggtaccgg

SEQ ID NO: 1754 - DNA, 624 bp, Homo sapiens
  misc_feature: GYAE6OF02JCW5L.43.5.A05.1.454.CMB.1.raw
  modified_base (278)..(278): a, c, t, g, unknown or other
  misc_feature (278)..(278): n is a, c, g, or t
  modified_base (343)..(343): a, c, t, g, unknown or other
  misc_feature (343)..(343): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctggaggtgaagaagccgtggggcctcgagtgaaggtctcctgacaaggcttcgtggatacaccttcaccggctactatatacnctgggtcgcgacacggccctaggacgaagggtcttggagtgggatgggacgattcgaaccctaanagtggtcgccacgtctgtagtgcaacgactaacgtttcgacgggtacagggtccaacgagtacgaaccgaggggaactacgtacccagtaaccgaaccacgacggtacctaacgacgtacggaccctaggaacgacgaaccgtccgtaacgacggtaaccgtacgaacccggacggaaccggggtcttacctttacgttcggttacgtcggtacgaacggtaccgtacccttacggtcggttaccggaccgtaacggtcggggttaaccgttgtaaccggg

SEQ ID NO: 1755 - DNA, 559 bp, Homo sapiens
  misc_feature: GYAE6OF02F113I.43.5.A05.1.454.CMB.1.raw
  modified_base (242)..(242): a, c, t, g, unknown or other
  misc_feature (242)..(242): n is a, c, g, or t
  modified_base (337)..(337): a, c, t, g, unknown or other
  misc_feature (337)..(337): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagcctggggcctcagtgaaggtctcctgcaggcttcnggatacaccttcaccggctactatactacacgtgggtgcgacgacggccctggacgaagggcttggagtggagtgggacgagtcgaaaccctaanaagtggtgacctactcgtagtactgacaacgtagtaactttcgacggtacgagggtaccacagtacgacgagggcacgtcatcaacacagactacagtacgactagctacgacgtccgacctaggacctacggaaccgacggacgggtctacgttattcgtgtacgcggtacgtacgtaccctaggtcgttcggaccgtaggttcgggttaccttgtaccgg

SEQ ID NO: 1756 - DNA, 620 bp, Homo sapiens
  misc_feature: GYAE6OF02G1CWB.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggcctcagtgaaggtctcctgcaaggcttctggatacaccttcaccggctactatatacacgtgggtgcgacaggcccctggacaagggcttggaggtggagtgggacggatacgaaacctaacaatgggtacgccactcgtgtactgacaactagtaacctttcaaggacaggggtacaacccgtatacgaaccgacggggaactaccgtccaactaccaaacaaccgaaggacttaacgagttacggaccctaggacgccgaacgcccgtaccgaacgtaacccgtcggaaacggaccgaaccggggtcgttaccttacgtttccgttaggtccggtacgtaacggtaccgttacccgttagttcggttcgggacctaaccggaacggttcggggtatttaaccgg

SEQ ID NO: 1757 - DNA, 738 bp, Homo sapiens
  misc_feature: GYAE6OF02HT7NG.43.5.A05.1.454.CMB.1.raw
  modified_base (294)..(294): a, c, t, g, unknown or other
  misc_feature (294)..(294): n is a, c, g, or t
  modified_base (306)..(306): a, c, t, g, unknown or other
  misc_feature (306)..(306): n is a, c, g, or t
tcagtgtgagtagtcacgaccggtgctcgatttagatagatagacaggggtctggcaccaggggtcccttccaatatcagcaccatggcctggactcctctctttctgttcctcctcacttgctgcccagggtccaattcccaggctgtggtgactcaggacgcccctcactgactgtcgtccccgaggaggacagtcactctcactgtgctcagcactgactcgcaccagtgactattactcctacgttcggttccagacacgaacgccgtcggcccgaccggccccccgganacgtgtatttanacgataacaacgaacaaccttaaacctttcctacggacctaccgtcgtacccgtagttcaccgtcggtaccctcccgttccggtacggggacctaacggtctccgtccgtccgttacccggtttcgggcgtccgacgacgtccgtaggaggtacgtacggacggtctacgtaattacgttacgtcgtcgttacgttccgtaccgtacgttacgtgtactcggtacttccgggttccggttttaccggggggtttaccggacgggggtaaccggtaaccgttaagggttaccgtaacccgggttaccgtaggtcccgaaccgggtaacccgtacgggtaccccgttcccggtacccccggttacggtaccccttacccggttcccggttaccccttaccccccgtaccccgtttaccctacccgttaaccccg

SEQ ID NO: 1758 - DNA, 561 bp, Homo sapiens
  misc_feature: GYAE6OF02JDR2F.43.5.A05.1.454.CMB.1.raw
  modified_base (263)..(263): a, c, t, g, unknown or other
  misc_feature (263)..(263): n is a, c, g, or t
  modified_base (334)..(334): a, c, t, g, unknown or other
  misc_feature (334)..(334): n is a, c, g, or t
  modified_base (358)..(358): a, c, t, g, unknown or other
  misc_feature (358)..(358): n is a, c, g, or t
  modified_base (416)..(416): a, c, t, g, unknown or other
  misc_feature (416)..(416): n is a, c, g, or t
  modified_base (481)..(481): a, c, t, g, unknown or other
  misc_feature (481)..(481): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggccttctggatacaccttcaccggntactatatacactgggtgcggcaggcccctggacaagggcttgagtgggatgggacggatggaaccctaanaatgggtcgccactctgtatgcanagactttcaggacagggtcacatgaccagggacacgtccatccaacacaggactacancggtacctggacgcacgcctcgacgaccgtcgaccgaacgcggggcgttaccgttagttttccgnggttcgcgtaacggtacggtcccttaagttcgggttaccgggacccgtaacggtttcggggttacctttaggtaacccgg

SEQ ID NO: 1759 - DNA, 674 bp, Homo sapiens
  misc_feature: GYAE6OF02HPH65.43.5.A05.1.454.CMB.1.raw
  modified_base (201)..(201): a, c, t, g, unknown or other
  misc_feature (201)..(201): n is a, c, g, or t
tcagtgtgagtagtcacgaccggtgctcgatttagatagatagacaggggtctggcaccaggggtcccttccaatatcagcaccatggcctggactcctctctttctgttcctcctcacttgctgcccaggtccaattcccaggctgtggtgactcaggacgccctcactgactgtcgtccccaggagggacagtcactcncacctgtcggctccagcacgtggaactgtcaccagtggtcattactcctatggttccagcaagaagcctggcccgacggccccccggacactgatttatgatacaagcaaacaactttccgtagacacctgcccgtattctcacgcctcccgtcgttggggacaacgctcgcctcgtacccgtttggcgcgcacgccgtagaggagtcggaggcttagtacttacttactggtccttggtaccgttcgaccgttagtcgtagtcgtcgttcgttccgggtttaccggggttttccggggaccgggtaaccgggttaacccggttaacggttcggaaccccgtttaccggtacgggttaccgaccgtaaccccgggtaacggccccgttacccggtccccccggttaccgggtaccctccgttccccgttacccggtttaccccctaccccccgttccctacccggttaacccc

SEQ ID NO: 1760 - DNA, 658 bp, Homo sapiens
  misc_feature: GYAE6OF02GVI2C.43.5.A05.1.454.CMB.1.raw
  modified_base (352)..(352): a, c, t, g, unknown or other
  misc_feature (352)..(352): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgagtgaacggtctccgtgacaaggtcttcgtggataccaccttcgaccggcttactatatacacgtgggtgacgacgacggcccctaggacgagggcttggaggtggagtgggacggatacgaacctaanaacgtggtacgacctacgtctagtagtcgacaacgtaacgtaaccgtttcgaacgggtaacgtacgggtaccaaccgtagtacggaaccgaacgggacctaccggtaccacgtaaccaaccgaacgacggtacctaaccgtagtaccgggaccgtaggacggacgaccgtacctacgaacgaccgtacggaacccgacgaccgggtaccgttacgttacgtttcgtggtcgaaccggtagtacccgtaccgttaggttacgggttccggtacccggtaggttacgggttaccgttagtaacccggg

SEQ ID NO: 1761 - DNA, 603 bp, Homo sapiens
  misc_feature: GYAE6OF02GWZ41.43.5.A05.1.454.CMB.1.raw
  modified_base (474)..(474): a, c, t, g, unknown or other
  misc_feature (474)..(474): n is a, c, g, or t
tcagtgtgagtagtcacgaccggtgctcgatttagatagatagacagggggagcatcacccagcaaccacatctgtcctctagagaatcccctgagagctccgttcctcaccatggactggacctgggaggatcctcttcttggtggcagcagccacaggagcccactcccaggtgcagctggtgcagtcgtggggctggaggtgaagaagccgtggggcctcgaggtgaaggtctccgtgacgaaggtcttcgtggtactactaccttacgaccggtactaactatactaccgacgtggggtgcgacgacggccccgtaggaacgagggtcgttaggaggtaggagtacggggaggactacggaaaccctaacgaagtcggtacgcctacgtcgttagtatcgacaactaagtaacttcgaaggtacgacggacacagtcgacgaggacacgtacataccaacagacgactanacgtacgactgacacgactccacgacgactacgacgaccgaacgggtcttacttactttcgaggtcggacggacgtacgttaccgaggttcggtacgggacctaacggtcgggttacgtccgtaacggg

SEQ ID NO: 1762 - DNA, 551 bp, Homo sapiens
  misc_feature: GYAE6OF02FIDHU.43.5.A05.1.454.CMB.1.raw
  modified_base (273)..(273): a, c, t, g, unknown or other
  misc_feature (273)..(273): n is a, c, g, or t
  modified_base (383)..(383): a, c, t, g, unknown or other
  misc_feature (383)..(383): n is a, c, g, or t
  modified_base (417)..(417): a, c, t, g, unknown or other
  misc_feature (417)..(417): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatatacnctgggtgcgacacggcccctggacaagggcttggagtgggatggggacggatcgaaccctaacaagtggtcgccactctgtatgacacagactttcaggacaggtcacancgacgaggacacgtcactcaacacaggctaacanggtacctgagtcagccctacacgaccgtagaccgaacgacgggtcgtaccttactttcgtgtacggtcggaacggtacgttcccttagttcggttccgggaccctaacgggtcggggtactttacggtaaccgg

SEQ ID NO: 1763 - DNA, 701 bp, Homo sapiens
  misc_feature: GYAE6OF02HLIIG.43.5.A05.1.454.CMB.1.raw
  modified_base (294)..(294): a, c, t, g, unknown or other
  misc_feature (294)..(294): n is a, c, g, or t
  modified_base (340)..(340): a, c, t, g, unknown or other
  misc_feature (340)..(340): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtcccaggagggacagtcactctcacctgtcgctccagcactggactgtcaccagtgtcattactccctatcggttccagtcagaacgcctggccacggccccccggacactgatttangatacaagacaaactaaactttcctacggacacctgcccgtattcncaggcctccctcgttggggacaaagcgtcgcccgtcgtacccgtttcgggtcgccgcgtacgctacggaggtacgtaggacggtctacggtaacttacgttacgtcggtcttcggccgttccgtaccttagtacgtagtccggtccggttccggtttccggggttttccgggaccggggtaccgggtaaccggttaacggttccggtaacccggttacccggttaacgggtccgaaccggtacccggtaaacgggtcccgttacccggtacccccggttacggtaccccgttaccgttcccggtttacccggttaccccccgtccccgtttaccccgttacccgtaaccctttaacccccg

SEQ ID NO: 1764 - DNA, 652 bp, Homo sapiens
  misc_feature: GYAE6OF02FYYHI.43.5.A05.1.454.CMB.1.raw
  modified_base (308)..(308): a, c, t, g, unknown or other
  misc_feature (308)..(308): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggacgccctcactgactgtcgtccccgagggagggacagtcactctcacctgtggctccagcactggaactgtcaccgtagtggtactattactccctacgttcggttccagcagaagccgtggccgacggcccccgacacgtgtatttangactacgaagacaactaacttcgtgaccacctcgaccgtatctcacggcctcccgtcgtcggggacaacgctcgccgtacgtcccgttcggtcgcgcgacgtccgtggacggagtcggagtcgtacgtacttacgttacgtcgttccttaggccgtcgtactagttcgacgttccggccgttccgggtttcggggtttaccggcggggtacggtaccgtacggttaccggaccgttcgtacggtaccaccgtacccggacggtcccgtcccggccccgttaccgtaccgtaccgttccgttaccccgttccccgtcccctaccggttaccctacccttaacccg

SEQ ID NO: 1765 - DNA, 646 bp, Homo sapiens
  misc_feature: GYAE6OF02GYBMO.43.5.A05.1.454.CMB.1.raw
  modified_base (469)..(469): a, c, t, g, unknown or other
  misc_feature (469)..(469): n is a, c, g, or t
tcagtgtgagtagtcacgaccggtgctcgatttagatagatagacagggggagcatcacccagcaaccacatctgtcctctagagaatcccctgagagctccgttcctcaccatggactggacctgggaggatcctcttcttggtggcagcagccacaggacgcccacctcccaggtgcagctggtgcgagtcgtggggctggaggtgaagagccgtgggcctcgaggtgaaggtctcgtgacgaggtcttcgtggactacctaccgttccgaccggtactactatactacacgtgggtcgacgacgacggccccgtaggaacgaagggtcttaggaggtggaggtgggacgagtacgaacctaacgagtggtacgacctactcgtagtactcgacaacgtacgtaacgttacgaggtacgtaggtaccacgagtacgaccgacgggaccacgtacaactaccgaaacncgtaacgacctaacgtacggtaccgacgtaggacgacgtaccgtacctagaccgtacgacgaaccgaccggtaacggtccgttacttacgttcgtggtacgtcgtacggtaccttccggttagttaccgggtaccggtacccgttaaggggttccgggttacgttacggtaaccggg

SEQ ID NO: 1766 - DNA, 596 bp, Homo sapiens
  misc_feature: GYAE6OF02GHSPV.43.5.A05.1.454.CMB.1.raw
  modified_base (344)..(344): a, c, t, g, unknown or other
  misc_feature (344)..(344): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatctcttcttggtggcagcagccacaggagcccactcccaggtgcagctggtgcagtctggggctgaggtgaagaagccgtgggggcctacgacgtgaaggtctcctgcgaaggcttctggataccaccttcaccggtctaactatatacacgtggtgcgacacggtccccgtggacgaaggcttgagtggagtgggaggtatacgaacctaanaagtggtcgcctactcgtgtatcgactacgagtaactttacgacggacgacgggtacaacagttcgaccgagggacacgtaccactacaaacacgacgacctacgagtcggaccgtaggacgacacgcctacgaacgccgtagaaccgacgtacgggaccttacgtttacttcgtggtacgtcggaaggtaccgttacccgtagttcgggttaccggacccgtagggttccgggtaccgtttggtaacccgg

SEQ ID NO: 1767 - DNA, 612 bp, Homo sapiens
  misc_feature: GYAE6OF02G8703.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcaggtctggggctgaggtgaagaagcctggggcctcgagtgaaggtctccgtgacaggcttctggatacaccttcaccgctactatatacacgtgggtgcgacacggcccctggacgagggtcttggagtggagtgggacggagtacgaaccctaacaagttcggtacgaccactctgtatcgactacgaagtaacctttagacggtacgacgggtacaaccgtcgtacgaaccgtagggaaccacgtaccacgtaccaaacgacgaacgtacctacgtaacgtcggtacccgtagacgacgaccgtacctacgaaccgaccgtacgaaccggacggtaccgggcttacgttacttcggtacgtgacggagtccgtaccgtagttacggtaccggtacccgtacgggtcgggttacgttacgtaacgg

SEQ ID NO: 1768 - DNA, 691 bp, Homo sapiens
  misc_feature: GYAE6OF02JBQ2O.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgccagctggtgcagtctggggctgaggtgaagaagcctggggcctcagtgaaggtctcctgcaaggcttcgtggatacaccttcgaccggctactatatacactgggtcgcgacacggccctggacagggcttaggagtggagtgggacgtatacggaacccttaacgaatcgggtcgcctaacgtctagtactgactacaaggtaacctttcgaacgggaccgtaggggttaccaacccgtaagtaccggaaccggaacgggtaacctaccggtaccctaacgttaccaaaccacgtaacgggtacctaacgaacgtaccggtaaccgtggtaacggccaacggtcccctacgtaccgacccgttacgggaaaccgtaccggaaccggggtacgttaccgtttaacgtttccgcggttacggaccggtaacggtacccgtttacccgtaacggtttcgggttaaccgggtacccgttaacgggttacgggggttaccgtttaccggtaacccgggg

SEQ ID NO: 1769 - DNA, 574 bp, Homo sapiens
  misc_feature: GYAE6OF02IJ3O9.43.5.A05.1.454.CMB.1.raw
  modified_base (160)..(160): a, c, t, g, unknown or other
  misc_feature (160)..(160): n is a, c, g, or t
  modified_base (246)..(246): a, c, t, g, unknown or other
  misc_feature (246)..(246): n is a, c, g, or t
  modified_base (273)..(273): a, c, t, g, unknown or other
  misc_feature (273)..(273): n is a, c, g, or t
  modified_base (282)..(282): a, c, t, g, unknown or other
  misc_feature (282)..(282): n is a, c, g, or t
  modified_base (311)..(311): a, c, t, g, unknown or other
  misc_feature (311)..(311): n is a, c, g, or t
  modified_base (317)..(317): a, c, t, g, unknown or other
  misc_feature (317)..(317): n is a, c, g, or t
  modified_base (321)..(321): a, c, t, g, unknown or other
  misc_feature (321)..(321): n is a, c, g, or t
  modified_base (350)..(350): a, c, t, g, unknown or other
  misc_feature (350)..(350): n is a, c, g, or t
  modified_base (373)..(373): a, c, t, g, unknown or other
  misc_feature (373)..(373): n is a, c, g, or t
  modified_base (389)..(389): a, c, t, g, unknown or other
  misc_feature (389)..(389): n is a, c, g, or t
  modified_base (477)..(477): a, c, t, g, unknown or other
  misc_feature (477)..(477): n is a, c, g, or t
  modified_base (537)..(537): a, c, t, g, unknown or other
  misc_feature (537)..(537): n is a, c, g, or t
tcagtgtgagtagtcacgaccggtgctcgatttagatagatagacaggggctggcaccaggggtcccttcaatatcagcaccatggcctggactcctctctttctgttcctcctcacttgctgcccagggtccaattcccaggtctgtggtgactcaggngcctcactgactgtcgcccaggacggcagtcactctcactgtcggctccagcactggactgtcaccagtgcattctcctatcgtcngcagacgctcgccgacggccccgacanagtacttantagactaagactaactaacttcagacacngaccgnttcncctagcctccgtcgtacgggacaaggtcncgaccgtcgtacccgttcggacnccgactacgtctaagnggtactcgggacgtctaggtaccttagtaccgtaggttcttacggtctcgtactagtcgagtcgtccggtgttacggttcgggacggntaaccgtgtacggtccgtaacgttcgactcgccgtaggccgttaccgcccgtttacgacnccgttctaccggtacccctcctacctccgactacccg

SEQ ID NO: 1770 - DNA, 638 bp, Homo sapiens
  misc_feature: GYAE6OF02IRETA.43.5.A05.1.454.CMB.1.raw
  modified_base (344)..(344): a, c, t, g, unknown or other
  misc_feature (344)..(344): n is a, c, g, or t
  modified_base (399)..(399): a, c, t, g, unknown or other
  misc_feature (399)..(399): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgccagctggtgcagtcgtggggctggaggtgaagaagccgtggggcctcgaggtgaacggtctcctgacaaggcttcgtggatacaccttcaccggctactatatacactgggtgcgacgacggcccctggaccgaagggcttgagtggagtgggacgatacgaacctanaagtggtcgaccgacttctagtagtgactaacacgtaactttcgacgggtaacgngggtaccaccgtatacggaaccgacggacaccgtaccaactaccgaacacgaacgcttaacgacgtcgggacctggacgacgtacgcccgtacaaccggtaccgacggtaaccgcggtaaccgggtcttaccgttaccgtttcgtacggttcggtaccgggtacgtaccgttacccgtaacgttcggttaccgggaccccgttaaccgggtacggggtttacctttacgggtaacccgg

SEQ ID NO: 1771 - DNA, 765 bp, Homo sapiens
  misc_feature: GYAE6OF02JEELT.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcgaggtgaaggtcctccgtgcgaaggtccttcgtggaactaccgaccctttcgacccgggtcttactataactaccgtacgttggggtcgacggaaccgccggtcccccgtagggaaccggtaacggggtcctttagggaacggtgggtacggttcgggggaacggtagttaaccgaaaaccccgttaaagtaacgttacggggtacgtaccccgtacgtttacgttacgttaagtcgaccgtaacgtaacggttaaaccctttacggaacgggtaccggtacgggtaaccctaccgtaagtacccggaaaccggacggggaaccctaccgtaccgtaaaccgtaaccaaaccgtaaccggaacggtacctaaacgacgttaccggaccgtaggaacgtccgaaccgtcctacgaaccgtaccgtaacggaccgaccggtaccgggtactttacgtacgtttcggtcgtacggacgtaacgtaccgttaccctaggttacgggtcccggtacccgtaacgggtggttaccgttagtaacccggg

SEQ ID NO: 1772 - DNA, 842 bp, Homo sapiens
  misc_feature: GYAE6OF02JKHFP.43.5.A05.1.454.CMB.1.raw
  modified_base (202)..(202): a, c, t, g, unknown or other
  misc_feature (202)..(202): n is a, c, g, or t
  modified_base (216)..(216): a, c, t, g, unknown or other
  misc_feature (216)..(216): n is a, c, g, or t
tcagtgtgagtagtcacgaccggtgctcgatttagatagatagacaggggtctggcaccaggggtcccttccaactatcagcaccatggcctggactcctctctttctgttcctcctcacttgctgcccagggtccaattcccaggctgtggtgactcaggagccctcactgactgtcgtccccaggagggacagtcactcncacctgtggctccngcactggaactgcacagtcgcattactcctactgttccagcagagcctggccgacggcccccggacaccgtgtactttacgtacgatacgaacgacgaaacctaaacgttttccgacggtaccaacccttcgaccgttacgttcctacgtaccggtccctacccgttcccggtttagggggacctaaacggtccgttccggcccgtttaccgggtaaccccggttttcccgggggtccgtacccggtaccgtaccgggtacccggtacggtaacgggtaccgtacggggaacgggttccgttaacgggttacgtttaaccggtttaacgtttcccggttacgtttcccgggcgttttaccccggtaccgttaacgttcggtaacgtttccgggtcccgttccgggtttaccgggttttaccggggggttttaccgggtaacccgggggttaaccgggtacccggtttaaacgggttcccggttaaccggttccggtaacggttaccgaccggttaccccggtaaacgggtccgtaccccggtcccccggtacgggtttaccccgtacccgtttccggttacccccgtttccccccgtaaccccggttccctaacccgtttaacccg

SEQ ID NO: 1773 - DNA, 660 bp, Homo sapiens
  misc_feature: GYAE6OF02ID3KR.43.5.A05.1.454.CMB.1.raw
  modified_base (242)..(242): a, c, t, g, unknown or other
  misc_feature (242)..(242): n is a, c, g, or t
  modified_base (340)..(340): a, c, t, g, unknown or other
  misc_feature (340)..(340): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccgaggtgcagctggtgcagtcgtggggctgaggtgaagagccgtgggcctcagtgaagtctctgcagcttcgngatacaccttcaccggctactatatacacgtgggtgcgacgacggcccgtaggacgagggtcttggaggtggagtgggtacggagtacgaaccctaanagtggtcgaccacgttctagtatcgacacgtacgtaactttacgagggtacgtacgggtacaccgtagtacgaaccggacgggtacctacgtacctaacgtacccaaaccgacgtacggaccttaacgacgttaccggtaccgtacggacgccgacgacccgtacgaacgtacccgtaccggaaccggtaccggaaccgggttcgttaccgttacgtttcgtacgggtcggtaccggtaaggttacccgttaccgttaggttccgggttaccgggtacccgttaacggggttcggggtttacccgttaggtaaccccggg

SEQ ID NO: 1774 - DNA, 583 bp, Homo sapiens
  misc_feature: GYAE6OF02H745C.43.5.A05.1.454.CMB.1.raw
  modified_base (464)..(465): a, c, t, g, unknown or other
  misc_feature (464)..(465): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctgggtgcaggtcgtggggctggaggtgaaggaagccgtggggcctcaggtggaaggtctccgtgacaaggtctctggatacacttcacggtctactatatactagtggtcgcgacacggccctaggacgaggtctgaggtggtagtcgggacggtactacgaaacctaagaagtggtacgacctacgtctagtatacgactacgacgtaacttcgagtacgaggtacactagtacgacgaggactacgcatacaacacgaggctacgtacgtcgactcgagaccnncctagacgtaccgtagaccgacggacggtaccttacgtacgttccgtgtcgtacgaggtaccttacccgttaggtcggtacgggtacccttacgggtacggtttacgttcggtaacgg

SEQ ID NO: 1775 - DNA, 780 bp, Homo sapiens
  misc_feature: GYAE6OF02JUJX1.43.5.A05.1.454.CMB.1.raw
  modified_base (121)..(121): a, c, t, g, unknown or other
  misc_feature (121)..(121): n is a, c, g, or t
  modified_base (157)..(157): a, c, t, g, unknown or other
  misc_feature (157)..(157): n is a, c, g, or t
  modified_base (168)..(168): a, c, t, g, unknown or other
  misc_feature (168)..(168): n is a, c, g, or t
  modified_base (267)..(267): a, c, t, g, unknown or other
  misc_feature (267)..(267): n is a, c, g, or t
  modified_base (330)..(330): a, c, t, g, unknown or other
  misc_feature (330)..(330): n is a, c, g, or t
  modified_base (574)..(574): a, c, t, g, unknown or other
  misc_feature (574)..(574): n is a, c, g, or t
  modified_base (749)..(749): a, c, t, g, unknown or other
  misc_feature (749)..(749): n is a, c, g, or t
tcagtgtgagtagtcacgaccggtgctcgatttagatagatagacagggcgtggcaccaggggtcccttccaatatcagcaccatggcctggactcctctctttctgttcctcctcacttnctgcccagggtccaattcccaggcctgtggtgactnaggacgccctnactgactgtcgtccccagggacgggacaggtcacttctccaccgtggtcggctcctaggctactacggaacttgtaccaccacgttgggtcactttacnccctacgttcggttccacgcctaagacgctcggccacggacccccgacacgtactacgtttangtactaacgaacgaccaactaacctttccgaggtacctacctacgtacccgattacctcgacggtaccttccccgtcgttaacggggtaccaaacgtcgttccgtccgtaccgttacccgtttcggggacgtacccgggtaccacggtcccggttacgacggtcgttacggtaaccgggtctacggtaaaccttacgttcgtacggttcgtcccgtacgtcttacccggtaatcgtttaccggngttcccggttacgggtttacccgggttttacggggacccgggggtaggtttaccccgtaaacgggttccgtaccccgggttacggttacgggtacctaccggtacccggttacgggtccgttaccccgtcccggtttaccgggccttaacccggtttcgttaccccggtttcccnccccggttttacctacccgttccctaacccg

SEQ ID NO: 1776 - DNA, 619 bp, Homo sapiens
  misc_feature: GYAE6OF02HHJNF.43.5.A05.1.454.CMB.1.raw
  modified_base (347)..(347): a, c, t, g, unknown or other
  misc_feature (347)..(347): n is a, c, g, or t
  modified_base (369)..(369): a, c, t, g, unknown or other
  misc_feature (369)..(369): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtgaagaagccgtggggcctcagtgaaggtctacctgcaaggcttcgtggatacaccttcgaccggctactatatacacgtagggtcgcgacgacggcccctaggacgaaggcttggagtcggagtgggacgagtacgaacctaanagtggtacgacctactctgtangactaacgtacgtaacgttacgaggtaacgtacggtaccaacgtagtacgaccgaggacctacggtaccaagtacgaacacgaacggactacgagtacggactagatcacgccgtcaacgtacgtcgaccggacgtaccggtacgttacttacgtttcgtaggtacgcggtaacggtaccgttacccgttaggttcgggttacccgggtaacccgtacgggtttaccgggttacgtttacggtaacccgg

SEQ ID NO: 1777 - DNA, 622 bp, Homo sapiens
  misc_feature: GYAE6OF02JAPFA.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaaggtctccgtgcaaggcttctggatacaccttcaccggctactatatacacgtgggtcgcgacgacggcccctgggaaccgaagggtcttggagtggatggggacgtatacgaaaccctaagaagtgggtcaccgacttcgtagtagtcgaccaacgacgtaaccgtttcgaacgggtacgtagggtaccaaccgtacgtacggaaccgacgggaacctaccggtaccaagtaccaaaccacgtacggctacacgtcgacctggacgctacgccgtacgacgtacgacggacgaccggtacggtcttacgttcgttagtcggtcgaccggtacgtaccgttaccgtaggttccggtaccggtaaccggtacggtacggtttacgtaccgtaccggg

SEQ ID NO: 1778 - DNA, 975 bp, Homo sapiens
  misc_feature: GYAE6OF02GFAJV.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgccccactcccgaggtgcagctggtgcagtcgtggggctggaggtgaagaacgtccgtgggcctcgaggtgaacggtcctccgtgacgaacggtccttacgtacgggaacttaccgtacccgtttaccggaacccggtaccttaaaccttaacttaacgttaaccgtacggttagggggtacgaacccgggtaaccggaacccgggtccccccggttaggggaaacccggtaaacgggggtccgttttaagggagggttacggggagggttacggggggtaaaccgggtacgtaaccgggtaaaacccctaaaacggtaaacggttcgggggtaaccggtacccctaacgtttacggtacgttaagttaccggaacctaaacggtaaaccgttaaacccggttttacgggaaacccggggtaacgggtaacgggttaacccgtaaaccccgtaaggtaacccgggaaacccgggtaaaccgggggtaacccgttaacccgggttaacccctaaaccgttaaccccgaaaaaccggtaacccggtaaacgggttaacccgttaaacgttaaaccggttacccgggtaaccgtacgggtaaccggacccgtaaccggtaccccgttaaccggaaacccgtaccggtaaacccgggaaccggtaaacccggtacccggggtacgtttaaccgttttacgtttcggttacggttaaccgggtaacgtacggttaacccgttaccggttaggtttaccgggttaccgggtaaccccggtttaaggtaccgggggtttaactttaccggtaaacccgggg

SEQ ID NO: 1779 - DNA, 574 bp, Homo sapiens
  misc_feature: GYAE6OF02ICG28.43.5.A05.1.454.CMB.1.raw
  modified_base (191)..(191): a, c, t, g, unknown or other
  misc_feature (191)..(191): n is a, c, g, or t
  modified_base (314)..(314): a, c, t, g, unknown or other
  misc_feature (314)..(314): n is a, c, g, or t
  modified_base (329)..(329): a, c, t, g, unknown or other
  misc_feature (329)..(329): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacngtcactctcacctgtggctccagcactggaactgtcaccagtgtcattactcctactggttccagcagaacgcctcggccacggccccccggacactgatttatgatacagcaactaacttcngacacctgccatccncagcctccctcgttcggggacaacgctcgccctcgtaccctttgggtcgcgcgacgtcctaggaggtctaggagctagtacttattactgtcttcgctcgcttatgactcgccggtcgttccggggtttcgacgggtacgggtacctaggttccgaccgtcgtacggccacgacccgtaggccgtccgtccccgtcggttaccaccgttctccgttcccctaccctccctaccctacttaacccg

SEQ ID NO: 1780 - DNA, 755 bp, Homo sapiens
  misc_feature: GYAE6OF02GYE3R.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggagcccactcccaggtgcagctggtgcagtcgtggggctggaggtgaagaagcgtgggcctcagtgaacgtctctgacgaggtcttctggacgtacaccttcgaccggtactaacgtataactacgacgttacgggtacgacggaccgaccgggtccccgtagggaccgtaagggtcgttaggtacggtggtaggtacggggtacggacgttaccggtaaaccccgttaaacgtaacgttacgggacgtacctaccggtacgtttacgtaacgtacggaccgtaaccgtaacgttaacgtttacggaacgggtaacggtacggggtacctaacccgtaggtaccggaaacccgggtaacgggtaaccgttaccggtacccgtaacgttaaccaaacggtaaccggtaacggtaaccgttaaccggtacgttaaccgggactacggacgtaccgtacgtaccctacgaacgtaccggtaacgtaaccggacggtaccggtaccgtacgtttacgttacgtaggtacggacgtcggtaaccgttaccgttacgttacgggtccggtaaccgtacgggttcggttacgttacgtacggg

SEQ ID NO: 1781 - DNA, 614 bp, Homo sapiens
  misc_feature: GYAE6OF02II40J.43.5.A05.1.454.CMB.1.raw
  modified_base (287)..(287): a, c, t, g, unknown or other
  misc_feature (287)..(287): n is a, c, g, or t
  modified_base (346)..(346): a, c, t, g, unknown or other
  misc_feature (346)..(346): n is a, c, g, or t
  modified_base (354)..(354): a, c, t, g, unknown or other
  misc_feature (354)..(354): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagagccgtgggcctcaggtgaaggtctcctgcaaggtcttcgtaggatactaccttcgaccggctactatactacagtgggtncgaacgcggccccgtaggacgaagggcttggagtggagtgggacgatacggaacctaanagtggtcnccaactctagtatcgacaagtagtaacgttacgaaggtacgaggtaccacgtagtcgaaccgacgggacaacgtaccaagtcaaacgacgtacggactacgtacgtacgaacgtgacgaccgacggtaccctacgaacgacccgtagaaccggacgtaccgggtacgttacttacgtttcgcggttaacgacgaagttaccgtaccgttaaggtcggttaccgggaacccgtaggttacgggtacttaaggtaacccggg

SEQ ID NO: 1782 - DNA, 807 bp, Homo sapiens
  misc_feature: GYAE6OF02IGDEC.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcgttggtggcagcagccacaggacgccccactcccgaggtgcagcgtggtgcagtcgtggggctgaggtagaacgagccgtgggcctcgagtgaacggtcctccgtgcgtaagcgttcgtacggtaactacctaaccttccgaccggtacttaactaatataaccgtacgtggtacgaccggaacgtaccggcccccgtaggaaaccgaaggggtcttacggaggttacggaaggtcggggaacggtaagtaccggaaaacccctaaacgtaaacgtacgggtacgtacccgtacctcgtttaacgtacgtacggtaccgtaaacctaaccggttaaaccgtttcccaacggggtaaccgggtaacgggtaccgtaaacccgtaacgtaacccggtaaaccgtaaaccgggaaccgtaaccggtacccgtaaaccgtaaccaaacccgaaccggttaaccggaccttaaccgtacgtaaccggaaccgtacggtaacgaccgtaaccggaccctaccggtaacccgtaacccgttaacgaacccggtaccggtaaaccgggtccgtttaacgttacgttacgtaggtaacggtaccggtaacgtaccgttacccgttagttcgggtaccggtaaccggttaccgtacgggttacgttacggtaacccgg

SEQ ID NO: 1783 - DNA, 558 bp, Homo sapiens
  misc_feature: GYAE6OF02ICBWB.43.5.A05.1.454.CMB.1.raw
  modified_base (288)..(288): a, c, t, g, unknown or other
  misc_feature (288)..(288): n is a, c, g, or t
  modified_base (368)..(368): a, c, t, g, unknown or other
  misc_feature (368)..(368): n is a, c, g, or t
  modified_base (373)..(373): a, c, t, g, unknown or other
  misc_feature (373)..(373): n is a, c, g, or t
  modified_base (429)..(429): a, c, t, g, unknown or other
  misc_feature (429)..(429): n is a, c, g, or t
  modified_base (433)..(433): a, c, t, g, unknown or other
  misc_feature (433)..(433): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtcgaagaagccgtggggcctcaggtagaaggtctcctgcaaggcttcgtggatacaccttcgaccggctaactatatacacgtggtncgacacggccctaggacgaagggtctgaggtggagtcgggacggatacgaaccctaatagtggtcgactactactggtangcaanatacgtttagacggagtcggacacgatacgacgagggacacgtacacgtacacganacgnacgtatacgctagagccagcctacgacgacgtacgacggacgacggtcttacttgttcgtggtcgcgtacgtacgttaccgttaggtcgtcggtacccgtaggtacggttacgttacgtaccggg

SEQ ID NO: 1784 - DNA, 760 bp, Homo sapiens
  misc_feature: GYAE6OF02GALXJ.43.5.A05.1.454.CMB.1.raw
  modified_base (274)..(274): a, c, t, g, unknown or other
  misc_feature (274)..(274): n is a, c, g, or t
  modified_base (398)..(398): a, c, t, g, unknown or other
  misc_feature (398)..(398): n is a, c, g, or t
tcagtgtgagtagtcacgaccggtgctcgatttagatagatagacagggggaggcatcacccagcaaccacatctgtcctctagagaatcccctgagagctccgttcctcaccatggactggacctggaggatcctcttcttggtggcagcagccacaggacgcccacctcccaggtcgcagcgtggtcgctacgtcgtggggctggagggtcgaaaggtaagccggtgggggcctcgacggtagaacggtcgtccgtgacgaaggtctttcgnggactaccaccttcgaccggcttaactaatactactacggtgggtacgcgaccgtagccccgtaggaaccgagggctttaggaggtacggagtcgggggaacgtagtaccgtaaaccgtaaaanaagttgggtcgacctaacttcgttacggttaactcggaacctaacggaacgttaaaccttttccgggaacgggtaaccggtaaccggggtttaccaaaccgtaacgtaccgggtaaccgggtaaacggacccggttaaaccgttacccgaaactaccccgaaaaggtaccaaacggtaaccgttaacgtaacggtccgtaaccgtacgggtaacacggtaacggtccctaacgggaaccgtaacgtccgggaacacccgggtacgggtcttaccgttacgttcgtgggtacggcgtaaccggtacgtccgttaggtcggttaccggtaccgtacgggttaccggttactttccggaaccggg

SEQ ID NO: 1785 - DNA, 599 bp, Homo sapiens
  misc_feature: GYAE6OF02GEZDV.43.5.A05.1.454.CMB.1.raw
  modified_base (434)..(434): a, c, t, g, unknown or other
  misc_feature (434)..(434): n is a, c, g, or t
  modified_base (462)..(462): a, c, t, g, unknown or other
  misc_feature (462)..(462): n is a, c, g, or t
  modified_base (518)..(518): a, c, t, g, unknown or other
  misc_feature (518)..(518): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctgaggtgaagaagccgtggggcctcgagtgaaggtctcctgcaaggcttctggatacaccttcaccggtctactataatacacgtgggtgacgacgacggccccgtggacgaagggcttggaggtggagtgggacgatacgaaccctaaacacgtggtacgccacttctagtactgacacgtaacgtaactttcgaaggacgtacgggtaccacagtcgaaccgagggacacgtacanacaacacaggactacgagtcgactgacncgacgccctagacgtaccgagaaccgacgaccgggtcgttacgtttagtttaccgnggtacgtacggacgttaaccgttaccgttaagttccggttacgggtacccgtagggtaccgggttacgtttcggtaaccgg

SEQ ID NO: 1786 - DNA, 634 bp, Homo sapiens
  misc_feature: GYAE6OF02F0UC1.43.5.A05.1.454.CMB.1.raw
  modified_base (353)..(353): a, c, t, g, unknown or other
  misc_feature (353)..(353): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccgaggtgcagctggtgcagtcgtggggctggagggtagaagaacggccgtggggcctcgagtgaaggtctcctgcaaggcttcgtggactacaccttcgaccggtctactatatacacgtgggtcgcgacacggcccgtaggacgaagggtcttggagtggagtgggacgagtacgaacctaanaagtgtcgccactcgtagtatacgacactagtaacttcgacggtacgacggtacacgagtcgaaccgacgggacctaccgtacctaataaccaacgtacgacgtacctacgagtaccggactaggacgtcgacgtccgtacgaaccgtacgaggaacccgtaacggaccgggttcttacgttacgttcgtggaccggtacggtagttacccggttccgttaggttcgggtacccgggtaacccgttaacggggttcgggttaaccgtttcggtaacccggg

SEQ ID NO: 1787 - DNA, 716 bp, Homo sapiens
  misc_feature: GYAE6OF02FVORL.43.5.A05.1.454.CMB.1.raw
  modified_base (503)..(503): a, c, t, g, unknown or other
  misc_feature (503)..(503): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtcgcagctggtgcagtcgtgggctgaggtgaagaagccgtgggcctcgagtgaaggtctctgcaaggcttcgtggatacaccttcgaccggtctactattactactacgtgggtcgacgacgacgggcccccgtgggaaccaaggggcttaggagtggagtggggacgtagtacgaaacctaacgaagtgggtacgtaccacgttcgtaggtaactcgaccaacgaaacgttaccgtttacgtacgggaactacggggttccaaccgtagtacggaaccggtacgggtaacctaacgtaccgtaactacgaaccaacgaaggaccttaanacggttcggaacttcggtaaccgacgacgtacccgtacgaaaccggtaaccgttcgaaaccgacgggtaccgggtacggtttaccttttacgtttaccgtgggtaccggtaccggtaaacggtaaccggtttacccgttaaggttccggggtttcccgggtaaacccggttaaccgggtttaccgggggttaaacctttcggttaaacccggg

SEQ ID NO: 1788 - DNA, 760 bp, Homo sapiens
  misc_feature: GYAE6OF02HUQ1S.43.5.A05.1.454.CMB.1.raw
  modified_base (702)..(702): a, c, t, g, unknown or other
  misc_feature (702)..(702): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggacgcccacctcccaggtgcacgctaggtgcagtccgtggggctggaggtcgaagaacggccgtaggggtcctaccgagtacggtaaggtcctaccgtgacctaaggtccgttcgtacggaacgtactacccgtttaccgaaccgggtaccttaaccgttaagtaccgttaaccgtaaccggttaggggtacgtacccggtaacggaccggtaccccccgtaggggtaacccgaaacggggtcctttaggaacgggttggaacggtttacgggaacggtacgtaccgaaaccgttaacgaagtcgggttacgacctacgtgttcgtaacgtcggactaacgtaacggttaacgttacggaggtaccgtaacgggtcctaacccggtagtaccggaaccgtaacgggactaaccgtacgactaaccgaacgtacgacggtacgtaaactcggttacggacttacggaacgtcgtacccgacgttacacggtcccgtaagacccgtagtacccgggtattccgttagttccgtaggtcgtaacgngttaacccttacgtggtacggttaaccgccgtaagggttacggtacttacgtaccggg

SEQ ID NO: 1789 - DNA, 742 bp, Homo sapiens
  misc_feature: GYAE6OF02JB553.43.5.A05.1.454.CMB.1.raw
  modified_base (194)..(194): a, c, t, g, unknown or other
  misc_feature (194)..(194): n is a, c, g, or t
tcagtgtgagtagtcacgaccggtgctcgatttagatagatagacagggggagcatcacccagcaaccacatctgtcctctagagaatcccctgagagctccgttcctcaccatggactggacctgggagatcctcttcgttggtggcagcagccacgaggacgcccactcccaggtgcagctggtgcagtcgngggctaggaggtgaagacgccgtgggctcgagtaggacgtctccgtcgagaacggtcttcgtaggacttaacctaccgttccgaccggttaccttaacgttaatactaacgcggttggggtcacgaccgacgggttacccccgtagggaaccgacggggttacttagggacggttagggtaacggtcgggggtaacgtaaccggttaaccgaaaaccccgttaaggtaacgttcgggttaccgacccgtacgttaccgttaggtaactacggacccttaacgtaacggttaccgtttaacggaggtaacggtacgggtaacccacgttacgtacggaaccggtacggacccgtaataccggaactaccgaaacgacgtaccgtacacggtacgtaacgcgtagaacgtcgacgtcgaacgacaccgtgaacgaccggttaacgtccgtttagttacgtcggttacgacggtaccggagtttaacccgtaccgttaggtcccgggttaccgaccggttacgggttaggttaccgtttaccggtaacggg

SEQ ID NO: 1790 - DNA, 612 bp, Homo sapiens
  misc_feature: GYAE6OF02FN1XC.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggacgcccactccccaggtgcagctggtgcagtcgtgggctgaggtgaagaagccgtgggcctcgagtgaaggtctccgtgcgaagtcttcgtggactacgaccttcgaccggtactactatactacacgttgggtcgcgaacgacggccccgtaggaccgaagggtcttaggaggtaggaggtcgggacgagtacgaaccctaaagagtggtactccgactcgtagtatacgactaacacgtaacctttacgaacggtacgaggttaccaacgacgtacgaccgaacggacaccgtacacgtacaacgtacgacgctaacacgtacgacgtagacgtacgacgtccgtacgacgtaccgtacgacgtacgaccggtcgtactttagttctacggtgacgtaggtcgtaccgttagttcgtacggtacccgtaggtcggtacgttagtacccgg

SEQ ID NO: 1791 - DNA, 661 bp, Homo sapiens
  misc_feature: GYAE6OF02F0L30.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctgggaggatcctcttcttggtggcagcagccacaggagcccactcccaggtgcagctggtgcagtcgtggggctggagggtgaaggaagccgtgggggcctcgaggtgaagggttcctccgtgacgaaggtctttcgtggactacaccttcgaccggtctactatatactacgtgggtgaccgacgacgggtcccctagggaaccgaagggtcctttaggcggagttcggggaacggtagttacgaacccctaagagtcggtacgaccctacgttcgttagtagcggactaacgtacgtaaactttcgaacggtacgtacgggtaccacgtagacgaccgaacggacctaccgtaccaactccaacgaccgacgtactaacgacgtacgacgtagtacgcacgtacctacgacgtaccgtagaccgtacgacggtcgtacgtacgttcgtacgtagtacgacggtaccgttaccgttacgtcgggttaccggaccgtaccgggttacgggtaccgtttacggtacggttaacccggg

SEQ ID NO: 1792 - DNA, 652 bp, Homo sapiens
  misc_feature: GYAE6OF02IBVX5.43.5.A05.1.454.CMB.1.raw
  modified_base (287)..(287): a, c, t, g, unknown or other
  misc_feature (287)..(287): n is a, c, g, or t
  modified_base (357)..(357): a, c, t, g, unknown or other
  misc_feature (357)..(357): n is a, c, g, or t
  modified_base (581)..(581): a, c, t, g, unknown or other
  misc_feature (581)..(581): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagccgtggggcctcgagtgaacggtctctgcaaggtcttcgtgataccaccttcgaccggctacgtatatacacgtgggtnacgcacggtccccgagggaacacgggtcttacggagtgggagtgggaacggagtacggtaaacccctaanaaacgtacgggtgacccaacgttcgtagtactacgtcaaccgaacgtaccttttacgacgggtaccgtaacggggttcgaaacccgtacgtaccggtaaccgaaacgggaacgtaaccgttcccgaactaaccgtaacaaccgacggtcgtaacgtactacgggaacctgacggtcgacgtccacgagtaccgtagaaccgacggacggtcgtacttacttcgnggtgtacggtactaccggttaccgtagttcggtacgggtaccgtaacggtacgggttacttggtaaccggg

SEQ ID NO: 1793 - DNA, 793 bp, Homo sapiens
  misc_feature: GYAE6OF02JUKFF.43.5.A05.1.454.CMB.1.raw
tcagtgtgagtagtcacgaccggtgctcgatttagatagatagacagggggagcatcacccagcaaccacatctgtcctctagagaatccctgagagctccgttcctcacctatggactggacctggaggatcctcttcttggtggcagtcacgccacgaggacgcccactcccaagggttcgcgtaagccgtgggtcgactacggtcgtacgggggtctaggagggtacgaacgtaacggtccgtggggtaccctcgtaggtacgtaacggtcgtccgtgacaaggtccttctggactactaccgttacgacgggtacctacgtaacttacgtaaccgtcggtacgggtcgaccggtaacgccgggtaccccgttagggaaccggtaaggggttccttacgggacggttagggaacgaccggggtacgtacgtaccgtaaaccccgttaagtacggttaggggtacctaccgtaccgtaccggttgtaacgtagtacccgtaagtaaccgttaagtttacccgaagggaaccgttacgggaccctaacggtacggttacggtaaccggaccgggtaactccgggtaccaacgtacctaacggacggtacgtcctacggacgtcggtaacgtacggacgtacgtacgtacgtttaccgaagtacccggacgttaaccggaccggttacggccttagttaccgttacggcggttaacgacggttacggtacccgttacgttacggtacggttccggaacccttaggggtactttaccggttacgtaacccgggg

SEQ ID NO: 1794 - DNA, 646 bp, Homo sapiens
  misc_feature: GYAE6OF02FSEGP.43.5.A05.1.454.CMB.1.raw
  modified_base (177)..(177): a, c, t, g, unknown or other
  misc_feature (177)..(177): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatctcttcttggtggcagcagccacgaggacgcccactcccgaggtncagctggtgctagtcgtgggctgaggtagaagagcgtgggcctcagtgaagtctctagcacggcttctaggataccgtaccttacgaccggtactactaactatacctacgtgggtacgcgtaacggacggaccccgtaggtaccgacgggtacgttggacggtaggtagggtacgggaacggtcgtaacgtaaacccgtaagtacgtagggtaccgactacgttcgtggtactcgactacgtaagtaaccgtttcgacgggtaacgtacggtacaccgtagtccgaacgacggactaccgtacctacaacgtacacgtacgctaacgtacgtaccgcgtacgagtacgacctcgtacacggtaccgacgtaccggaccgtacggtcttacgttacgttacgtgtacggacgtcggtacttaccgtggtacgttccggtaccggtaggtacggttcgtacgtaaccggg

SEQ ID NO: 1795 - DNA, 606 bp, Homo sapiens
  misc_feature: GYAE6OF02GNXWV.43.5.A05.1.454.CMB.1.raw
  modified_base (165)..(165): a, c, t, g, unknown or other
  misc_feature (165)..(165): n is a, c, g, or t
  modified_base (299)..(299): a, c, t, g, unknown or other
  misc_feature (299)..(299): n is a, c, g, or t
  modified_base (399)..(399): a, c, t, g, unknown or other
  misc_feature (399)..(399): n is a, c, g, or t
tcagtgtgagtagtcacgaccggtgctcgatttagatagatagacagggggagcatcacccagccaaccacatctgtcctctagagaatcccctgagagctccgttcctcaccatggactggacctggaggatcctcttcttggtggcaaggcagccacgaggancccactcccaggtgcagctggtgcagtcgtggggctgaggtgaagagccgtggggcctcgagtagaggttctccgtgcgaaggtcttcgtaggactacctaccttcgaccggtctactatactacacgtgggtncgtacgacggccctaggacgaggtctgagtggagtgggtacgatacgaacctaacgagtggtcacctacgtgtgtacagtaccaacgtaataacgtttanacggtacgacggtaccacgagtacgaccggtagaccgtacgtccaataccaaccgaagacgtctaacgattacggaacctgacgaccacggtacctacacggtacaggtaaccgcgacggtacctattacgtcgtcgtcggacgtagtaccgttaccgttagttacggtaccggtaccggtaacggtcggttacgttcggtaaccgg

SEQ ID NO: 1796 - DNA, 770 bp, Homo sapiens
  misc_feature: GYAE6OF02GSB7D.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtgcagcagccacaggacgcccactcccaggtgccagctgggtgctagtcgtgggctggaggtgaaggaagccgtggggcctcgaggtaggaacgggtcctccgtaggacgtaacgggtccttcgtagggattaaccgtaccgtttaccgaaccgggtaccttaacttaattaacgtaaccgaccggttagggggtacgccgtaacggtacccggacccccggttagggaaccgtaaaggggtcgtttagggtaacgggttacgggaggttacgggggaccggtagtaaccgtaaaacccgtaaacgaagtcgggtacgacctcgttacgtagtactggacaacgtaaacgtaccttggaacgcggtaaggtcgaacctagaccggacgaacgggtaccacgactaacgaccaaacgtacgaacgtacctaaacgtcgtaacggtctaggacggactacggtacccacgtaacgacccgttaggacccgtaacgtaccgggtacgttaccgttttacgtcgttacggtccggaacggtaacccgtaccggttaccgttacggttaccgggtttacccgggaacccgtacccgggggtttacgggttaaccgtttcccggtaaacgggg

SEQ ID NO: 1797 - DNA, 785 bp, Homo sapiens
  misc_feature: GYAE6OF02J1XU7.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccactcccaggtcgcagctggtcgctaggtcgtcggggctaggaggtagaaggaagcgtcggggcctcgaggtgaacggtctccgtgacgtaggtcttcgtggaatacccgtacccttcgacccggtcttaacgtaacttactaccgtacggtgggtcgaccggaacgccggtaccccgtagggaacggtaacgggtcgtttacgggaggttgggacggtacggggacggtaacgttccggaaaacccgttaagtaacggttcgggaccgtaccggtacctttagtaccggttaagcggaactacggtaaacgttaaccgttcggaaacgggtaccgtaccggggttaccaaccgtacggttaccggaacgggaaccgggtaccgtaccgtacctaacgtaccgaactacggtacccggagtacgttaagccggtaacgtacggacgaccgtacgaccgtacgacgttacccgaagaccggtaccggacggtttaaccgttcgttacgtttaccggagtaccggggtaactaaccgggtccgtttacggttaccgggtttcccggttaaccggtacccgggttaacggggttaccgggtttacgtttacccggttaacgggg

SEQ ID NO: 1798 - DNA, 887 bp, Homo sapiens
  misc_feature: GYAE6OF02FYU8A.43.5.A05.1.454.CMB.1.raw
  modified_base (499)..(499): a, c, t, g, unknown or other
  misc_feature (499)..(499): n is a, c, g, or t
tcagtgtgagtagtcacgaccggtgctcgatttagatagatagacagggggagcatcacccagcaaccacatctgtcctctagagaatcccctgagagctccgttcctcaccatggactggacctgggaggatcctcttcttgggtggcaggcagccacgaggacgcccactcccgaggtgcgagtcgtgggtgactaggtcgtggggctaggaggtagaaggaacgccggtcgggtcctaggtagtaggtaaggtcctccgtacggacgtaacggtcctttcgtaggaacctaaccgtaccgtttaccgaaccggtaccttaaccgttaataagtaccgtacggttaggggtacacggtaaccggaaccggtccccgttaagggaaccgtaagggtccgtttagggacgttagggacggtaggggtaaccggtattaaccggaaaacccctaaggttaaacgtgggtaccggtcccttaacggtcttacggttaacgngaccgtaactaacggtttaaaccgtttacggaacggggtaacgtaccgggttacctaaaccggtacgtaccggtaaccggtaaaccgggggacccttaaccggtaacccgaaacgttaacccgaaaaacccgggttacgaaccgggtttaccttaaaccggtaaacgggacccggtttacccggtaaagggaaaccggtaccgtaacccggtaccgtttaaccgaaacccgggtaccggttaagaaaacccccgggtaaacggtaccgggggtaaccttttacgttaaccggttttcggtcggtaaccggtacggtaacggttacccgttacgttagttacccgggtccggttaacccgtaagggttcggttaccgtttagtaccggg

SEQ ID NO: 1799 - DNA, 649 bp, Homo sapiens
  misc_feature: GYAE6OF02G36QN.43.5.A05.1.454.CMB.1.raw
  modified_base (211)..(211): a, c, t, g, unknown or other
  misc_feature (211)..(211): n is a, c, g, or t
tcagtgtgagtagtcacgaccggtgctcgattttagatagatagactagggggtaggcagtcgaccccagcaacccacctatcgtgtcctctagagaatcccctgagagctccgttcctcaccatggactggacctggaggatccgtcttctttggtggcagcgagccaagaggagccccgacgtcccgaggtcgcagctggtgcagtcgngggctggacggtgaacgagtccgtcgggtccctcacgtagtaacggtctccgtgcgaaggtcctcgtgtactacctaccgtcgaccgtactaactatactactacgtggcgacgacgaccggtcccgtaggacgacggtcgtagaggtaggagtcgggacgacgtacgaacctaacgtagtcgtcgcctactcgtagtatcgacgtaactacgtaactacggaggacgtacgtaccacgtagacgaaccggacggtacctacgtaccgacgtaacaaccgtagacgtaccgtagaccgtacgtaccgaggaccgacaccgcctacgaacgtccgtacgaaccgaccgtacggtccttacgttacgttgacggtcggacgtaccgtccgttaccgtaggttcggacccgtaaccgtagggttccggttacgtagtaccg

SEQ ID NO: 1800 - DNA, 704 bp, Homo sapiens
  misc_feature: GYAE6OF02J1HEC.43.5.A05.1.454.CMB.1.raw
  modified_base (262)..(262): a, c, t, g, unknown or other
  misc_feature (262)..(262): n is a, c, g, or t
tcagtgtgagtagtcacgaccggtgctcgatttagatagatagacagggggagcatcacccagcaaccacatctgtcctctagagaactcccctgagagctccgttcctcaccatggactcggacctggaggatcctcttcgttggtggcaggcacgccacgaggacgccccaactcccaggtcgcagctggtcgcagtcgtgggctggaggtacgaagacgccgtgggcctcgaggtagacggtctcgtgacgagtctcgngactacctaccgttcgaccggtctaactataacgtactacggtggtcgcgaccgtcggccctaggacaagggtcgtacgaggtaggacgtcgggacgtacgacgtaacctaagcggtggtccgacttactcgtagtaacgtcacgtaacgtacggttaacttcggaaacggtacggtacggttaccaaccgagttaacggaaccggaaccggtaccgtaaccgtaccgtacgtaacccgaacgtaaccggttacgaaccctacggtaaccggtcgaaccggtacgtacggaccctacccggtccgtaacgaaccgtaccgtaccggaaccgaccggtaccgttacgttaccgttacgtcgttacggacgttacggtaccgttacgtaccgttcggtaccggtaccggtaccgttaacggtcgggtttaccacggttaaccgg

SEQ ID NO: 1801 - DNA, 647 bp, Homo sapiens
  misc_feature: GYAE6OF02JWRMD.43.5.A05.1.454.CMB.1.raw
  modified_base (193)..(193): a, c, t, g, unknown or other
  misc_feature (193)..(193): n is a, c, g, or t
  modified_base (202)..(202): a, c, t, g, unknown or other
  misc_feature (202)..(202): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (250)..(250): a, c, t, g, unknown or other
  misc_feature (250)..(250): n is a, c, g, or t
  modified_base (330)..(330): a, c, t, g, unknown or other
  misc_feature (330)..(330): n is a, c, g, or t
  modified_base (341)..(341): a, c, t, g, unknown or other
  misc_feature (341)..(341): n is a, c, g, or t
  modified_base (349)..(349): a, c, t, g, unknown or other
  misc_feature (349)..(349): n is a, c, g, or t
  modified_base (364)..(364): a, c, t, g, unknown or other
  misc_feature (364)..(364): n is a, c, g, or t
  modified_base (418)..(418): a, c, t, g, unknown or other
  misc_feature (418)..(418): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagcgtggtgctagtcgnggggctggnggtgaagagccgtgggctcaggtgaggtctctgnaggntgtggatacncttcgacggtctatatatactacgtggtcgcggacacggccccgtggacgagggtcctggaggtaggtcgagggacgtancgaaccctaanacgtggcncgtctctagtgtacncgaatacgtaactttcgaacggagcggtacgactcacggtaccgaacgggtacnccgtacaacttacgaactacgacgacctcgacgtacggacctggagacccgacgtaacgccgtaaccgtaccgtacggaacccgacggtaacccggggtctttaccttaccgttttagtccgggttaacgggtaccgtacgggtacccggtttacccgtacggttttacggggtaccggaaccccggtttacgggttacccgggtttccgggttaacgttaaccggggg

SEQ ID NO: 1802 - DNA, 773 bp, Homo sapiens
  misc_feature: GYAE6OF02GFN7I.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccagtggactggacctggaggatcctcttcgttggtggcagcagccacgaggacgcccacctcccgaggtgcagctggtgcaggtcgtgggctggaggtagaagaagccgtcggggcctcgagtggaaggtctcctggacgagtcttcgtaggactactaccgttccgaccggtactacgtatactacgacggtgggtcgacgacgaccgggccccgtaggaaccggtaaggggtcttacgggtacggtggacggttacggggacggtagtaccgtaaaccgtaacgaagtcggtacacctacgttactgtagtcgaccgtaacgtaacgttaaccgtttacgaacgggtaaccgtacggggttacccaaccgtacgtaaccggacccggaacggggaccctaccgtaccctaaccgtaaccaaccgaaccgaacgtacctaaccgtaggttacgaccgtacgaccgtaccgaccggtacctacggacgtacccgtacggaaccgtaccggtacgtaccgtttacgttacgtttacggtacggttacgggtacccggtacgggtaaccccgttcccgttttaacgggttacgggtttacccggggtaacccggtttaacccggggttaccgggggtttacccttttacggggttaaccccggg

SEQ ID NO: 1803 - DNA, 614 bp, Homo sapiens
  misc_feature: GYAE6OF02FTWHK.43.5.A05.1.454.CMB.1.raw
  modified_base (362)..(362): a, c, t, g, unknown or other
  misc_feature (362)..(362): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccaacaggacgcccactcccaggtgcagcgtggtgcagtcgtggggctggagggtgaaggaagccgttggggccttcgagtggaacggttctcctggcaaggcttctggactacaccttcaccggtctactatatacacgtggtgcggtacacggtccccgtggacgagggtcttggaggtggagtgggaacggagtacgaacccgtaanagtcggtcgcctaactcgtagtactcgacacgtacgtaactttcgaacggtacgtacgggtacacgtagtcggaaccgaggactacgtaccaactaccaaacgacgtacgactagactcggacctcggaagcgacgccgtcacggtacctacggacgaccgaacgtcgttattacttcgtcggtcggacgtacgtccgttccgttaggttccggtcggtacccgtacgggtcgggttaccgttggtacccgg

SEQ ID NO: 1804 - DNA, 579 bp, Homo sapiens
  misc_feature: GYAE6OF02IERZ5.43.5.A05.1.454.CMB.1.raw
  modified_base (219)..(219): a, c, t, g, unknown or other
  misc_feature (219)..(219): n is a, c, g, or t
  modified_base (352)..(352): a, c, t, g, unknown or other
  misc_feature (352)..(352): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagagccgtggggcctnagtgaaggtctcctgcaaggcttcgtggatacaccttcgaccggctactatacactacgtgggtgccgacacggccctggacaagggcttgagtgagtgggagagtgaacctagaagtgtgccactctagtanggacacaagtactttacgaggacgagggtacacagtacgacgaggactacgccaatcaacacgtaggactacgtactacggacctaggacgtcgaacgtcctacgaacgaccttacggaccgaacgaccgggtcgttacttacgtttccgtggtacgtcgaacgtaccgttccgtaagttcgggttacccggaccgtaacgggtcggggttaccttaggtaacccgg

SEQ ID NO: 1805 - DNA, 715 bp, Homo sapiens
  misc_feature: GYAE6OF02HFL2H.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggacgcccacctcccgaggtcgcagctggtgcgtagtcgtggggctggaggtagaagacgtccggtcggggcctcgagtaggaacggttctccgtgacgaaggtcttcgtggactacctaccgttacgaccggacttaactatactacgacggtggtcgacacgaccggtccccgtagggaacgtaacgggtcttaggacggtaggaggtacggggacggacgtaaccgtaaacctaaagtacgttcggcgtacctacgtacgttagtacgtacggactaacgtaacgttaacgttacgaacggtacggtacggtaccacgtacgtaaccggaacggacggtaaccgacgtacctaacgtaaccaacgtaacgacggtacctaagtaacgtcggaactaggacgtaccgtacgaccctacgacgtaccgtagaaccggtacgacgggttacctacttacgttcgtacggtaccggcgtaacggtccgttacccgttaaggttcccgggtaccgggaaccggttacgggttacggttacggttaccggttaacccggg

SEQ ID NO: 1806 - DNA, 696 bp, Homo sapiens
  misc_feature: GYAE6OF02GPXZZ.43.5.A05.1.454.CMB.1.raw
  modified_base (191)..(191): a, c, t, g, unknown or other
  misc_feature (191)..(191): n is a, c, g, or t
  modified_base (218)..(218): a, c, t, g, unknown or other
  misc_feature (218)..(218): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgnggggctgaggtgaagagccgtgggccngagtgagtctctgcagctgtgactacaccttcgaccgtctactatatacacgtggtcgcgacgacggtccccaggacgaagggtcttggacggtggacgttggggaccgtagtaccggtaaaccctaaacgtaagttggggtacctacccgtaccgttacgtttaggttagtaccggacctaaacggaccggtttaaaccgtttaccggaacgggtaaccggtaacggggttaccctaacccgacgttacccggaaacccggtaacggggtacccgtaaccggtaccctaacgaaccctaaacgaccggaaggtaccctaacgtacggttaccggaaccgtacggacgtacgacggtaccctacgactaacccgaggacccgtacggaccggttctacttacgttcgtcggcgtaccggtacgaccgttaccgttaggtccggttcggaacccgtcggtacggttcgttacgtaccgg

SEQ ID NO: 1807 - DNA, 679 bp, Homo sapiens
  misc_feature: GYAE6OF02GVI3F.43.5.A05.1.454.CMB.1.raw
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccgaggagggacagtcactctcacctgtggctccagcactggaactgtcaccagtggtcattactccctactggttccagtcagaagcctggccacggccccccggacactacggatttacgtgactacaaggacaaactaaaccttttccgtacggaccaacccgtcgaccccgactttcctctaacggtccttcccgtccgtttcgggggcctaaaacggtcctcggtacccgtcgtacccgtttccggggtacggtccggtcgaacgtcctaggaacgggtagtacggacgggtcgtagtacttagttacttgtacttgtctccgaccttgtcgactcgccgtacgttccggggtttccggcgggtacggtaccgtaggttaccggtacggtaccgttagggtcctacggacccgtaagggtccgtccgtacccccggtccgtccgtaccttccgttccggttcccctaccccgttccctacccttaccgttacccc

SEQ ID NO: 1808 - DNA, 938 bp, Homo sapiens
  misc_feature: GYAE6OF02JZZSH.43.5.A05.1.454.CMB.1.raw
tcagtgtgagtagtcacgaccggtgctcgatttagatagatagacagggggagcatcacccagcaaccacatctgtcctctagagaactcccctgagagctccgttcctcaccatggactggacctggaggactcctcttcgttgggtggcaggccagcctacgaggacgccccacgttccccgagggttcgccgacggtcggtcgggtcgccgtacggttccgggtggggtactagggtacgggtaagaaacgggtaaccgtccgggttaccgggtccttagacgggttaggtaacggtccgtttccggacgaacggacggttccgttcggtaggtaacttaccgtaccttaccggaaccggttaccttaaagttaacttacggtaacctgggggtcgttacggaaacgtccggtacccggttaccgtaggaaaccggggtacggtttccgtagggtagggtacgggtaccgggtaaggggtaaccttacggaaccggttaaaacctaggttaaacggttcggggttacccaaacggttacccttaagggttacgtaacggtaccctaaccgggaaacttttaaccggttaacggtttaccggaacgggttacggttaaaaccgggttccaaaacgttacggggttaccggaacgtaaccggggtaacttacccggttaaactcgttaaacccgaacgtaccgggaatttaccgaacgtaacgggttaccgaccgtacggttaaacgacccgttgacccggtttaaacaccgggtttaccaaaccggggttaacccgaggtttaaaccgggtctttaaaccggtttacgttagttccgggaacggtccgttaaccgtaccggttttacgaaccgggtttttcgggaacccgtttaacccgttagggtttaaccgggttccgttaggttaaacccggg

SEQ ID NO: 1809 - DNA, 574 bp, Homo sapiens
  misc_feature: GYAE6OF02FWY8G.43.5.A05.1.454.CMB.1.raw
  modified_base (161)..(161): a, c, t, g, unknown or other
  misc_feature (161)..(161): n is a, c, g, or t
  modified_base (477)..(477): a, c, t, g, unknown or other
  misc_feature (477)..(477): n is a, c, g, or t
  modified_base (517)..(517): a, c, t, g, unknown or other
  misc_feature (517)..(517): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggancccactcccaggtgcagctggtgcagtctggggctggaggtgaagaagccgtggggcctcagtgaacggtctcctgcaaggtcttctggatacaccttcaccggctactatatacactgggtagcgacgacggcccctggaactagggcttagacggtggagttggggacggtagtacgaaccctaaacgaagtggtacgccactctaggtactggacaacgagtaacctttcgacggtacgacgggtaccacctagtacgaaccgacgggacaccgtacactacaacacgagactacgagtcgactagagcgacncctacacgacctagacgacgacgggctacgttactcgtgngcgtaacgtctaccgtagtcggtaccggaccgtacgtcgggttacttacgtaaccgg

SEQ ID NO: 1810 - DNA, 719 bp, Homo sapiens
  misc_feature: GYAE6OF02H9Y2S.43.5.A05.1.454.CMB.1.raw
  modified_base (631)..(631): a, c, t, g, unknown or other
  misc_feature (631)..(631): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggagatcctcttcttggtggcagcagccacaggacgcccactcccaggtgcagctggtgcagtcgtggggctgaggtgaagacgcgtgggcctgagtgaggtctctgcaggcttcgtaggataccaccttccaccggtcctaactatactacacgtgggtcgccggacgaccggtccccgtaggaccgaaacgggtcgttaggaaggttgggtaaggtacggggaccggtaacgtacgtaaaacccccgtaaagaacgttacgggtacgtaccccgtaactttaccgttcgttaacgtacggacctaacgtaacggttaaaccttttcgaacggggtaaccgtaggggtaccgaaccctaagtacggaccgtaacgggaactaaccggtaccctaaacgtacccaaaccgacgtaacggtacctaacaacgttacggaccgtcgaacgacgacgtccctacgacggtaccgtaccggaaccgtaccggaccgggtaccgttacgtnttttccggagttccggaccgaaggtaccgtaccggttacgtcgggtcccggacccggttacggtaccgggttacgttacgtaaccggg

SEQ ID NO: 1811 - DNA, 744 bp, Homo sapiens
  misc_feature: GYAE6OF02JH232.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcgttggtggcagtcagccacaggacgcccacgtcccaggtcgcagctggtgcagtcgtggggactggtaggtagaaggaacgtccggtggggcccttacgaggtaggaacggttcctccgtggacgtaacggtcctttcggtaggtactacctacccgttaccgaccggtactaactatactacgacgtgggacgaccgacgtacgccccgtaggacgtagggtcttgggaggtaggtaggtagggcgtaactacggtaaccctaacgagttcgggtacaccgtacgttcgtacgtagtcgactaactacgttacttcggacgtaacggacgtaccgacctagtacggtaccgaacggtacctaccgtacaacgtaccgaaacgtacgtccgtaactaaccgtggtaccgtaccgaggtaccgaccgtacgtacccgtaccgaacgtacccggtaggaacccggtaaccggtccgggttcgtttacccggtcgttttacggtccgggtaacggtaccggtaccgttaacccggttacccgtttaaggttccgggttacccggtaccggtaaccggggtttacggttacggttaccgttaacccggg

SEQ ID NO: 1812 - DNA, 711 bp, Homo sapiens
  misc_feature: GYAE6OF02INF5H.43.5.A05.1.454.CMB.1.raw
  modified_base (188)..(188): a, c, t, g, unknown or other
  misc_feature (188)..(188): n is a, c, g, or t
  modified_base (294)..(294): a, c, t, g, unknown or other
  misc_feature (294)..(294): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggacgccctcactgactgtcgtccccgaggngggacagtcactctcacctgtcggctcagcactggactcgtcaccgagtgtctattactcctactcggttccagcagaacgccgtcggccgaccggccccccgganacgtgtactttatgactaacaacgacaaacctaacctttccgtacgacctacctcgacccgtacttcctacgacggtcccttccccgttccggtttacgggggaaccaaacgtccgtccggtcccgttaccgggttaccccggtttcggggtacgcccgtacgaccgtaccgtagggacggtagtcggaggtccgtagtaccttaacttacgtcgtcgttcggtccttaccggtaccttaacgtcgaccgttcggtcccgttccgggttttccggggtttccggggaccgggtaacgggtaccgttaaggttcccggaccgttaccgtacggtaccgaccggtaccgacggtccctacccggccccgttcggtccctacgttccttcccgttccccgaccctcctaccctacctacc

SEQ ID NO: 1813 - DNA, 806 bp, Homo sapiens
  misc_feature: GYAE6OF02GP155.43.5.A05.1.454.CMB.1.raw
tcagtgtgagtagtcacgaccggtgctcgatttagatagatagacagggctggcaccagggtcccttccaatatcagcaccatggcctggactcctctctttctgttcctcctctacttgctgcccagggtccaattcccaggctgtggtgactcgaggacgccctcacctgactgtcgtcccaggaggactagtcactcgtcacctgtggctccacgtcacgtaggaaccttgcctaccgtagtggtctaattacgtcccctaacgtcggttcgacgtcgaacgtaacgtacctcggaccaccgggaccccccgaactaccgtagtaccttttagtactaacggttaacaaaccgtacaaacctaaaccgtttccgtaacggtaactacccgtacggtacccccttaattaccgtaccgtacggtacccctttaccccgttaccggggtttaggggaacctaaaccgggttacccgttcgtaccccggttaccgttaaccccgggttttacggggtcccggcggtaacccgtacggtacgtttacgggaacggtacttacgggacgtacgtacggtaactacgttaaccgtcgtacgttccggtcctaccgtacgtcgtacgtacgtccgaccgttcggttccgggttttaccggacggtaccgggtaactacgggttacccgtcggttacctagggtaccgtaccggacgtaccggtacgtcccggttcccgtacccgggttactacccggttcgtttaccccggtcccgttacccggtaccccggttacacccgtttaacccg

SEQ ID NO: 1814 - DNA, 831 bp, Homo sapiens
  misc_feature: GYAE6OF02HPQI5.43.5.A05.1.454.CMB.1.raw
  modified_base (328)..(328): a, c, t, g, unknown or other
  misc_feature (328)..(328): n is a, c, g, or t
tcagtgtgagtagtcacgaccggtgctcgatttagatagatagacaggggggagcatcacccagcaaccacatctgtcctctagagaatcccctgagagctccgttcctcaccatggactggacctggagatcctcttcttggtgcagcagccacaggacgcccactccgaggtgcagctggtgacagtcgtggggctggaggtagaaggagccggtggggcctacgagtacggaacggtcctccgtagacgaacgggtctttccgtaggattaaccctaccctttaccggaccggtacttaactaattaactaccgaggttcgggtnaccggacgtaccggtaccccggtagggaaccgtaacggggtcgttaggaggttgggtaaggtacggggacggtaacgtaccggaaaacccctaagtaacggtcggtccgacttaccgttacgtagttacgtacgacctaactaaacgttaacgtttcggaacgggtaacgtacgggttaccgaaccgtaaagtaccggaaccggtaacggggacctaaccgtacaaaccgttaaccgaacgtaaccggaacggttactaaccggtaacgtacggtaacccgttacggacgaaccgttacccggtaacccgtacggtaaacccggtaccgtaacgggaaaccccggtacgggtaaaccgggttaccgtttacccgtttaaggtttccggttaacgggtacgttacccgggtaaggttaccccggttaaccggttggtttaacccggggtacccggaacccggtttaaccggggtttacgggttaccgttacgggttaacccggg

SEQ ID NO: 1815 - DNA, 773 bp, Homo sapiens
  misc_feature: GYAE6OF02F5FBY.43.5.A05.1.454.CMB.1.raw
  modified_base (188)..(188): a, c, t, g, unknown or other
  misc_feature (188)..(188): n is a, c, g, or t
  modified_base (192)..(192): a, c, t, g, unknown or other
  misc_feature (192)..(192): n is a, c, g, or t
  modified_base (603)..(603): a, c, t, g, unknown or other
  misc_feature (603)..(603): n is a, c, g, or t
  modified_base (704)..(704): a, c, t, g, unknown or other
  misc_feature (704)..(704): n is a, c, g, or t
tcagtgtgagtagtcacgaccggtgctcgatttagatagatagacagggggaggcgatcacccacgcaaccacatctgtcctctagagaatcccctgagagctccgttcctcaccgatgctggacctggaggagtcctcttcgttggtcggtcgagcacgccacgacggagcccactcccgaggtcgnacgngtggtgcagtcgtcggggctggacggtgtaaagaagtccgtggggccctacgaggtgtaacgggtcctacggtcgacggtaagtccgttcgttacgggacttaaccgtacccgttaccgaccggtaaccgttacttacttaagtaaccacgttacggggtcgtaccggtacgtacggtccccgtacggtaacggaacgggaccggtttcgaagggttcggtaaacggtcggggaccggtagttaccgaaccgtaaaacgtagttacgggtaacgcctaacgttccgtagttacgtagacctaggaacctaacttttcggaacggtacgtaacgggtactactacgtaccggaacgacgggttaaaccggaaccttcgtaacgtaccgaaagtacccggagtaacccgttanaaacggttccgaaccgttaccgggaacaccggtaaccgacgttacgaaccgtaacctcgggaacctaccggaacgggtcctaacggtttcctgttaccggnttacggaccgtaagttcccgtaagttcggttaacccggtcgtaggtaaccgtacggttcgttaaccggg

SEQ ID NO: 1816 - DNA, 747 bp, Homo sapiens
  misc_feature: GYAE6OF02F4JJ8.43.5.A05.1.454.CMB.1.raw
  modified_base (246)..(246): a, c, t, g, unknown or other
  misc_feature (246)..(246): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatccctcttcttggtggcagcagccacaggagcccactcccaggtgcagctggtgcagtctggggctggaggtgaagaagcctggggcctcagtgaaggtctcctgcaaggcttcnggatacaccttcaccggctactatatacactgggtgcggacacggccccgttggaacgaaggggtcttaggaggttgggagtaggggaccggattacggaaaccccgttaaaccgaaagttcgggtacggaccctaacgttacccgttagtatacggtccgaaccgtaaaggtaaaccttttacccggaaggggaacccgtaacgggggttaccaacccgaacgttaccggaaacccggaaccggggtaaacccaacccgggtaccctaacttacccgaaaacctaccggaaccggttacctaacgaacggtaccggacctacgggacgtaacgaccgtaccgtaccgtaaccgtacggtaaccgtaacggaccgtacgggtccgttaccgtttacgttccgtcggtaacggacgtaaccgggttaccgttacccgttaggttaccggtacccgggtaaccccggtaacgggtaccgggtttaccgttacggttaacccgg

SEQ ID NO: 1817 - DNA, 684 bp, Homo sapiens
  misc_feature: GYAE6OF02F6AMX.43.5.A05.1.454.CMB.1.raw
  modified_base (228)..(228): a, c, t, g, unknown or other
  misc_feature (228)..(228): n is a, c, g, or t
  modified_base (309)..(309): a, c, t, g, unknown or other
  misc_feature (309)..(309): n is a, c, g, or t
  modified_base (328)..(328): a, c, t, g, unknown or other
  misc_feature (328)..(328): n is a, c, g, or t
  modified_base (337)..(337): a, c, t, g, unknown or other
  misc_feature (337)..(337): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctgggcctcagtgaagtcnctgcaaggcttctggactacaccttcaccggtctactatatacactggtgcgacgacggcccctggacaagggctgagtgngtgggagatcgaacctaanaagtggtcnccactcgtagtactcgacacgaactaaccgtttacgaacgggacgaagggttaccaacctacgtacgacccggaacgggtaccgaacgtaccctaactaccgtaaaaccgacgtaacggtaccctaacgtacgtacgggtaaccctcggtaacgtaccgaaccgtcccgttaacgacggaacccttaacggaaccggaaacccggtacgggtcccgtttaacgtttacgtttaccgttggttacggaaccgttaacggtaaccggttacccgtttaagttccggggtttaaccggggtaccccttaaacccggggttcggggttaaccgttttaccgttaacccggg

SEQ ID NO: 1818 - DNA, 800 bp, Homo sapiens
  misc_feature: GYAE6OF02FLGBJ.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtcgtggggctggaggtagaagaagccggtaggggcctagagtaggaacggtctccgtagcgaacgggtcttcggtggacttaccacccgtttacgaccggtaccttaacgtaacttaactaaccgtacggttgggtagaccggaaccgtaccgggacccccgtagggaccggaacggggtcgtttaggaacggttacgggtaggtcggggacggtaagtaaccgaaacccgttaacgaacggttgggtcgtaccctagttacgtaggttacgtcggaactacgtaacgttaacctttacggaacgggtaaccggtacgggtaccgaaccgtacgtaccgggaaccggtaacgggtacctaaccgtacccgtaaccgtaaccgaaaccgtaccggtacggtaacctaacgttacggtaacgggtacccgagtaccgacggtacctaccgttacgaaccggtaccgtaacgggaccgtaacgggtaccgggttcttacgttacgtttaccggtcggttacggacgtaacggtaccgtttaacccggttacggttcgggttacccgggtaccccggtaagggtttaccgggtttaccggttaccgttaacccgggg

SEQ ID NO: 1819 - DNA, 689 bp, Homo sapiens
  misc_feature: GYAE6OF02GQAQY.43.5.A05.1.454.CMB.1.raw
  modified_base (238)..(238): a, c, t, g, unknown or other
  misc_feature (238)..(238): n is a, c, g, or t
  modified_base (251)..(251): a, c, t, g, unknown or other
  misc_feature (251)..(251): n is a, c, g, or t
  modified_base (365)..(365): a, c, t, g, unknown or other
  misc_feature (365)..(365): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacaggacgcccacctcccgaggtgcagcgtggtgcgagtcgtgggctggaggtgaagagccgtgggcctcgagtgaggtctcgngacaggtcttcgngatacctactccgaccgtctactatactacgtagtggcgacgacgcggcccgtaggacgaacggtgttggaggtggaggtcgggacggtagtaccgaaccctaagagttggccncctactcgtagtatgaacacgtaagttaccgttagacgtacgtacgtactacgtagaccgaacggaaggacccacgtacctaacaacaacgagtacgactacgacgtacggacctaggacctacgaccgtacctaccggaacggtacccgaacgaacccgggtaacggtccggggttaaccctttaccgttacggtttaccgttcgggtacggaccggttaaccgggttaccttaaccccgggttttaaggtccgggtttaaccccggggtaacccgtttaaaccgggggttcgggttttaccggttccgggttaaacccgggg

SEQ ID NO: 1820 - DNA, 699 bp, Homo sapiens
  misc_feature: GYAE6OF02GTZJO.43.5.A05.1.454.CMB.1.raw
  modified_base (187)..(187): a, c, t, g, unknown or other
  misc_feature (187)..(187): n is a, c, g, or t
  modified_base (309)..(309): a, c, t, g, unknown or other
  misc_feature (309)..(309): n is a, c, g, or t
tcagtgtgagtagtcacgaccggtgctcgatttagatagatagacagggggagcatcacccagcaaccacatctgtcctctagagaatcccctgagagctccgttcctcaccatggactgacctggaggatcctcttctggtgcgagcagccacgaggacgccccactcccgaggtgcgagctggtncgagtcgtgggctggaggtgaagagccgtgggtacctcgaagtaggaacggttcctccgtagacgaaggtcgttactgactacctaccttcgaccggtactactatacgtactacggtaggngtacgacgacggcccgtaggaaccggaggtctaggacggtaggacggtagggacggtacgtacgtaaaccctaaacgtaagtacgggtcgaacctaacgtcttagtacgtcgactaacgtaacgttaaccgttacggaacggtaacgtacggtacccgtacgtaacgtacggaaccggacgggaccgtaaccgccgtaaactacgaaacctacgaaccggtaacctaaccgtacgtacggtactcggacgtaccgaacgtccgtaacgacgaaccgacgacgtaccggtacggtcccgtagttacgttcgtacggtcgtaacggtacgtaccgtccggttagttccggtacggtacccggtaacgggtacggttcggtacggttaaccgg

SEQ ID NO: 1821 - DNA, 929 bp, Homo sapiens
  misc_feature: GYAE6OF02F0D0P.43.5.A05.1.454.CMB.1.raw
tcagtgtgagtagtcacgaccggtgctcgatttagatagatagacaggggctggcacccaggggtcccttccaatatcagcaccatggcctggactcctctctttctgttcctcctcaccttgctgcccagggtccaattcccgaggctgtggtgactcaggagccctcactgactgtcgtccccaggagggacagtcgactctcacctgtcggctccagcactggaactgtcaccagtcggtacatttactcccttagttcggttccacgtcaaggaacgcccgttcggcccgacccgggaccccccccgggtacaccgtacgtacgttttaatcgtaactaacgaaacggtacccaaaaccgttaaaaccgttttacccgtaccgggtaaaccgtaccccggttaccggacccccggttaacgttccgttaccggtaacccgggtccccgtttacccccggttcccgggtttacgggggggtaacccgtaaaacggttccgttacccggtacccccgttacccgggttaacccccgggtttttccgggggtaccggttccggggacccgtaacgggtcccgtttaacgggtaacgggtacggtaccgggtaacgggtcccgttaacgggtaacccttttaacggtttaccctacgggttcccgttttaccggccgttaccccgttaccgttaaccggtttcggtaacggttcccgggttcccggttacccggggttttaccgggggttttcccggggaccgggggttaaaccgggtaaccgttacgggttcccggtaacccggttccgggtaccggtaccggaccgtcccgggaccggttcccgtcccggtacccccgttcccggttaccccgtcgttaccccggttccgttaccccccggtccctcccgttaaccacccgttaccc

SEQ ID NO: 1822 - DNA, 904 bp, Homo sapiens
  misc_feature: GYAE6OF02FOL24.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggagcccactcccgaggtcgcacgctggtcgcgaggtcgtcgggcgtagagggtagaaagaacggcccggtacgggaccttcgtaacggttaggaacggttccttcccgaggccgtaacggttccttcgttacgggaactaacccgtaacccgtttacccgaccccgggtaccttaaccttaagttaacttaacccgtacgggttacggggttacgaacccgggtaccggtaacccgggacccccggttaggggtaaaacccggtaacgggggtccctttaagggtacggggtttacggggtaacggggttaacggggggtaaaccggtaaccggtttaaacccggaaaaaccccggttaaacttaacggttacgggggttccgtaaccccttaccggttaccgttaggtttaccgacgtaaccccgtaaacgttaaccggtttaaaccgtttaccggtaaacgggtaaccggaccgggttaaccctaaaccgttacggtaccccggaaacggaaccgggtaccgtaacccgggttacctaacctaaccggaaacgtaaccgtacggtaacctacgacggtaccgtacgtacgaccgtaccggactcccgtagacccggttactaccggggacaccgggtaccgttaccgttctttaccggttcgacgtcggaacggttacgtaccgtttcgtacggttacggtacccggtccggtaacggttcgggttacgttacgtaacccggg

SEQ ID NO: 1823 - DNA, 589 bp, Homo sapiens
  misc_feature: GYAE6OF02FL34T.43.5.A05.1.454.CMB.1.raw
  modified_base (414)..(414): a, c, t, g, unknown or other
  misc_feature (414)..(414): n is a, c, g, or t
tcagtgtgagtagtcacgaccggtgctcgatttagatagatagacaggggctggcaccaggggtcccttccaatatcagcaccatggcctggactcctctctttctgttcctcctcacttgctgcccagggtccaattcccaggctgtggtgactcaggagccctcactgactgtgtccccaggagggacagtcactctcacctgtggctccagcactggaactgtcaccagtggtcattatccctactggttccagcagaagcctggccaggcccccccggacacctgatttatgatacaagcaacaaactttcctggacacctcgcccgattctcaggctccctccttgggggcaaagctgccctcgaccctttcgggcgtcgcgagcctgaggatgaggctgactattacngtcttgctcgtacctatgactgcccgtgttaccggggttttcggcggggtacgggaccgtaacggttcgacccgttccgtagggtcctacggcccgtaacgggtcctcggccccccgttccggtccgtaccctccggttcgttccccccgcccttccccgtcctacccttacccg

SEQ ID NO: 1824 - DNA, 677 bp, Homo sapiens
  misc_feature: GYAE6OF02IK11I.43.5.A05.1.454.CMB.1.raw
  modified_base (154)..(154): a, c, t, g, unknown or other
  misc_feature (154)..(154): n is a, c, g, or t
  modified_base (163)..(163): a, c, t, g, unknown or other
  misc_feature (163)..(163): n is a, c, g, or t
  modified_base (185)..(185): a, c, t, g, unknown or other
  misc_feature (185)..(185): n is a, c, g, or t
  modified_base (257)..(257): a, c, t, g, unknown or other
  misc_feature (257)..(257): n is a, c, g, or t
  modified_base (398)..(398): a, c, t, g, unknown or other
  misc_feature (398)..(398): n is a, c, g, or t
  modified_base (415)..(415): a, c, t, g, unknown or other
  misc_feature (415)..(415): n is a, c, g, or t
  modified_base (550)..(550): a, c, t, g, unknown or other
  misc_feature (550)..(550): n is a, c, g, or t
tcagtgtgagtagtcacgaccggtgctcgatttagatagatagacagggggagcatcacccagcaaccacatctgtcctctagagaactcccctgagagctccgttcctcaccatggactggacctggaggatcctcttctggtgcagcagcanaggcgcccncctcccaggtcgcacggctggngcagtcgtgggctgaggtgaagagccgtcggggtcctacgaggtgaacggtccgtcctgacgtaggcttcgnggtaactcctaaccgttccgtaccgggacttacctaattactaccgtacgttcggggtcgcgtaccacggtccccgtggacgacggtacgtgtacggtgaggtacggggacgacgtacgtaaaaccgacgtagtggtaccnctacgtacgtggtaacngaacctacgtaaacggtacctttcggaaagtcgttacgggaccacccgtaagtcgaaccggtacggacgtacggtacccaagttacgacctaacgcgtaccaacgttcacggacgtacgagtaccagacccgtanaaccgtcgccggtaaaccacggccggtactttacgtacgttacctggtcggtacgaaccggttaccgttcgtcggttacggttaccggggaccttaaccggggtcggtttacttacggtaacccggg

SEQ ID NO: 1825 - DNA, 721 bp, Homo sapiens
  misc_feature: GYAE6OF02I8ET1.43.5.A05.1.454.CMB.1.raw
  modified_base (242)..(242): a, c, t, g, unknown or other
  misc_feature (242)..(242): n is a, c, g, or t
  modified_base (395)..(395): a, c, t, g, unknown or other
  misc_feature (395)..(395): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggactcctcttcgttggtggcgagcagccacaggacgcccactccccaggtgcagcctggtcgcagtccgtgggctggaggtgaagagccgtgggctacagtgacgtctctganaggcttcgtggataaccccgtttacaccggtctaactagtacttacaccggtggacgtcgaacgcggtcccgtggtaccgaggtcttcggaagtcggagtagggacgtaagtaccgtaactaacgtaagttggacacccgtaactcgtaaggntacgcctaactaaacgttaccgtttacgaacggacgtacggtaccgtaccgtaacgtacgaaacccggtacgggtacctaaccgggttacacgtaccgaacgacggtacgtacgttaccgaagttaccggaccgtaaccggagtaaccgtacccggaccgtaacccggtaccggtaaccgttaaaccggaccggaaaccggtacccggtacggtttaaccgtaccgtttacggttacggaccggttacgtaacgttacccggttaccgttacggttacggttcccgtaacccggttcggtacgggtttaccttacgtaaccccggg

SEQ ID NO: 1826 - DNA, 632 bp, Homo sapiens
  misc_feature: GYAE6OF02IG05Y.43.5.A05.1.454.CMB.1.raw
  modified_base (249)..(249): a, c, t, g, unknown or other
  misc_feature (249)..(249): n is a, c, g, or t
  modified_base (253)..(253): a, c, t, g, unknown or other
  misc_feature (253)..(253): n is a, c, g, or t
  modified_base (262)..(262): a, c, t, g, unknown or other
  misc_feature (262)..(262): n is a, c, g, or t
  modified_base (268)..(268): a, c, t, g, unknown or other
  misc_feature (268)..(268): n is a, c, g, or t
  modified_base (274)..(274): a, c, t, g, unknown or other
  misc_feature (274)..(274): n is a, c, g, or t
  modified_base (277)..(277): a, c, t, g, unknown or other
  misc_feature (277)..(277): n is a, c, g, or t
  modified_base (280)..(280): a, c, t, g, unknown or other
  misc_feature (280)..(280): n is a, c, g, or t
  modified_base (350)..(350): a, c, t, g, unknown or other
  misc_feature (350)..(350): n is a, c, g, or t
  modified_base (452)..(452): a, c, t, g, unknown or other
  misc_feature (452)..(452): n is a, c, g, or t
  modified_base (564)..(564): a, c, t, g, unknown or other
  misc_feature (564)..(564): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtggcagcagccacgaggagcccactcccgaggtgcagcgtggtgcagtcgtgggctgagggtgaaagagtccgtgggcctcgagtgaagtcctctgcaaggtcttnaggntaactcctnaccggnacatanacncgnggtgcgacacggccccgtaggacgacgggtattcggacgtaggtagtcgggaacggatacgaaacctaanaagtaggtcaccctaagcgttagtagttcgacgtactaaagtaaccgtttcgaacgtacggaggtacaacccagtccgaacgaacggaacacggttaccaanacgaaactacgagtaccgtaactacgtaccggaaaccgtgaacgccgtaacggaccctaacgccgtaaccgacggaaccggaccgtaaagggtcctacttagttttaccggngtcggaccgtacgtaccgtaaccgtacgttcgtaccgggtaaccctaggtcggttacgttacggtacg

SEQ ID NO: 1827 - DNA, 732 bp, Homo sapiens
  misc_feature: GYAE6OF02GXR6Y.43.5.A05.1.454.CMB.1.raw
  modified_base (400)..(400): a, c, t, g, unknown or other
  misc_feature (400)..(400): n is a, c, g, or t
  modified_base (671)..(671): a, c, t, g, unknown or other
  misc_feature (671)..(671): n is a, c, g, or t
tcagtgtgagtagtcacgaccggtgctcgatttagatagatagacagggggagcatcacccagcaaccacatctgtcctctagagaactcccctgagagcctccgttcctcacatggactggaccgtgggaggactcctcttcgttggtggacaggcagccaacgaggacgcccacctcccgaggtcgcgagcgtcggtagcgtaggtcggtggggtcgtaggagggtacgaaaggacggccggtcgggtacctgaggtagaacgggttcctcgtaggacgtacggtccgttcgtacggacgtaaccgtcccgttaccgaacccggtacttaacttaacgttacttacgacggtacgggtacgacgaaccggcccggacccgttacggaacgtaacggtnttaaggcggtaggacggtagggacgtaacgtaccggtaaacctaacgttacgtacgggttcaccggtacctttacggtgtacgacgtacaacgttataacggttcgaacgtagtaccggtaccacgtataccgacggaacccgggtacgactacgtaacacaaccgtaccgagtaccgtacgaccggtcgtaacgcgaacggttcaccgtaccgtaccgtactaaccgacggaaccgacgtaccggtcgttattacgttccgtaggtacgngtacggtacgttaccgtcgttacgtacggttaccgtacgggtacggttacgttagtaccgg

SEQ ID NO: 1828 - DNA, 773 bp, Homo sapiens
  misc_feature: GYAE6OF02GPHPL.43.5.A05.1.454.CMB.1.raw
tcagtgtgagtagtcacgaccggtgctcgatttagatagatagacagggggagcatcacccagcaaccacatctgtcctctagagaactcccctgagagctccgttcctcaccatggactggacctggagatccgtcttcttggtggcagcacggccactacgggacgcccctaacgtccccgaggttcgaccagtcggtaggttgcctaacggttccgtaggggtcctgggaaggtcgaaacggaacgtccgtcgggggtccctcgaggtacgaacgggttcctcccgttagccggtaaggtccttacggttacggacttaacccgtcctttaccggaaaccggtccgttaacttaatactaccgtaacggtggttcgaccggtacgtacgtcccgtaggactaacggtctacgaggtcggagttgggacgtacgttaacgaaaccctaagtacggtcgggtactaccgtacgttcgtacgttactacgactacgtaacggttaccttcggacggtaacggtacgtaaccgaccgtaagttacggaacgtacggaccctaacgtactacgtaacccgtagaaccgtacggtactaccgacggttcgtaaccggtacgacgtaccgtaccgtccgtacacgtaccggactaccggtaacggtccgttacgttaaccgttggtttaccgagtttaaccggaccggttacgtaacccgttccgtagttaccgggtcggtaccgtaacgggtttacgggtacttaccggtaaccgg

SEQ ID NO: 1829 - DNA, 669 bp, Homo sapiens
  misc_feature: GYAE6OF02IPXNO.43.5.A05.1.454.CMB.1.raw
  modified_base (179)..(179): a, c, t, g, unknown or other
  misc_feature (179)..(179): n is a, c, g, or t
  modified_base (434)..(434): a, c, t, g, unknown or other
  misc_feature (434)..(434): n is a, c, g, or t
  modified_base (589)..(589): a, c, t, g, unknown or other
  misc_feature (589)..(589): n is a, c, g, or t
tcagtgtgagtagtcacgaccggtgctcgatttagatagatagacagggggagcatcacccagcaaccacatctgtcctctagagaatcccctgagagctccgttcctcaccatggactggacctggagatcctcttcttggtggcagcagccacgaggacgcccactcccgaggtgcngctggtgcagtcgtggggctggaggtagaaagacgtccgtgggcctcgaggtggtaaggtcctccgtgacgaacggtccttacgtagggtactacccgtaccctttccgacccggtacttaacctattacgtaccacggttgggttacgacggaaccgaccgggccccttgggaaaccgaagggtcgttaggacggttggacgtggggaccgataccgtaaaaccctaagagtacggtacacctgttccgtagtntaggccaacgtagttacttacgagaccgtacggtacacccgtaagacgaccgtaacggacctaccgtaccgaacgttaaccaaccgaacgagtacgtacagtacgacgtacgagccgactccacgacgtacgtacggacgacggccggtaccttnttacgttcgttaggtccgtacgacggttcgtccgttagttcggttaccggaccgtacggtacggttaccgtcgttaacgg

SEQ ID NO: 1830 - DNA, 734 bp, Homo sapiens
  misc_feature: GYAE6OF02HAAO7.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtgcagcagccacaggacgcccactcccaggtgccagctggtgccaggtcgtggggctggaggtgaagacgccggtgggcctgaggtagaacggtcctccgtgacgtaaggtccttcgacggtaacttaccgacccgttaccgacccggacttacctaatactaacccgtacggttggggtacgaccggtaccgaccggggtacccccgttacgggaaccgggtaacggggttccttaacgggtaacggggttaccggggtaagggttaccggggggtaacgggtaactaacccgggtaaaaccccgttaaagtaacggtgggtacccgacctaacgttcggttagtagaccgaactaacgtacgtaaacgttggaacggtacgacggtacaaccgtagacggaaccgacggacctacgtacactaacgaaccagaacgtctagactacgacgtagcgacgcctacacgtcaaccgtgaaccgaccgtccggtcttaccgttatacgggtcgtaaccgtcgggacttacccgttcggttagtacgggttacccggtacctacgggggttaccggttacttaccggtaccggg

SEQ ID NO: 1831 - DNA, 612 bp, Homo sapiens
  misc_feature: GYAE6OF02GR24F.43.5.A05.1.454.CMB.1.raw
  modified_base (340)..(340): a, c, t, g, unknown or other
  misc_feature (340)..(340): n is a, c, g, or t
  modified_base (349)..(349): a, c, t, g, unknown or other
  misc_feature (349)..(349): n is a, c, g, or t
tcagtgtgagtagtcacgaccggtgctcgattttagatagatagacagggggagcatcacccagcaaccacatctgtcctctagagaatcccctgagagctccgttcctcaccatggactggacctggaggatcctcttcttggtggcagcagccacaggagcccactcccaggtgcagctggtgcagtctggggctgaggtgaagaagcctggggcctcagtgaaggtctcctgcaaggcttctggatacaccttcaccggctactatactacactgggtcgcgacgacggtccctggacgaagggcttgaggtggagtgggacgatacgaaccctaanagtggtacncctactcgtgtactcgcacgtagtaacttcgagtacgacggtacactagtacggaacgaagggacctaaccggtaccataccgaaacacgacggtaccttaacgacgtacggacctacggacgtaccgacgtccctaagaccgtaccgtgaacccggtacaccggggtacttcgtttactttacgtcggtgtacggaacgtaccgttaccgtagttcggttaccggaccccttaagggtcggggttacttacggtaaacccgg

SEQ ID NO: 1832 - DNA, 704 bp, Homo sapiens
  misc_feature: GYAE6OF02GL43X.43.5.A05.1.454.CMB.1.raw
tcagtgtgagtagtcacgaccggtgctcgatttagatagatagacagggggagcatcacccagcaaccacatctgtcctctagagaatcccctgagagctccgttcctcaccatggactggacctggaggatcctcttcttggtcggcagcacgccacaggacgcccactcccaggtgcagcgtggtgcgagtcgtggggctggaggtagaagacgccgtcgggcctagagtggaacggtctccgtgcgaaggtcttcgtggataccaccttccgaccggtctactatactacacgtggtcgacgacgacggcccctaggaccaagggtccttagaggtaggtagtcggggacgacgtacgtaacctaaacaagttggtacgacctacgttacgtagttacgtcgaccgtaacaacgttaaccgtttacgaacggtaccgagggtaccaccgtagtacggacccgaagggacctaccggtaccaagtaccaaacgacggaacgtaccgtaactacgtacggtaccgtaggacgaccgtaccgcccttaacgaccgttaacccgtagaacccggtaaaccggaccgggttccggttaactttcggtttacgtacggttcggacggtaacggttacccgttaccttagggttaccgggttcccgggtaaccctacggggttcgggttacgttccggtaacccgggg

SEQ ID NO: 1833 - DNA, 220 bp, Homo sapiens
  misc_feature: GYAE6OF01C9PN8.13.5.A05.1.454.CMB.1.raw
  modified_base (220)..(220): a, c, t, g, unknown or other
  misc_feature (220)..(220): n is a, c, g, or t
tcagtcacgtactacacgaccggtgctcgatttagatagatagacagggtggaggctgaggatgctgggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagn

SEQ ID NO: 1834 - DNA, 538 bp, Homo sapiens
  misc_feature: GYAE6OF01BOROT.13.5.A05.1.454.CMB.1.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttacngggcatctatccggaatccgggtcctgaccgattcagtggcagcgggtctgggacagtatttcactctcaccatcagcagcctgcaggctagaagatgtggctagtttattacgtgtacagactaattattaatagtacctcctccggagtcctcgtaccgtttcgggcgggaacggggtacccaaaggggttggaacgtaagtaccgaaaaggacgttaggtcgggtaccg

SEQ ID NO: 1835 - DNA, 496 bp, Homo sapiens
  misc_feature: GYAE6OF01AS1JA.13.5.A05.1.454.CMB.1.raw
  modified_base (230)..(230): a, c, t, g, unknown or other
  misc_feature (230)..(230): n is a, c, g, or t
  modified_base (449)..(449): a, c, t, g, unknown or other
  misc_feature (449)..(449): n is a, c, g, or t
tcagtcacgtactacacgaccggtgctcgatttagatagatagacaggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtcctgaccgattcagtggcagcggtctgggacaggatttcactctcaccatcagcagcctgcaggctgaagatgtggcagtttattactgtcagcaatattatagtactcctcgaggctnactttcggcggagggacccaaggtggagtatcaaacgactgtggtcg

SEQ ID NO: 1836 - DNA, 268 bp, Homo sapiens
  misc_feature: GYAE6OF01EC9VE.13.5.A05.1.454.CMB.1.raw
  modified_base (262)..(268): a, c, t, g, unknown or other
  misc_feature (262)..(268): n is a, c, g, or t
tcagtcacgtactacacgaccggtgctcgatttagatagatagacagggagggccccgtaatggggcctggtggagggttcttctttgactgctggggccagggaaccctggtcaccgtctcctctgcctccaccaagggccaatcggtcttccccctggcgccctgctccaggagcacctccgagagcacagcggccctgggctgcctggtcaaggactacttcctagtacgtgactgagcgggctggcaaggcgcatagnnnnnnn

SEQ ID NO: 1837 - DNA, 495 bp, Homo sapiens
  misc_feature: GYAE6OF01DK4LI.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaaagctgctcatttactgggcatctatccgggaatccgggtcctgaccgattcagtgcagcggtctgggacagatttcactctcaccatcagcagcctgcaggctgaagatgtggcagtttattactgtcagcaatattatagtactcctccgaggctcacgtttcggcggagggaccaaggtggagatacaacgaactgtggcg

SEQ ID NO: 1838 - DNA, 522 bp, Homo sapiens
  misc_feature: GYAE6OF01EEWBR.13.5.A05.1.454.CMB.1.raw
  modified_base (304)..(304): a, c, t, g, unknown or other
  misc_feature (304)..(304): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctctaagctgctcatttacnggcatctatccgggaatccggggtcctgaccgattcagtggcagcggtctgggacagatttcactctcacatcagcagcctgcacggctagaagatggtgctagtttattactgtacagactaattattatagtactccgtccgaggtctcgtacgtttcgggacggtacgggaccgaagggtggaacgtagtaaccgaaacgtacgtggtcggtacg

SEQ ID NO: 1839 - DNA, 223 bp, Homo sapiens
  misc_feature: GYAE6OF01BBW5M.13.5.A05.1.454.CMB.1.raw
  modified_base (221)..(223): a, c, t, g, unknown or other
  misc_feature (221)..(223): n is a, c, g, or t
tcagtcacgtactacacgaccggtgctcgatttagatagatagacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnnn

SEQ ID NO: 1840 - DNA, 496 bp, Homo sapiens
  misc_feature: GYAE6OF01EODUU.13.5.A05.1.454.CMB.1.raw
  modified_base (459)..(459): a, c, t, g, unknown or other
  misc_feature (459)..(459): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactacctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtcctgaccgattcagtggcagcggtctgggacagatttcactctcaccatcagcagcctgcaggctgaagatgtggcagtttattactgtcagcaattattatagtactcctcgaggctcactttcggnggagggacaaggtggagtatacaaacgactgtggtcg

SEQ ID NO: 1841 - DNA, 502 bp, Homo sapiens
  misc_feature: GYAE6OF01AD4JB.13.5.A05.1.454.CMB.1.raw
  modified_base (231)..(231): a, c, t, g, unknown or other
  misc_feature (231)..(231): n is a, c, g, or t
  modified_base (398)..(398): a, c, t, g, unknown or other
  misc_feature (398)..(398): n is a, c, g, or t
  modified_base (403)..(403): a, c, t, g, unknown or other
  misc_feature (403)..(403): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccgggtcctgaccgattcagtgcagcggtctgggacagatttcactctcacatcagcagctgcaggctgaagangtgcngtttatactgtcagcaatattatagtactcctccgagctcacgtttcggaggtacgggaccaagggttgaacgtactacgaaaaccgacgtgtgtaccg

SEQ ID NO: 1842 - DNA, 221 bp, Homo sapiens
  misc_feature: GYAE6OF01AVA7A.13.5.A05.1.454.CMB.1.raw
  modified_base (221)..(221): a, c, t, g, unknown or other
  misc_feature (221)..(221): n is a, c, g, or t
tcagtcacgtactacacgaccggtgctcgatttagatagatagacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagn

SEQ ID NO: 1843 - DNA, 222 bp, Homo sapiens
  misc_feature: GYAE6OF01E3P40.13.5.A05.1.454.CMB.1.raw
  modified_base (221)..(222): a, c, t, g, unknown or other
  misc_feature (221)..(222): n is a, c, g, or t
tcagtcacgtactacacgaccggtgctcgatttagatagatagacagggtggaggctgaagatgttgggatttattattgcatgcaaggtgcactctggtctatgtggacgttcggccaagggaccaaggtggaaatcaaacgaactgtggctgcaccatctgtcttcatcttcccgccatctgatagtacgtgactgagcgggctggcaaggcgcatagnn

SEQ ID NO: 1844 - DNA, 225 bp, Homo sapiens
  misc_feature: GYAE6OF01DWBBC.13.5.A05.1.454.CMB.1.raw
  modified_base (221)..(225): a, c, t, g, unknown or other
  misc_feature (221)..(225): n is a, c, g, or t
tcagtcacgtactacacgaccggtgctcgatttagatagatagacagggtggaggctgaggatgctggggtctattactgcatgcaagctacacactggcctccgctcaccttcggccaagggacacgactggagatagaacgaactgtggctgcaccatctgtcttcatcttcccgcatctgatagtacgtgactgagcgggctggcaaggcgcagtagnnnnn

SEQ ID NO: 1845 - DNA, 496 bp, Homo sapiens
  misc_feature: GYAE6OF01EX9EP.13.5.A05.1.454.CMB.1.raw
  modified_base (231)..(231): a, c, t, g, unknown or other
  misc_feature (231)..(231): n is a, c, g, or t
  modified_base (402)..(402): a, c, t, g, unknown or other
  misc_feature (402)..(402): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaaacaataagaacttcttagcttggtaccagcagaaaccaggacagcctcctaagctgctcatttactggcatctatccgggaatccgggtcctgaccgattcagtggcagcggtctgggacagatttcactctcaccatcagcagcctgcaggctagaacgntgtggctagtttatactgtcagctaattattatagtactcctcgagctctacgtttcggacggaggaccaaggtgagatacaaagactgtgtcg

SEQ ID NO: 1846 - DNA, 565 bp, Homo sapiens
  misc_feature: GYAE6OF01AJZNG.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcaagaaaccaggacagcctcctaagctgctcatttactggcatctagtccgggaatccgggtcctgaccgtattcagtggcaggcggtcgtgggacagtatttcactctcacctatcagcagtcctgcgaggcgtagaagtgtggtgtctagttttacttacgtcgtacgagtaccgtaaattattaacgttacgtacccttccgtaccgggagttccgtaccgttaccggtttccgggacgggtacgggaccgtaagggtacggaagtacgtaacgaaacgtacgtggtcgtccg

SEQ ID NO: 1847 - DNA, 703 bp, Homo sapiens
  misc_feature: GYAE6OF01CIJG2.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaaacaataagaactttcttagcttggtaccagcaagaaacccaggacacgcctctaagctgctctatttactgggactatctacgtccgggaactccggggtccctggacccgtatttaccgaggttgggacacggtcgggtcgtagggacgtaggtacttttcaacgttcctaccaacctagttaccgaacgaccgacgtaccctaggaccgaagggtcctaaggaaacgtagttgggtacggtaccttaagttttaacgtttacgttagtaccgtaacgtaccgttaaatttacgtttaattaaccggttacccttacccggttaccggtaaccgggttccgttaccgttaacccggttttccgggggaccgggtaaacggggtaacccggtaagggttacgggtaacggttaaacgtaacccgtaaaaaccgggttaacgttgggttaccgggtaacccg

SEQ ID NO: 1848 - DNA, 562 bp, Homo sapiens
  misc_feature: GYAE6OF01ERHUB.13.5.A05.1.454.CMB.1.raw
  modified_base (360)..(360): a, c, t, g, unknown or other
  misc_feature (360)..(360): n is a, c, g, or t
tcagtcacgtactacacgaccggtgctcgatttagatagatagacaggggactgatcaggactcctcagttcaccttctcacaatgaggctccctgctcagctcctggggctgctaatgctctgggtctctggatccagtggggatattgtgatgactcagtctccactctccctgcccgtcacccctggagagccggcctccatctcctgcaggtctagtcagagcctcctgcatagaatggatatacctatttgattggtatctgcagaagccgagggcagtctccacactcctgatctattgggtctaagtcggcctccggggtcctgacaggttcaggtggcagtgatcgaggcanagtatttacactagaaatcagacagagtgggaggcgtaggaggtagttgggttttaggggttttattacgtgacgtagtgtacgaacgtctacgtaactaaacgttcgtacgtaccggtaccgtttccggcccgttacgggaaccctaaagggtacggtaagtaacgtaaccggaaacgtaacggttcggtcggtcgtacgg

SEQ ID NO: 1849 - DNA, 496 bp, Homo sapiens
  misc_feature: GYAE6OF01BUCEB.13.5.A05.1.454.CMB.1.raw
  modified_base (451)..(451): a, c, t, g, unknown or other
  misc_feature (451)..(451): n is a, c, g, or t
  modified_base (464)..(464): a, c, t, g, unknown or other
  misc_feature (464)..(464): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttacgtgggcatctagtccgggaatccgggtcctgaccgtattcgagtggcagcggtctgggacagtatttcactctcaccatcagcagctcgcaggctgaagatgtggctagtttattactgtcagactaatattatagtactcctcgngctcacgttcggnggaggcaggtgagtacacaaacgactgtgtcg

SEQ ID NO: 1850 - DNA, 503 bp, Homo sapiens
  misc_feature: GYAE6OF01C5VG0.13.5.A05.1.454.CMB.1.raw
  modified_base (307)..(307): a, c, t, g, unknown or other
  misc_feature (307)..(307): n is a, c, g, or t
  modified_base (386)..(386): a, c, t, g, unknown or other
  misc_feature (386)..(386): n is a, c, g, or t
  modified_base (388)..(388): a, c, t, g, unknown or other
  misc_feature (388)..(388): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcaagaaaccaggacagcctcctaagctgctcatttacngggcatctatccgggaatccggggtcctgaccgattcagtggcaggcggtctgggacagtatttcactctcaccatcancngcctgcagctagaagagtgtggctagtttattactgtcagataatattatacgtactcctccgagctcacgtttcggcggtaggaccgaggtggagagtacaaagactgtggacg

SEQ ID NO: 1851 - DNA, 565 bp, Homo sapiens
  misc_feature: GYAE6OF01BWYWD.13.5.A05.1.454.CMB.1.raw
  modified_base (232)..(232): a, c, t, g, unknown or other
  misc_feature (232)..(232): n is a, c, g, or t
  modified_base (401)..(401): a, c, t, g, unknown or other
  misc_feature (401)..(401): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctaccaaacaataagaacttcttaagcttggtaccagcaagaaaccaggacagcctactaagctgctctatttacgtggcatctagtccggaacgtcccgggtcctgaccgtattcgagtgcacggtcggtctagggactagtacttcactctacaccatcgacncacgcctgacagctagaagtgtgtgtactagtttattacgtgtacagtataattattactacgtactccgtacgtacgtccttacgtacggtttcggacgggtacgggtaacccgtaagggtaggaacgtaactaacggtaaaaccgtacgttggtcggtaccg

SEQ ID NO: 1852 - DNA, 223 bp, Homo sapiens; identical to SEQ ID NO: 1839
  misc_feature: GYAE6OF01B0XFA.13.5.A05.1.454.CMB.1.raw
  modified_base (221)..(223): a, c, t, g, unknown or other
  misc_feature (221)..(223): n is a, c, g, or t

SEQ ID NO: 1853 - DNA, 497 bp, Homo sapiens
  misc_feature: GYAE6OF01BJM7V.13.5.A05.1.454.CMB.1.raw
  modified_base (231)..(231): a, c, t, g, unknown or other
  misc_feature (231)..(231): n is a, c, g, or t
  modified_base (461)..(461): a, c, t, g, unknown or other
  misc_feature (461)..(461): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccggaatccgggtcctgaccgattcagtggcagcggtctgggacagattcactctcaccatcagcagcctgcagctagaagatggtgctagtttattacgtgtacagctaatattatagtactcctcgagtctcgtacgttcggnggacggcaggtggagatacgaaacgactggtggtcg

SEQ ID NO: 1854 - DNA, 508 bp, Homo sapiens
  misc_feature: GYAE6OF01C9WN3.13.5.A05.1.454.CMB.1.raw
  modified_base (357)..(357): a, c, t, g, unknown or other
  misc_feature (357)..(357): n is a, c, g, or t
tcagtcacgtactacacgaccggtgctcgatttagatagatagacagggggtgggtccaggaggcagaactctgggtgtctcaccatggcctggatccctctacttctcccctcctcactctctgcacagctctgaggcctcgtatgagctgacacagccactctcggtgtcagtgtccccaggacagacggccaggatcacctgctctgcagatgcattgccataacattttgcttattgctgtcagcagaaaccaggccaggccaggccaggcccctatacttcctgatataaaaagcattgaggggccctcagtgatccctgagcgattctctggctccatctcagggacaacngtcacgtgacatcagtggagtccaggcagaggacgaggctgactgtagtgactttcagcagacaacgagtcggacttccgtgtagttttcggaacggtagggaaccctaaacgtcgtaaccgtcctcggacgtcacggcccgaaggtcccg

SEQ ID NO: 1855 - DNA, 223 bp, Homo sapiens
  misc_feature: GYAE6OF01ADX1T.13.5.A05.1.454.CMB.1.raw
  modified_base (220)..(223): a, c, t, g, unknown or other
  misc_feature (220)..(223): n is a, c, g, or t
tcagtcacgtactacacgaccggtgctcgatttagatagatagacagggtggaggctgaggatgctggggtctattactgcatgcaagctacacactggcccccgctcaccttcggccaagggacacgactggagattaaacgaactgtggctgcaccatctgtcttcatcttcccgcatctgatagtacgtgactgagcgggctggcaaggcgcatagnnnn

SEQ ID NO: 1856 - DNA, 263 bp, Homo sapiens
  misc_feature: GYAE6OF01CRNQL.13.5.A05.1.454.CMB.1.raw
  modified_base (259)..(263): a, c, t, g, unknown or other
  misc_feature (259)..(263): n is a, c, g, or t
tcagtcacgtactacacgaccggtgctcgatttagatagatagacagggagggccccgtaatggggcctggtggagggttcttctttgactgctggggccagggaaccctggtcaccgtctcctctgcctccaccaaggcccatcggtcttcccctggcgccctgctccaggagcacctccgagagcacagcggccctgggctgcctggtcaaggctacttcctagtacgtgactgagcgggctggcaaggcgcatagnnnnn

SEQ ID NO: 1857 - DNA, 526 bp, Homo sapiens
  misc_feature: GYAE6OF01DZY6N.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatcccggggtccctgaccgtattcagtggcaggcgggtctgggacagatttcactctcaccatcagcagcctgcaggctagaagtatgtggtctaggtttattactgtcagcaattattatagtactcctccgagtcctctacgtttcggacgggacgggaccgaagggtgaacgtacgtaaccaaacgaacgttggtggtacg

SEQ ID NO: 1858 - DNA, 524 bp, Homo sapiens
  misc_feature: GYAE6OF01ADW58.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctctaagctgctcatttactggcatctagtccgggaatccgggtcctgaccgattcagtggcaggcggtctgggacagtatttcactctcaccatcacgcacgtcctgcaggctgaagtgtgtgtactagtttactacgtgtactagactaattatttaatagttacctcctcgagtcctacgtcgttcggacggacgggtaccgaagggtcgagtactacgaaacgtactggtcgtcg

SEQ ID NO: 1859 - DNA, 531 bp, Homo sapiens
  misc_feature: GYAE6OF01BV29G.13.5.A05.1.454.CMB.1.raw
  modified_base (306)..(306): a, c, t, g, unknown or other
  misc_feature (306)..(306): n is a, c, g, or t
  modified_base (360)..(360): a, c, t, g, unknown or other
  misc_feature (360)..(360): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttacngggcatctatccggaatccgggtcctgaccgattcagtgcagcggtctgggacngatttcactctcaccatcagcagcctgcaggctgaagatgtgctagtttactagtgtacagctaattattatagtactccgtaccgagtcctacgtaccgtttcgggacggtagggtacccgaaagggtcggaacgtagttaaccgaaaacggaaccgttggtcggtaccg

SEQ ID NO: 1860 - DNA, 539 bp, Homo sapiens
  misc_feature: GYAE6OF01CTMMK.13.5.A05.1.454.CMB.1.raw
  modified_base (231)..(231): a, c, t, g, unknown or other
  misc_feature (231)..(231): n is a, c, g, or t
  modified_base (244)..(244): a, c, t, g, unknown or other
  misc_feature (244)..(244): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgacaagtccagccagagtgttttanacagctaccaaanaataagaacttctagtcttggtaccagtcaagaaaccaggacagcctcctaagctgctctatttactggcatctacgtccgggaatccgggtcctgaccgtattcagtgcaggcggtctgggacagtactttcactcgtacactatcagcacgcctgacgaggctacgaagtatgtgtactagtttattctgtacagtactaattattatacgtactaccgtcgtacgtctctaccgtttcgggacggacgggtacgaagggtcggagtactacgaaacgacgttggtcggtacg

SEQ ID NO: 1861 - DNA, 507 bp, Homo sapiens
  misc_feature: GYAE6OF01EEMUW.13.5.A05.1.454.CMB.1.raw
  modified_base (230)..(230): a, c, t, g, unknown or other
  misc_feature (230)..(230): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcatttactggcatctatccggaatccgggtcctgaccgatcagtgcagcggtctgggacagatttcactctcaccatcagcagctgcagctgaagatgtggctagtttattactgtcagtcaattagttaatagtactcctccgaggtcctacgtacgtttcggacggacgggaccgaaggtggaagatacaaaaccgactggtggtacg

SEQ ID NO: 1862 - DNA, 570 bp, Homo sapiens
  misc_feature: GYAE6OF01C0SEG.13.5.A05.1.454.CMB.1.raw
  modified_base (233)..(233): a, c, t, g, unknown or other
  misc_feature (233)..(233): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagacctccctggctgtgtctctgggcgagagggccaccatcaactgcaagtccagccagagttgttttanacagctaccaaacaaataagaacttcttagcttaggtaccagcaagaaaccaggacacgcctacctaagctgctctatttaccgtgggcatctagtccgggaagtcccggggtcctacgaccgtattccgaagtggcacggcgggtcgtggggactagtatttccgactctaccaccatcagcacgcctgcgaggctagaagagtgtggacttagtttatactgtacagactaattattaatacgtactccgtcgacgtcctacgtacgtttcgggacgggtaacgggaaccgaagggtggaagtaacgtaaccgaaaacgaacttggtcggtaccg

SEQ ID NO: 1863 - DNA, 552 bp, Homo sapiens
  misc_feature: GYAE6OF01EFRAG.13.5.A05.1.454.CMB.1.raw
  modified_base (319)..(319): a, c, t, g, unknown or other
  misc_feature (319)..(319): n is a, c, g, or t
  modified_base (347)..(347): a, c, t, g, unknown or other
  misc_feature (347)..(347): n is a, c, g, or t
  modified_base (408)..(408): a, c, t, g, unknown or other
  misc_feature (408)..(408): n is a, c, g, or t
tcagtcacgtactacacgaccggtgctcgatttagatagatagacagggggagctacaacaggcaggcaggggcagcaagatggtgttgcagacccaggtccttcatttctctgttgctctggatctcgtggtgcccgacggggacatcgtgatgacccagtctccagactccctggctgtgtctcgtgggcgagagggccaccatcaactgcaacgtccagccagtagttgttttatacagctaccaacaataaagaacttcttagcttggtaccagacaagaaaccaggacagcctacctaagcttgctctatttcngggcatctatccgggaatcccgggtccngaccgtattcagtggcagcgggtctgggacagtattcactctcaccatcagcacgcctgcnggctgaagacgtgtgtacttagtttacttacgtgtcagactaattattatacgttactcccgtacgacgtcctacgtacgtttcgggcgggtaacgggaccgaagggtacggagtaactaacggaaacgtaacgtgtggtaccg

SEQ ID NO: 1864 - DNA, 734 bp, Homo sapiens
  misc_feature: GYAE6OF01EMZ62.13.5.A05.1.454.CMB.1.raw
  modified_base (312)..(312): a, c, t, g, unknown or other
  misc_feature (312)..(312): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaacaataagaacttcttagcttggtaccagcaagaaaccaggacagcctacctaagctgctctatttacgnggcatctacgtccgggaatcccggggtcctagaccgtattccgaggtcggcgacgggtccgggtacgtacgggactagttacgttttaccaccgttccttaccaaccctacgttaccgaacggtcctaacggtcccgttaggaccgtaagggtacccttaagggaaacggtagttacggggttacggtaccgtttaagggtttttaactttacgtacggttaccgtaacgtacgttaaaagtttattttaaacgttaacgttaacccttacccggttaccggtaacgggtttcctaacccggtttaaccggttttacccgggggaacgggtaaccgggggtaaacccgtaaagggggttaaccgggtaaacgtaaccgttaacccggaaaaaccgggttaccgtttgggtacggttaacccg

SEQ ID NO: 1865 - DNA, 222 bp, Homo sapiens
  misc_feature: GYAE6OF01ESQXB.13.5.A05.1.454.CMB.1.raw
  modified_base (221)..(222): a, c, t, g, unknown or other
  misc_feature (221)..(222): n is a, c, g, or t
tcagtcacgtactacacgaccggtgctcgatttagatagatagacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnn

SEQ ID NO: 1866 - DNA, 536 bp, Homo sapiens
  misc_feature: GYAE6OF01A7L8L.13.5.A05.1.454.CMB.1.raw
  modified_base (401)..(401): a, c, t, g, unknown or other
  misc_feature (401)..(401): n is a, c, g, or t
  modified_base (431)..(431): a, c, t, g, unknown or other
  misc_feature (431)..(431): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttaggtaccagcagaaaccaggacagcctctaagctgctcatttactggcatctatccgggaatcccgggtcctgaccgattcagtggcagcggtctgggacagactttcacttctcaccatcagcagcctgcagctagaagntgtgctagttattctgtcagactaaagttnttaatagttacctccgtccgaggtcctacgtacgtttccgggacgggtacgggaaccgtaagggtcgggaacgtacgtacggaaaaccgtacgtggtcggtaccg

SEQ ID NO: 1867 - DNA, 538 bp, Homo sapiens
  misc_feature: GYAE6OF01CB265.13.5.A05.1.454.CMB.1.raw
  modified_base (414)..(414): a, c, t, g, unknown or other
  misc_feature (414)..(414): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcaagaaaccaggacagcctacctaagctgctcatttactgggcatctagtccgggaatcccgggtcctgaccgattcgagtggcaggcggtcgtgggacaggtactttcgacttctcacctatcagcagcctgcaggctagaagntgtggctagtttactacgtgtacagctaattattagtacgtctccgtcgagtcttacgtacgtttcgggacggacgggtaccgaagggtcggaagtacgtacgaaacggtactggtcggtaccg

SEQ ID NO: 1868 - DNA, 593 bp, Homo sapiens
  misc_feature: GYAE6OF01DP9EY.13.5.A05.1.454.CMB.1.raw
tcagtcacgtactacacgaccggtgctcgatttagatagatagacaggggactgatcaggactcctcagttcaccttctcacaatgaggctccctgctcagctcctggggctgctaatgctctgggtctctggatccaggtggggatattgtgatgactcagtctccactctccctgcccgtccacccctggagacgcccggcctccatcctcctgcaggtctagtcagacgcctcctgcatagaaatggatatactatttggattggtatctgcagaagccgagggcacgtctaccaactaactctagacttcgttagttgggttactaacggtccgggtcccgttccggggtccctgacgtaggttcgaggtcggactaggtgactcgaggtcacgtagttactttaacgactaagaaactcgaagcgaaggtaggtggacggtcgtaggtaggtagtttgggtttaggggtttattacgtgactagtgtacacgtcttactactaacgtcgtcgtaccggtacgtttccgggcccgtagggaaccgtaaggtacggaagtacgtaacgaacgtacgtcggtgtcgtaccg

SEQ ID NO: 1869 - DNA, 499 bp, Homo sapiens
  misc_feature: GYAE6OF01C624L.13.5.A05.1.454.CMB.1.raw
  modified_base (231)..(231): a, c, t, g, unknown or other
  misc_feature (231)..(231): n is a, c, g, or t
  modified_base (305)..(305): a, c, t, g, unknown or other
  misc_feature (305)..(305): n is a, c, g, or t
  modified_base (391)..(391): a, c, t, g, unknown or other
  misc_feature (391)..(391): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttctagcttggtaccagcagaaaccaggacagcctcctaagctgctcatttacngggcatctatccgggaatccgggtcctgaccgattcagtggcagcgggtctgggacagatttcactctcaccatcagcagcctgcnggctgaagatgtggctagtttattactgtcagctaatattatagtactcctccgtagcctctacgtttcggcggaggccaagggtgagactacgaaaccgatgtggac

SEQ ID NO: 1870 - DNA, 580 bp, Homo sapiens
  misc_feature: GYAE6OF01BXZK8.13.5.A05.1.454.CMB.1.raw
  modified_base (235)..(235): a, c, t, g, unknown or other
  misc_feature (235)..(235): n is a, c, g, or t
  modified_base (316)..(316): a, c, t, g, unknown or other
  misc_feature (316)..(316): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgacaagtccagccagagttgttttanacagctaccaaacaataagtaacttctaagcttaggtaccagcaagaaccaggacacgcctactaagctgctctatttacnggacatctacgtcgggaactccggggtcctgaccgtattcgagtggcaggcggtgtagggactagtacttcgactcctacacctatcagcacgccgtgacctaggtacttaagagtcggtagtactagtttatacgtgtacgtaagtactaagttattacgttacgtaccctccgtaccgtagtcctacgtacggtttccgggacggtaacggaccggtaagggtcggaagtacgtaaccgaaacggtacgtggtcgtcgtacg

SEQ ID NO: 1871 - DNA, 221 bp, Homo sapiens
  misc_feature: GYAE6OF01CV96G.13.5.A05.1.454.CMB.1.raw
  modified_base (220)..(221): a, c, t, g, unknown or other
  misc_feature (220)..(221): n is a, c, g, or t
tcagtcacgtactacacgaccggtgctcgatttagatagatagacagggtggaggctgaggatgctggggtctattactgcatgcaagctacacactggcctccgctcaccttcggccaagggacacgactggagatagaacgaactgtggctgcaccatctgtcttcatcttcccgcatctgatagtacgtgactgagcgggctggcaaggcgcatagnn

SEQ ID NO: 1872 - DNA, 268 bp, Homo sapiens
  misc_feature: GYAE6OF01DDIIQ.13.5.A05.1.454.CMB.1.raw
  modified_base (262)..(268): a, c, t, g, unknown or other
  misc_feature (262)..(268): n is a, c, g, or t
tcagtcacgtactacacgaccggtgctcgatttagatagatagacagggagggccccgtaatggggcctggtggagggttcttctttgactgctggggccagggaaccctggtcaccgtctcctctgcctccaccaagggcccatcggtcttccccctggcgccctgctccaggagcacctccgagagcacagcggccctgggctgcctggtcaaggactacttcctagtacgtgactgagcgggctggcaaggcgcatagnnnnnnn

SEQ ID NO: 1873 - DNA, 269 bp, Homo sapiens
  misc_feature: GYAE6OF01ACDBZ.13.5.A05.1.454.CMB.1.raw
  modified_base (262)..(269): a, c, t, g, unknown or other
  misc_feature (262)..(269): n is a, c, g, or t
tcagtcacgtactacacgaccggtgctcgatttagatagatagacagggagggcccccgtaatggggcctggtggagggttcttctttgactgctggggccagggaaccctggtcaccgtctcctctgcctccaccaagggcccatcggtcttcccctggcgccctgctccaggagcacctccgagagcacagcggccctgggctgcctggtcaaggactacttcctagtacgtgactgagcgggctggcaaggcgcatagnnnnnnnn

SEQ ID NO: 1874 - DNA, 229 bp, Homo sapiens
  misc_feature: GYAE6OF01DXMT3.13.5.A05.1.454.CMB.1.raw
  modified_base (223)..(229): a, c, t, g, unknown or other
  misc_feature (223)..(229): n is a, c, g, or t
tcagtcacgtactacacgaccggtgctcgatttagatagatagacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactggagcgggctggcaaggcgacatagnnnnnnn

SEQ ID NO: 1875 - DNA, 800 bp, Homo sapiens
  misc_feature: GYAE6OF01EGFC8.13.5.A05.1.454.CMB.1.raw
  modified_base (235)..(235): a, c, t, g, unknown or other
  misc_feature (235)..(235): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgcaagtccagccagtagttgttttaanacagcctaccaaactaataaagtaactttcgttaacgtcgtttaggtaaccagacaaacgaaaacccgagggaccaacgcccttaccgtaaagcttacgaccttctaattttaccgtgggtacctaacgttaccgttaacggtacccggggtaaacgttccccgggggttacccttacggaaccccggtactttaccgaggttcggcgtaacgggtccggggttacgtacggggacgtaaggtacttttacccgaccgttccttaccaaccctaacgtaccgaacggtacctaccggtaccgtcggtaccggacgggtccttagggaaacggttagttcgggtacggttacgtttaaggttttaacttacgttacggtttaaccgtaacgtaacttaaagtttaacttttaagttaaccgttaccttacccggttaacccggacggttacccttaccggttacccggtttccgggggaaccgggtaacggggtaaaccggtaagggttaacgggaaacgtaacgttaaacccggtaaaacgaacggttccgggtcgggtaacccg

SEQ ID NO: 1876 - DNA, 621 bp, Homo sapiens
  misc_feature: GYAE6OF01BVG4Q.13.5.A05.1.454.CMB.1.raw
  modified_base (232)..(232): a, c, t, g, unknown or other
  misc_feature (232)..(232): n is a, c, g, or t
  modified_base (309)..(309): a, c, t, g, unknown or other
  misc_feature (309)..(309): n is a, c, g, or t
  modified_base (347)..(347): a, c, t, g, unknown or other
  misc_feature (347)..(347): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctaccaaacaataagaacttcttagcttggtaccagcaagaaccaggacagcctcctaagctgctcatttacnggcatcgtagtccgggaagtcccggggtcctgaccgtnttacgagtcggcaggtcgggtctaggggactagtactttcacgttctacaccattacacgcacgcctcggacgacggctaggaagtagtggtggtacgttagttttacgtttacgttgtacaagtactaaattagtttaacgttacgttaccttccgtaccggtacgtacccgttaccgtaccggttttccgggaccgggtacggggtaacccgtaacggggttaggaacggtaacgtaaccgtaaaaccggtaacgttcgggtcgggtacccg

SEQ ID NO: 1877 - DNA, 529 bp, Homo sapiens
  misc_feature: GYAE6OF01E1BNK.13.5.A05.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttcttagcttggtaccagcagaaaccaggacagcctcctaagctgctcatttacnggcatctatccgggaatccgggtccctggaccgatcagtggcagcggtcgtgggacagtatttcactctcaccatcagcacgctgcagctagaagagtgtgctagtttatactgtacagtctaattattattacgtactcctcgacgtctccgttacgtttcgggacggtacgggtaccgaagggtggaacgtacgtacgaaaacgtacgtggtaggtaccg

SEQ ID NO: 1878 - DNA, 666 bp, Homo sapiens
  misc_feature: GYAE6OF01DSE1B.13.5.A05.1.454.CMB.1.raw
  modified_base (232)..(232): a, c, t, g, unknown or other
  misc_feature (232)..(232): n is a, c, g, or t
  modified_base (244)..(244): a, c, t, g, unknown or other
  misc_feature (244)..(244): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctaccaanaataagaacttcttagcttaggtaccagacaacgaaaccgaggacacgacctacctaagcctgcctctatttacgtgggacatctacgtaccgggtaacgtcccggggtcctcgaccgtattacgaggttcggcgtagggtccgggttacgtcggggactaggtacttttccgaccttccgtaccaccctataccacgaccacgtcctaggaccgacggccgtaggaagtagtggttacggtacgttaagttttattacgttgtactaacgtactaattaatttaagttaacgttacccttcccgttacccggtacggtccttaccgttaccggtttaccggggaccggggtaacgggtaacccggaaaggggttacggtaaggtaacgtaaaccgaaaccggtaacgtgggtacggtaccg

SEQ ID NO: 1879 - DNA, 534 bp, Homo sapiens
  misc_feature: GYAE6OF01B30OV.13.5.A05.1.454.CMB.1.raw
  modified_base (529)..(529): a, c, t, g, unknown or other
  misc_feature (529)..(529): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctaccaacaataagaacttctagcttggtacagcagaaccaggacagcctcctaagctgctcatttactggctatctagtccgggaactccggggtccctgaccgtattcgaggtggacaggccgggtctgggacaggtactttcactctcaccatcagcagcctgcaggctagagagtgtgactagtttacttactgtacagctaattacttatacgtactccgtacgagtcctacgttacgttcgggaggtagggaaccgagggtaggagtaactacgaaacgtacgtggngtacg

SEQ ID NO: 1880 - DNA, 573 bp, Homo sapiens
  misc_feature: GYAE6OF01DW1IW.13.5.A05.1.454.CMB.1.raw
  modified_base (237)..(237): a, c, t, g, unknown or other
  misc_feature (237)..(237): n is a, c, g, or t
  modified_base (249)..(249): a, c, t, g, unknown or other
  misc_feature (249)..(249): n is a, c, g, or t
  modified_base (317)..(317): a, c, t, g, unknown or other
  misc_feature (317)..(317): n is a, c, g, or t
tcagtcacgtactacacgaccggtgctcgatttagatagatagacaggggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgacaagtccagccagtagttgttttanacagctaccaanaataagtaacttcttagcttggtaccagcaagaaaccaggacacgcctcctaagctgctctatttacnggctatctagtccgggtaacgtccgggtcctcgaccgtattcgaggtggacgtaggcgggtcgtgggactagtatttcactctcacctatcagcacgtccgtgcgaggcgtagaagtagtgtcgtacttagtttaattcgtcgtatagtactaattattactacgttacctccgtcgagtcctcgttacggttcgggacggtaacgggaccgtaagggtacggaacgtactaacggaaacgtacgtggtcggtacg

SEQ ID NO: 1881 - DNA, 624 bp, Homo sapiens
  misc_feature: GYAE6OF01C2YS8.13.5.A05.1.454.CMB.1.raw
  modified_base (233)..(233): a, c, t, g, unknown or other
  misc_feature (233)..(233): n is a, c, g, or t
  modified_base (245)..(245): a, c, t, g, unknown or other
  misc_feature (245)..(245): n is a, c, g, or t
  modified_base (274)..(274): a, c, t, g, unknown or other
  misc_feature (274)..(274): n is a, c, g, or t
  modified_base (309)..(309): a, c, t, g, unknown or other
  misc_feature (309)..(309): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgaagagggccaccatcaactgacaagtccagccagagtgttttanacagctccaaanaataagaacttctagcttggtaccagcanaaaccaggacagcctactaagctgctcagtttacngggcatctataccgggaatccgggtcctgaccgtatcgagtgcagcggtctagggacagtatttcgactctacacagtacagacagcctgaccaggtctagaacgtagtcgtcggactaggtttttaacgtacttacgtacgaacgtacgtaaattaagtttactaacgtttaccgtcccgttaccggaacggtaccgttaccgtaaccggtttttaccggggacggggtaaccggggtaaacccgaaacggggtttacggaaacggtaaacgttaaacccgaaaaccggttaaacgtcggtagggttaacccgg

SEQ ID NO: 1882 - DNA, 492 bp, Homo sapiens
  misc_feature: GYAE6OF01AUDQB.13.5.A05.1.454.CMB.1.raw
  modified_base (402)..(402): a, c, t, g, unknown or other
  misc_feature (402)..(402): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtcctgaccgattcagtggcagcgggtctgggacagatttcactctcaccatcagcagcctgcaggctgaagntgtgcagtttatactgtcagcaatattatagtactcctccgagctcacgtttcggcggaggccaaggtgagatacaaacgactgtggtcg

SEQ ID NO: 1883 - DNA, 522 bp, Homo sapiens
  misc_feature: GYAE6OF01EPYXR.13.5.A05.1.454.CMB.1.raw
  modified_base (232)..(232): a, c, t, g, unknown or other
  misc_feature (232)..(232): n is a, c, g, or t
tcagtcacgtactacacgaccggtgctcgatttagatagatagacaggggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaaacaataagaacttcttagtcttggtaccagacagaaaccaggaacagcctacctaacgctgctcattttacctggggtcagtctatcccgggaatccggggtaccctggacccgattccagttggcagcgggtctgggacaggatttcactctcaccatccagcagcctgcaggctgaagatgtggctagtttattactgtacagcaatattaatagtactcctcaggctacactttcggcggtagggccaaggtggagatacaaacgactagtggtcg

SEQ ID NO: 1884 - DNA, 537 bp, Homo sapiens
  misc_feature: GYAE6OF01AUV1Q.13.5.A05.1.454.CMB.1.raw
  modified_base (305)..(305): a, c, t, g, unknown or other
  misc_feature (305)..(305): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagaggccaccatcaactgcaagtccagccagagtgttttatacagctccaacaataagaacttcttagcttggtaccagcagaaaccaggacagcctcctaagctgctcatttacnggcatctatccgggaatcccgggtcctgaccgatcagtggcagcggtctgggacagtactttcactctcaccatcagcagcctgcgaggctagaacgagtggtggtctagttttaattactgtacagtctaattatttatagttacctccgtccgaggtcctcgtaccgtttcgggacggacgggaacccgaagggtgaagtacgtacgaaaacggtactgggtcggtaccg

SEQ ID NO: 1885 - DNA, 570 bp, Homo sapiens
  misc_feature: GYAE6OF01DOZ76.13.5.A05.1.454.CMB.1.raw
  modified_base (230)..(230): a, c, t, g, unknown or other
  misc_feature (230)..(230): n is a, c, g, or t
  modified_base (362)..(362): a, c, t, g, unknown or other
  misc_feature (362)..(362): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacgggacatcgtgatgacccagtctccagactccctggctgtgtctcggggcgagagggccaccatcaactgcaagtccagccagagtgttttanacagctaccaacaataagaacttcttagcttggtaccagacaagaaaccaggacagcctcctaaagctgctcatttactgggcatctagtccggaatccgggtccctgaccgtattcagtggcaggcggtcngggacagtatttcactctacacatcagcagcctgacaggtcgtagaacgtgtggtagacttagtttacttacgtgtacagtactaagttattacgtacgtaccttcgtaccgtacgtctacgtaccggtttcgggaccgggtaacgggaccggtaagggtacggaagtaacgttaacgtaaaacggtaagtcggtggtcgtaacccgg

SEQ ID NO: 1886 - DNA, 525 bp, Homo sapiens
  misc_feature: GYAE6OF01EDGSG.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactggcatctatccgggaatcccggggtcctgaccgtattccagtggcagcggtctgggacagtatttcgactcctcacctatcagcacgcctgcgacgctagaagtagtgtggcttagtttatactgtacagactaattattatacgtactcgtacgacgtctacttcgttcggacggacggacgtaaggtgaacgtactaacgaaagacgtgtcggtacg

SEQ ID NO: 1887 - DNA, 778 bp, Homo sapiens
  misc_feature: GYAE6OF01CQ5BL.13.5.A05.1.454.CMB.1.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (336)..(336): a, c, t, g, unknown or other
  misc_feature (336)..(336): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggacgggccaccatcaactgacaacgtccagccagtagttgttttanacagcctaccaaanaataacgtaacttcgtagtcttaggtaccagacaacgaaaccaggacacgcctacctaagctcgactacgtatttcgnggactatcgtacgtaccgggtaaccgtcccggggtcctacggtacccgtacgttcgacggttcggaccgtagggtccgggttacggtagggaacctaggttactttaccgaccgttcctaccacccgtaactaccgaacggcctacgacccgttcgaccggtaggtccgtaaggtaacggtagttcgggtagtaaccggtttaagttttaaccgttaacggttcgtaaccgtaacggttaacttaaagtttaacgtttaaacgttaacccgttacccgttaccccggttaaccggggtaccgttacccgtttaacccgttaaccggggttttacccgggggaacccgggggtaaaccgggtaacccgggtaaacggggttaccggtaaaggttaacccggtaacgtaaaaaccgggtacgggttacgggttcgggtaacccg

SEQ ID NO: 1888 - DNA, 223 bp, Homo sapiens; identical to SEQ ID NO: 1839
  misc_feature: GYAE6OF01A7TEC.13.5.A05.1.454.CMB.1.raw
  modified_base (221)..(223): a, c, t, g, unknown or other
  misc_feature (221)..(223): n is a, c, g, or t

SEQ ID NO: 1889 - DNA, 653 bp, Homo sapiens
  misc_feature: GYAE6OF01AH5H4.13.5.A05.1.454.CMB.1.raw
  modified_base (232)..(232): a, c, t, g, unknown or other
  misc_feature (232)..(232): n is a, c, g, or t
tcagtcacgtactacacgaccggtgctcgatttagatagatagacagggggtgggtccaggaggcagaactctgggtgtctcaccatggcctggatccctctacttctccccctcctcactctctgcacagctctgaggcctcgtatgagctgacacagccactctcggtgtcagtcgtccccaggacagacggccaggatcacctgctctgcagatgcattgccataactnttttgcttattgctgtcagcacgaaccaggccaggccaggcccacggcccctatacttcctagaacttaataaaaagtacagtttcggacggggtccccttgagtcggtactcccgtaggacgtcgtactttctaccgtcggtcctccctacgttccgtacggaaacgggtacaaacgtacggtacccgtacgtttacgaaccgtacgttaccgtaacggtcgggtaacgttacccgaaggaccgtagggaacggacggtaacgggtcgtacggtacgttaggtttagtcgttactttcgacgtacgaacgtaacgaacgtagtacgggtacttaccggtagttaccgtttacggacggtagggaacctaaacgtccggtacccgtacgtacgtacgacgtaaccgcccgtaagtccccgg

SEQ ID NO: 1890 - DNA, 704 bp, Homo sapiens
  misc_feature: GYAE6OF01CMUHT.13.5.A05.1.454.CMB.1.raw
  modified_base (190)..(190): a, c, t, g, unknown or other
  misc_feature (190)..(190): n is a, c, g, or t
  modified_base (242)..(242): a, c, t, g, unknown or other
  misc_feature (242)..(242): n is a, c, g, or t
  modified_base (247)..(247): a, c, t, g, unknown or other
  misc_feature (247)..(247): n is a, c, g, or t
  modified_base (414)..(414): a, c, t, g, unknown or other
  misc_feature (414)..(414): n is a, c, g, or t
  modified_base (478)..(478): a, c, t, g, unknown or other
  misc_feature (478)..(478): n is a, c, g, or t
  modified_base (485)..(485): a, c, t, g, unknown or other
  misc_feature (485)..(485): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatcgacccagtcctccagacctccctggctgtgtctcgngggcgaggacggccacatacaactgacaagccagccaagtagttgttttaanacganctaaccaactaaataaacgtactttcgtaacgtcgttacggtaaccagaccaaagaaaccgtaggaacacgacccgtactaagctcgtacctactaactttccgaggactacgttacgtacggtaccgggtaacggtcccgggtaccctaggacctagtttaccggnggtaccggacggaccggtcgggtagtacgggacttagtactttcacttcctacgactagacganaccgtanccgtagacgagacgtaggaagtacgtggtcgatttaagttaccgtgtcgtaagagtaacttaagttacttaacgtaaccgttacctacggtaaccgtacgttaccgttacccggtaaccggggtttaccgggaacggggtaaccgggtacccggtaaaaggggtggtaaaccctaaaccgggttaaacccgaaaggttaccgttggggacccgttaccg

SEQ ID NO: 1891 - DNA, 552 bp, Homo sapiens
  misc_feature: GYAE6OF01C2VHJ.13.5.A05.1.454.CMB.1.raw
  modified_base (232)..(232): a, c, t, g, unknown or other
  misc_feature (232)..(232): n is a, c, g, or t
  modified_base (307)..(307): a, c, t, g, unknown or other
  misc_feature (307)..(307): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctccaaacaataagaacttctagcttggtaccagcagaaaccaggacagcctcctaagctgctcatttacnggactatctatccgggaatccgggtcctgaccgattcagtggcagcggtctgggacagtatttcactctacacatacagcagcctgcaggctagaacgatgtgtctaagttttatacgtgtacaagactaaattatttactaaggttacctccgtaccgacggtcctcgtaccgtttcgggacggtaacgggtaacccgaagggtacgaacggtaactaaccgtaaaggtaacgtggtggtaccg

SEQ ID NO: 1892 - DNA, 633 bp, Homo sapiens
  misc_feature: GYAE6OF01B4ZAG.13.5.A05.1.454.CMB.1.raw
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatgacccagtctccagactccctggctgtgtctcgtgggcgagcgggccaccatcaactgacaagtccagccagagttgtttanacagcctaccaaanaataagaacttcttagcttaggtaccagcgaacgaaaccgaggacngtacctactaacgctgctctactttacgtggacatacgtacgtccgggtaacgtcccgggtacctggaccgacttcgacggtcgcgtacggcggtcgtgggacctaggtactttccgactccgtacacctatccagcacgccgtgcgaggcgtagagagtcgtagtacgttagtttacgtcgtgtacagtacttaattagttaactaccgttaccgttcccgtacggtacgtccgttaccgttaccggttacggggaccgggtaacggggtaaccggtaaggggtacgggtaacgtaacgttaaccggaaaacggtccggttagggtccgggtaaccgg

SEQ ID NO: 1893 - DNA, 697 bp, Homo sapiens
  misc_feature: GYAE6OF01C3ZJ1.13.5.A05.1.454.CMB.1.raw
  modified_base (245)..(245): a, c, t, g, unknown or other
  misc_feature (245)..(245): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgaggacgggcccaccataccaactgacaacgtccagccagtagttgttttanacagctaccaataataacgtaactttctagtcttggtaaccagacaacgaaaccgaggaccacgaccctacctaagcctgtcttactaatttcgcggactataccgtacggtaccgggtaaccgtcccgggtccctacggaaccgtactttacggacggttcggacgacgggtccgggttacgtaggggaacctaacggttacgtttaccaccgttccgtaccctaccaacgttaccgacgaccgtacgtcccgtagaccgtacggtacgtaggaaagtgtcggtacgtacgtttaagtttcttacgtcgtacgtaagtacttaaattacgttaactaccgttacctaccgtaccggtaacgtccttacgtccgggttaccgggacgggtaacggtaccggaaggggttcgaacgtaacgtaaaccgtaaccggtacgttgggtccgtaccg

SEQ ID NO: 1894 - DNA, 585 bp, Homo sapiens
  misc_feature: GYAE6OF01CXK99.13.5.A05.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttanacagcctaccaaacaataagaactttcttagcttggtaccagcaagaaaccaggaccagccctcctaagcctgctctatttacgnggctatctagtccgggaacgtcccggggtcctcgaccgattcgagtggcgaggccgggtctgggacaggtatttccacttctacgaccactctagcacgcctagcgtaggctagagtagtgtcgtatagtttacttcgtagtcgagtactatttaattattacgttacctccgttaccggacgtccgttaccgtaccgtttccggggaccggtaacggggtaaccgaagggttggaagtacgttaacaaacgtacgtggtcggtacg

SEQ ID NO: 1895 - DNA, 640 bp, Homo sapiens
  misc_feature: GYAE6OF01EEM35.13.5.A05.1.454.CMB.1.raw
  modified_base (404)..(404): a, c, t, g, unknown or other
  misc_feature (404)..(404): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgttttatacagcctaccaacaaataagaacttcttagcttggtaccagcaagaaaccaggacagcctacctaagctgctacatttactgggcatctagtccgggaatcccgggtcctgaccgtatcgagtggcgacggtcggtcgtgggacagtatttcactctccacatcagcagccngcaggctgaagagtgtggctagtttatacgttcgtcagtactaagttaactttaagtaacgttaccctacccgtacccggtaacggttaccgttaccgttacccggttttaccggggaaccgggggttaacccggggtaaacccgggtaaaaacgggggttcgggtaaaaacgggtaaccgttaaaacccggtaaaaacgggttaaacccggtttgggttaccgggttaaacccgg

SEQ ID NO: 1896 - DNA, 701 bp, Homo sapiens
  misc_feature: GYAE6OF01C0XAD.13.5.A05.1.454.CMB.1.raw
  modified_base (234)..(234): a, c, t, g, unknown or other
  misc_feature (234)..(234): n is a, c, g, or t
  modified_base (313)..(313): a, c, t, g, unknown or other
  misc_feature (313)..(313): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccacggggacatcgtgatgacccagtctccagactccctggctgtgtctctgggcgagagggccaccatcaactgacaagtccagccagagttgttttanacagctaccaaacaataagaacttctagtcttggtaccagcaagaaaccaggacagcctcctaagctgctctatttacnggcatctacgtaccgggtaacgtccgggtacctgaccgtattcgagtcggcacggcgggtctgggacagtatttcactctacacctatcacgcacgtcctgaccgtaggtctaggaacgtagttggtacggtaccgttaagtttttaaccgttacgttacgttacgaacggttacttaaagtttaactttaacgttaaccgtttacccgttacccggttaccccgggtaaacggttcccctttaaccggttaacccgggtttttacccggggggaaccgggttaaaccgggggtaaacccggttaaacggggggttaccggtaaacggttaaacccgttaaacccggaaaaccggggttaaaccgttaggggtccggggtaaaccccg

SEQ ID NO: 1897 - DNA, 562 bp, Homo sapiens
  misc_feature: GYAE6OF01DCL2W.13.5.A05.1.454.CMB.1.raw
  modified_base (234)..(234): a, c, t, g, unknown or other
  misc_feature (234)..(234): n is a, c, g, or t
  modified_base (248)..(248): a, c, t, g, unknown or other
  misc_feature (248)..(248): n is a, c, g, or t
  modified_base (323)..(323): a, c, t, g, unknown or other
  misc_feature (323)..(323): n is a, c, g, or t
  modified_base (364)..(364): a, c, t, g, unknown or other
  misc_feature (364)..(364): n is a, c, g, or t
  modified_base (405)..(405): a, c, t, g, unknown or other
  misc_feature (405)..(405): n is a, c, g, or t
  modified_base (411)..(411): a, c, t, g, unknown or other
  misc_feature (411)..(411): n is a, c, g, or t
  modified_base (431)..(431): a, c, t, g, unknown or other
  misc_feature (431)..(431): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgacaagtccagccagagttgttttaanacagcctaccaaanaaataacgaactttctagtcttaggtaccagcaagaaaccaggacacgcctacctaagctgcctacattttacgnggctatctagtccggaacgtcccgggtcctgaccgtattcngtggcaggcgggtctgggacagtactttcacttctcacctntcagcngccgtagcaggactagaagngtgtggtcttagttttatacgtcgtacagactaatattatacgtacctcctacgtagccttctacggttccggacgggtaacgggacgtaagggtaggaagtaactaaccgaaagtacgtggtcggtaccg

SEQ ID NO: 1898 - DNA, 530 bp, Homo sapiens
  misc_feature: GYAE6OF01A1HE7.13.5.A05.1.454.CMB.1.raw
  modified_base (526)..(526): a, c, t, g, unknown or other
  misc_feature (526)..(526): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccagacagcctcctaagctgctactatttactgggcatctagtccgggaatcccgggtcctgaccgattcgagtggcgagcgggtctgggacagtactttcactctcaccatcacgcacgccgtgcgaggctagaagtagtggtcggctagtttattactgtacagtactaatattatacgtactcctcgtacgctacgtacgttcgggacggacgggaccgtaaggtggacgtactacgaaacgactggngtcg

SEQ ID NO: 1899 - DNA, 639 bp, Homo sapiens
  misc_feature: GYAE6OF01EWIO4.13.5.A05.1.454.CMB.1.raw
  modified_base (238)..(238): a, c, t, g, unknown or other
  misc_feature (238)..(238): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatcgacccagtctccagactccctggctgtgtctctgggcgaggagggccaccatcaactgacaagtccagccagtagttgttttaanacagctaccaaacaataaacgtaacttcttagcttcggtaaccagacaagaaaccaggaccacgcctacctaagcctgcttactatttacgtggcaacttctagtccggggaagttcccggggtacctaggaccgtattcgaggtcgcgaggtccgggtacgtggggacaggtactttacgacttcctcgaacctatccgacgctacggccctgacgaggtctaggaaagtcgttgggtacgtcgttaagttttacttacgtcgtaccgaagtactaaatttacttaacgttaacgttacccttcccgacggttacggtaccttacgttacgggttccgggacgggtaacgggaaccgtaagggtggaacgtactaacggaaaacgtacggttgcggtacg

SEQ ID NO: 1900 - DNA, 265 bp, Homo sapiens
  misc_feature: GYAE6OF01DJMKG.13.5.A05.1.454.CMB.1.raw
  modified_base (262)..(265): a, c, t, g, unknown or other
  misc_feature (262)..(265): n is a, c, g, or t
tcagtcacgtactacacgaccggtgctcgatttagatagatagacagggagggcccccgtaatggggcctggtggagggttcttctttgactactggggccagggaaccctggtcaccgtctcctcagcctccaccaagggcccatcggtcttcccctggcaccctcctccaagagcacctctgggggcacagcggccctgggctgcctggtcaaggactacttcctagtacgtgactgagcgggctggcaaggcgcatagnnnn

SEQ ID NO: 1901 - DNA, 805 bp, Homo sapiens
  misc_feature: GYAE6OF01CWLIS.13.5.A05.1.454.CMB.1.raw
  modified_base (237)..(237): a, c, t, g, unknown or other
  misc_feature (237)..(237): n is a, c, g, or t
  modified_base (250)..(250): a, c, t, g, unknown or other
  misc_feature (250)..(250): n is a, c, g, or t
  modified_base (403)..(403): a, c, t, g, unknown or other
  misc_feature (403)..(403): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagacctccctggctgtgtctctgggcgagaggccaccatcgaactgacaagtccaagtccagtagttgttttanacagctaccaaanaataagaacttctagtcttaggtaccagacgaacgaaaccaaggaacacgaccctacctaaacgctgacttactaacgttttacgtcgggtactacgttactacgtaccggggtaacttcccggggttaccctacggtaaccgtatttaccgngttggccgtacggcgggttactagggactaggttaactttcccgtactccttaccaaccctacgttaccgacgtaccgacgtccttacggaccggtacggtaccgttaggaaacgtaagttcgggtaggttaccttaacgggttttttaacttacgtttaccgttacgaacgttaaccttaaaagtttaacttttacgtttaaaccgtttacccgtaccccgtttaacccggggacggttacccgtttacccgttaaaccgggtttttaacccggggacgggggaaaaccccgggttaaacggggtaaaacggggtttaaggggtaaacgttaaaccccgggtttaaaaccggtaaaaccccggttaaaccggggtttcgggtagggtttaaacccccgggg

SEQ ID NO: 1902 - DNA, 649 bp, Homo sapiens
  misc_feature: GYAE6OF01EVSLP.13.5.A05.1.454.CMB.1.raw
  modified_base (255)..(255): a, c, t, g, unknown or other
  misc_feature (255)..(255): n is a, c, g, or t
  modified_base (439)..(439): a, c, t, g, unknown or other
  misc_feature (439)..(439): n is a, c, g, or t
tcagtcacgtactacacgaccggtgctcgatttagatagatagacaggggactgatcaggactcctcagttcaccttctcacaatgaggctccctgctcagctccgtgggctgctaatgctgtggtctctggatccgaggtgggattagttgtgatgactcagtcctccactcctccctgaccccgtccaccccgtggacgacggcccgtcctctactcctcctgactagttctacgtacaacgtcctacgtacntcagtagacgtggccacctacctagttaggtagttcggttacggacaggacggccgacgacctaactccgacgacggtaccgtaacttaagtttacggtaagtcgtacgtacgaccggtacggggtacccgtccggggtacctaaggactacggtactcggacggtcggcgtagggtcgggtanaccggtctagtacgttactacacgtacgtaagaactcgagtacggtaggtaggacggtacgtaggaggttatggtttaggtcgttacttattaacgttagttacgtacgtagtagactacgtaccaacgtaccgtacgtccggtaccgttacgtacgtttccggacgtacgggtacacggtagtacggacgttagacgtacgtgagtcgg

SEQ ID NO: 1903 - DNA, 627 bp, Homo sapiens
  misc_feature: GYAE6OF01CFGDW.13.5.A05.1.454.CMB.1.raw
  modified_base (331)..(331): a, c, t, g, unknown or other
  misc_feature (331)..(331): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctttccagacctccctggctgtgtctcgtgggcgaggagggcccaccatcaactgcaagtccagccagtagttgttttatacagctaccaaacaaataaagtaactttctagtcttacggtaccagacaacgaaacccaggacacgccctacctaagctgctactatttacngggactactcgtacgtaccgggaaccgtcccggggtccctacggacccgtattcgaggtcggacgacgggccggggtccggactaggtactttccgactcctaccaccatcagcgacgcctgacgaggctagaagtagtggtcggtacttaagtttattaccgtgtacaacgtactaattattagtacgttacctcccgtacgacggtcctaccgttacggttccgggacgggtaacgggaaccggtagggtaggaacgtacgtaaaccgaaacgtaacgttggtcggtcgtaccg

SEQ ID NO: 1904 - DNA, 581 bp, Homo sapiens
  misc_feature: GYAE6OF01ED6SO.13.5.A05.1.454.CMB.1.raw
  modified_base (235)..(235): a, c, t, g, unknown or other
  misc_feature (235)..(235): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccaccatcaactgcaagtccagccagagttgttttaanacagcctaccaaacaaataaagaactttcttagctttggtaccagacaagaaaccaggacagccctcctaagctcgctcatttactgggcatctatccgggaatcccggggtcctcgaccgattcaggtggcaggcgggtctagggacaggtatttcgactctacacctatacagacacgccgtgcgaggctagaagagttgtggtcgtaagttttattacttgtacgtaagacgtaattaatttaattaacgtacctaccgtccgagtcccgttactaccgtttcgggacggacggggtaacgaacgggtaggacgtactacgaaaacgtacgtaggtggtaccg

SEQ ID NO: 1905 - DNA, 585 bp, Homo sapiens
  misc_feature: GYAE6OF01EL3JA.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatgacccagtctccagactccctggctgtgtctcgtgggcgaggacgggccaccatcaactgaccaacgtccagccagagttagtttatacagacctaccaaacaataacgtaacttcgttagcttaggtaccagacaagaaccgaggacacgcctacctaagctcgctactatttacgtggactatcgtagtaccgggaacgtcccgggtacctcggaccgtatacgaggtcgcgtacggcggtcgtagggactagtacttcgactctacacactcgacgctacgcgtagacgagctagagtagtggtacggattagtttattactgtactacgacgtaattattagtacgtcctacgtcgtacgtctacgtacggttacgggacggaacggtacgaagggtcggaagtacgtaacgaaagtacgtggcgtacg

SEQ ID NO: 1906 - DNA, 728 bp, Homo sapiens
  misc_feature: GYAE6OF01CIJ0W.13.5.A05.1.454.CMB.1.raw
  modified_base (244)..(244): a, c, t, g, unknown or other
  misc_feature (244)..(244): n is a, c, g, or t
  modified_base (258)..(258): a, c, t, g, unknown or other
  misc_feature (258)..(258): n is a, c, g, or t
  modified_base (342)..(342): a, c, t, g, unknown or other
  misc_feature (342)..(342): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgaggacgggccaccatacaactgacaagtccagaccagtagttgttttaanacagcctaccaaanaataagtaacttcttagtcttacggtaccaagcaaacgaaaccgaggaacacgaccctacctaagctcgctactaattttacgngggactacgtactacggtacccgggtaacgttcccggggtacccctgaaccgtagttcgaaggtcggaccggtaggtccggggttactacggggactagtacgttttaccaccgtttactaccaaccacgttacgacgaccgtacggtccgtacggaccgtacgggaccttagggaaggttagtacggttacgggttacttaacggttttaacttcggttaacgttacgacggtaaaccttaagttaacgtttaacgttaacgttacccgttacccgtacggtaccgtccgttaccgttaccggttaccggggacggggtaacgggtaaccggtaaggggtacggtaagtaccgtaaaccgtaaacggtacggttggtcggtaccg

SEQ ID NO: 1907 - DNA, 265 bp, Homo sapiens
  misc_feature: GYAE6OF01DVK2A.13.5.A05.1.454.CMB.1.raw
  modified_base (250)..(250): a, c, t, g, unknown or other
  misc_feature (250)..(250): n is a, c, g, or t
  modified_base (255)..(265): a, c, t, g, unknown or other
  misc_feature (255)..(265): n is a, c, g, or t
tcagtcacgtactacacgaccggtgctcgatttagatagatagacagggagggcccccgtaatggggcctggtggagggttcttctttgactgctggggccagggaaccctggtcaccgtctcctctgcctccaccaagggcccatcggtcttccccctggcgccctgctccaggagcacctcgagagcacagcggccctgggctgcctggtcaagactactcctagtacgactgagcgggctggcagcncatgnnnnnnnnnnn

SEQ ID NO: 1908 - DNA, 582 bp, Homo sapiens
  misc_feature: GYAE6OF01BAFUI.13.5.A05.1.454.CMB.1.raw
  modified_base (304)..(304): a, c, t, g, unknown or other
  misc_feature (304)..(304): n is a, c, g, or t
  modified_base (357)..(357): a, c, t, g, unknown or other
  misc_feature (357)..(357): n is a, c, g, or t
tcagtcacgtactacacgaccggtgctcgatttagatagatagacagggggagctacaacaggcaggcaggggcagcaagatggtgttgcagacccaggtcttcatttctctgttgctttggatctctggtgcccacggggacatcgtgatgacccagtctccagactccctggctgtgtctctggcgagagggccaccatcaactgcaagtccagccagagtgttttatacagctccaacaataagaacttcttagcttggaccagcagaaaccagacagccctctaagctgctctatttacnggcatctagtccggtaagtccggggtccctgacctattcagtgcagcgggtcngggacagtatttcactctccaccatcagcctacgccttgacgacggacgtagaacgtagttggtcggactaagttttacttacgtgtacgtaagactaaagtttaacgttaattacgttacctacccgttacggacggtaccttacgtaccgtttacgggccgggtaacgggaccgaagggttacggaaggtaactaccgaaacgtaagtcggttcggctaccgg

SEQ ID NO: 1909 - DNA, 774 bp, Homo sapiens
  misc_feature: GYAE6OF01A48UN.13.5.A05.1.454.CMB.1.raw
  modified_base (228)..(228): a, c, t, g, unknown or other
  misc_feature (228)..(228): n is a, c, g, or t
  modified_base (234)..(234): a, c, t, g, unknown or other
  misc_feature (234)..(234): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatgacccagtctccagactccctggctgtgtctctgggcgagacgggccaccatcaactgcaagtccagccagtagtnttttanacagctaccaactaataaagaactttcttagcttacggtaaccaggacaaacgaaacccgaggaaccacggtacccctaccgtaagccttagccttacgtattttacgtgggacctaattaccgttaacggtacccggggtaacgtccccgggggttccctacggtaacccgtagtttccgaggttacgggacgtaacgggtccggggttacgtacggggacctaaggtacgttttacccaaccgttcccgtacctaacccgtaactacgacgtaccgtaacggtcccttacgggacggtacgggtaccgttaaggtaaacggtcgttacgggtacggttacggtttaaggtttttaaacgttttaaccgttaggtttaccgacggttaactaaagtttaatttaacgttaacggttacccttcgtacccggtaacgggttccttaccggttaaccggtttccggggacgggtaacggggtaaccggtaaggggtggtaaacgtacgtaaaccggaaacggtaccgttgggtcggtaccg

SEQ ID NO: 1910 - DNA, 557 bp, Homo sapiens
  misc_feature: GYAE6OF01DB5LP.13.5.A05.1.454.CMB.1.raw
  modified_base (328)..(328): a, c, t, g, unknown or other
  misc_feature (328)..(328): n is a, c, g, or t
  modified_base (392)..(392): a, c, t, g, unknown or other
  misc_feature (392)..(392): n is a, c, g, or t
  modified_base (401)..(401): a, c, t, g, unknown or other
  misc_feature (401)..(401): n is a, c, g, or t
  modified_base (405)..(405): a, c, t, g, unknown or other
  misc_feature (405)..(405): n is a, c, g, or t
  modified_base (436)..(436): a, c, t, g, unknown or other
  misc_feature (436)..(436): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtcctccagactccctggctgtgtctcgtgggcgagagggccaccatcaactgacaagtccagccagagttgttttatacagcctaccaaactaataagtaacctttcttagtaccttaggtaaccagacaagaaaccaggacacgacctcctaagctgctctatttacgnggcatctacgtaccgggacgtccgggtcctggaccgtatcgagtggcaggtcggtcgtgggacngtactttcnctcncacatcagcagtcctgacgcgctagtaggtntggtcgtatagtttacttcgtagtgaatactattattattacgtactccgtccgagacttgtaccgttcgggacggacgggtacaagggtgaagtacgtaactaacgtacgtggtcgtcgg

SEQ ID NO: 1911 - DNA, 708 bp, Homo sapiens
  misc_feature: GYAE6OF01D45S7.13.5.A05.1.454.CMB.1.raw
  modified_base (236)..(236): a, c, t, g, unknown or other
  misc_feature (236)..(236): n is a, c, g, or t
  modified_base (348)..(348): a, c, t, g, unknown or other
  misc_feature (348)..(348): n is a, c, g, or t
  modified_base (538)..(538): a, c, t, g, unknown or other
  misc_feature (538)..(538): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacgggacatcgtgatgacccagtctccagactccctggctgtcgtctcgtgggcgaggacgggccaccatcaatgcaacgtccagccagtagttgttttanacagcctaccaaacaaataacgtaacttcgttagtcttcggtaaccacgacaaacgaaaccagggaaccacggtaccctaccgtaaggccttagccttaccgtatttaccgnggtctacttacgtacgtacccgggtaacgttccccggggtaccctcggacccgtagttcgaggtcggcgaacgggtcgggtacgtgggacgtaggtactttccgaaccttcctaccgtaaccctagtaccgacgtaccgacgtcccgttacggacgtacggtaccgttaggaaacgtcgtgggtacggtntttaagttttacttaacggtcgtacgaacgtaactaatttattaacgtaaccgttacccgtcctaccgggtacgttcccgttacgtaccgggtttaccgggacggggtaaccgggtaaccggtaagggtacgaagtacgtaaacgaaacggtacggttggtccggtaccg

SEQ ID NO: 1912 - DNA, 650 bp, Homo sapiens
  misc_feature: GYAE6OF01AH7WD.13.5.A05.1.454.CMB.1.raw
  modified_base (234)..(234): a, c, t, g, unknown or other
  misc_feature (234)..(234): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacgggggacatcgtgatcgacccagtctccagacctccctggctgtgtctcgtgggcgagacgggccaccgatcaactgacagtccacgcagagttntttacacacgtcctaccaaactaataacgtacttacttacgcgtttacggtaccagtacgaacgaaaccacggacacgccctacctagtactcgtcctactactttacgcggactactacgtacggtaccgggtacgtcccggggtcctacggtaccgtacgttacgacggcggtaccgacgggtaccggtacggtacgggacttacggtacctttaccgtacttaccgtacctactactccgagccgtacgccgtagccgtagtcgtagacgtgtggtacgtacgttatttacgtctggtacacgtattaagttattacgtagttaccctccgtacggacgtcctacgttaccggtacggacgggtacgggacgtaggtaggtacgaacggttacaacggtacgtggtacgtacc

SEQ ID NO: 1913 - DNA, 729 bp, Homo sapiens
  misc_feature: GYAE6OF01CSSX6.13.5.A05.1.454.CMB.1.raw
  modified_base (239)..(239): a, c, t, g, unknown or other
  misc_feature (239)..(239): n is a, c, g, or t
  modified_base (268)..(268): a, c, t, g, unknown or other
  misc_feature (268)..(268): n is a, c, g, or t
  modified_base (328)..(328): a, c, t, g, unknown or other
  misc_feature (328)..(328): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatgacccagtctccagactccctggctgtgtctcgtgggcgagacgggccacactcaactgacaacgtccagccgagtagtgttttanacagtctaccaaacaataagacttcgtancgttggaccagacgaagaaaccaggacacgtccctactaagctagcctcaattttaccgnggactatccttacgtaccgggtactcccggggtccctagaccgtagttcgagtcgggctacggcgggtctacgggacctagtacttcaccttcgtcaaccgataccgaacgaccgtaacggtcccgtaggaccgacgggtacgtaacgggtaaggtaacgttgggttacgggtaacgttttaacggtttttaacgttaaccggttcggtaacgtaaccgtaacgttaaatttaaactttaacgttaaacccgttacccgtttacccggtaaccggttacggtaaccccgttacggtttaacccgggtttaccggggaacggggttaaccgggaacccggttaacggggtaaggtaacgtaaacgttaaccgaaaacggtaacgtacgggttcggtaaccgg

SEQ ID NO: 1914 - DNA, 594 bp, Homo sapiens
  misc_feature: GYAE6OF01DS87P.13.5.A05.1.454.CMB.1.raw
  modified_base (187)..(187): a, c, t, g, unknown or other
  misc_feature (187)..(187): n is a, c, g, or t
  modified_base (242)..(242): a, c, t, g, unknown or other
  misc_feature (242)..(242): n is a, c, g, or t
  modified_base (333)..(333): a, c, t, g, unknown or other
  misc_feature (333)..(333): n is a, c, g, or t
  modified_base (373)..(373): a, c, t, g, unknown or other
  misc_feature (373)..(373): n is a, c, g, or t
  modified_base (380)..(380): a, c, t, g, unknown or other
  misc_feature (380)..(380): n is a, c, g, or t
  modified_base (390)..(390): a, c, t, g, unknown or other
  misc_feature (390)..(390): n is a, c, g, or t
  modified_base (405)..(405): a, c, t, g, unknown or other
  misc_feature (405)..(405): n is a, c, g, or t
  modified_base (424)..(424): a, c, t, g, unknown or other
  misc_feature (424)..(424): n is a, c, g, or t
  modified_base (429)..(429): a, c, t, g, unknown or other
  misc_feature (429)..(429): n is a, c, g, or t
  modified_base (467)..(467): a, c, t, g, unknown or other
  misc_feature (467)..(467): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctgggtcgccccgacggggacagtcgtgatcgacccagtcctccagacctccctggctgtntctcgtgggcgagacgggccaccatcaatgacagtccagccagtagttgttttanacagctaccaacaaataaacgtacttcttaagtcgttacgtaccagacgaacgaaccaggaccacgtacctactaagctgctctatttcgnggctatctaggaccggacgttccggtaccacgtactatcnggtgcgnggtcggtcgnggtacatctcactcncactagcagcacgctaggnacggntagagtgtggtacgtagtttaagtttactcgtacgtanagttaagtaagtaacttaacgtacgttccgtaaccgtataccgtattacgtaccgtttacggttacggaaccggtaaccgggtacccgtaaggtacgaacgtacgactaaacgggtcgtagtacggg

SEQ ID NO: 1915 - DNA, 780 bp, Homo sapiens
  misc_feature: GYAE6OF01EKHEG.13.5.A05.1.454.CMB.1.raw
  modified_base (189)..(189): a, c, t, g, unknown or other
  misc_feature (189)..(189): n is a, c, g, or t
  modified_base (425)..(425): a, c, t, g, unknown or other
  misc_feature (425)..(425): n is a, c, g, or t
  modified_base (445)..(445): a, c, t, g, unknown or other
  misc_feature (445)..(445): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatcgacccagtcctccagacctccctggctgtgtctgngggcgaggacggccacatacaacgtgaccaacgtccagcctaaggtagtttagtttactacacgtcctaaccgaaataaacgtaagtaacctttcgttagtaccgttcggtaaccacgtacaaacgtaaacccgagggaacctacgtccccttaccgtaaagtcctacgccttactagtttacggcggacttatccgttaccgtccggggaacgttccccgggtcctacgaccgtntcgaggtcgcgaggtcggtncgggaactgtacttcaccgttcaccgactacgtcgaacgtccgtacgtccgtaggaccgtacggtacgtagggaaacgtgttacgggtacggttaactttaacggttttaccttaacggttaggtaacccgtaagttaaccgttaaaaggtttaactttaacgttaacccgtttaacccgttacccgggtacccggttacgttacccgttaccgggtttaaccgggtttcccggggaaacgggggtaacggttaaccccggggaagggtaaacggggttaaacctaaacggtaaacccggttaaaaccgggttgttaccgggtcggttaccccgg

SEQ ID NO: 1916 - DNA, 693 bp, Homo sapiens
  misc_feature: GYAE6OF01A0OMN.13.5.A05.1.454.CMB.1.raw
  modified_base (235)..(235): a, c, t, g, unknown or other
  misc_feature (235)..(235): n is a, c, g, or t
  modified_base (238)..(238): a, c, t, g, unknown or other
  misc_feature (238)..(238): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgaccccagtctccagacctccctggctgtgtctctgggcgaggacggccaccatcaactgcaagtccagccagagttgttttanacngctaccaaacaataagaacttcttagcttaggtaccagacaagaaaccaggacacgccctacctaaagctgcctctacttttaacgtcgggactattcttaacgtccgggtaacgtccccggggttcccacgtaccggtattccgaggtcgaccgaggccggggtcgtgggaactggtagtttcccacttcctaccacctacttcacggtaccacgtacccgtggaccgaacggccgttagaaggtaagtcggttacgggaactttaaggtttacttacggtcgtactacgtacgtaaatttacgtttaattaacgttacccgttaccgtacccggacggttcctaacctttaccggttcggggtaaccgggtacgggttaaacccggaaacggggttacggaaacggttaacgttaacccggaaaaccgttacggtacgggtcggttaacccgg

SEQ ID NO: 1917 - DNA, 226 bp, Homo sapiens
  misc_feature: GYAE6OF01DU7EV.13.5.A05.1.454.CMB.1.raw
  modified_base (221)..(226): a, c, t, g, unknown or other
  misc_feature (221)..(226): n is a, c, g, or t
tcagtcacgtactacacgaccggtgctcgatttagatagatagacagggtggaggctgaggatgctggggtctattactgcatgcaagctacacacttgcctccgctcaccttcggccaagggacacgactggagatagaacgaactgtggctgcaccatctgtcttcatcttcccgccatctgatagtacgtgactgagcgggctggcaaggcgcatagnnnnnn

SEQ ID NO: 1918 - DNA, 617 bp, Homo sapiens
  misc_feature: GYAE6OF01EFNS4.13.5.A05.1.454.CMB.1.raw
  modified_base (326)..(326): a, c, t, g, unknown or other
  misc_feature (326)..(326): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagtagttgttttaatacagcctaccaaacaaataaacgaacttcttaagcctttaggtaccagacaacgaaaccaggaccagcctcctaagctgctctatttacgnggcatctacgtccgggaactcccgggtcctgaccgtattcgagtcggcacgggtcggtcgtgggactagtactttcgactcgtaccaacctatacagaccacgtccgtcgacacgggtacctaaggaagtagttggtcggtacttagttttactactgtacgtagtactaaattattaactacgttacctccgtacggacgtcctaccgttacgttccgggacgggtaacgggtaacccggtaagggttaggaacgttaacgtaacgaaaacggacgttgggtacgtaccg

SEQ ID NO: 1919 - DNA, 712 bp, Homo sapiens
  misc_feature: GYAE6OF01AZMDF.13.5.A05.1.454.CMB.1.raw
  modified_base (372)..(372): a, c, t, g, unknown or other
  misc_feature (372)..(372): n is a, c, g, or t
tcagtcacgtactacacgaccggtgctcgatttagatagatagacagggggagctacaacaggcaggcaggggcagcaagatggtgttgcagacccgggtcttcatttctctgttgctctggatctctggtgcccacggggacatcgtgatgacccagtctccagactccctggctgtgtctcgtgggcgaggacgggcccaccgatccaaactcgacaaagtcccaagcccaaggtaggttgtttttaactacacgcctaccaaaacaaacgtaactaaacctttcgttaagtcttacggtaaccagaccaagaaaccgaggactaacgccctacctaaggcctgacttactaacttttacgagggacctntaccgtacggtaccgggaacgtcccggggtccctacggaaccgttattccgaaggtcggacgtacgggtccgggtacggtcgggactacggtactttccgacgttcctaccgactactaccgtaagccgtaacggtccctaggaccgaggtacgtagaagtacgttggtagtaccgtttagttttaacgtacgttcgtacgtaagtaacttaagttaaacttacgtttaacgtccccgttacgtaccgtcgtacccgtccgtaacgggtttccgggacccgggtaagggtaacctgggtacgaacgtaccgtaaacgtaacgtaccgtggtcggctaccg

SEQ ID NO: 1920 - DNA, 304 bp, Homo sapiens
  misc_feature: GYAE6OF01C4HY0.13.5.A05.1.454.CMB.1.raw
  modified_base (229)..(304): a, c, t, g, unknown or other
  misc_feature (229)..(304): n is a, c, g, or t
tcagtcacgtactacacgaccggtgctcgatttagatagatagacagggtggaggcgtgaggatggctggggtctattactggcatgcaagctacacactggcctccgctcaccttcggccaagggacacgactggagatagaacgaatgtggctgcaccatctgtcttcatccttccgcatctgactagtacgtgactggagcggctggcaaaggcactaataggatnnnnnnnnnnnnnnnnnnnnnnnnnnnnnnnnnnnnnnnnnnnnnnnnnnnnnnnnnnnnnnnnnnnnnnnnnnnn

SEQ ID NO: 1921 - DNA, 1185 bp, Homo sapiens
  misc_feature: GYAE6OF01AGO4V.13.5.A05.1.454.CMB.1.raw
tcagtcacgtactacacgaccggtgctcgatttagatagatagacaggggactgatcaggactcctcagttcaccttctcacaatgaggctccctgctcagctccgtggggctgctaatgctctgggtctctggatccgaggtgggattattgtgatgactctagtctccactccttccctcgcccgtccaccccgtggacgtacgcccggtcccttaccacttccgtccgtaggacccgtagggttacctaacggttccaacggtccgtccccgtttcccgttacggacccttaagttaaagggtaaacgttacgggttaaacttaaccgtttaacccggtttaaggtttttacggggtaagtttttacgggtttaccttaccggttacggaacccggtaaacgggtaaaacccggggcccggtaaacggggggttaccctaaaccgggttttaccccttaacccccgtaaaaccggttaaaccccttcccggtttaaacggttaccggtttaaacccgggtttttaaacggggtttttcggggggttttaaaaccccttaacccgggggttttccccggggggtcccccgggttttacccccgggggggtttaaccccctttaggggtaaaaccccgggtttcggggttttaacccgttacgggggttacgggtaacccggggtttaaacgggtttaccggggtaaaccgtccgggttaaaaccggggtaccctaaaaccggggttaaccgtttttaaaccggttttaaacccgttaaacgggttttaaaacggttaaaacccggttaccggtaaaccggggttaaccggttaacgggggttaacccgggttaacgggggttaaaccggggttacgggtttaacgggggttaaaacgggggtttcggttttaccgggggttttttaaccggggggtttttaactttaacccgttgggggttaacccttagggttacccgggttaaaccgttaacccgggtttaaccttaacccgggtttaacccttaaaccgggttcccggttaaccggggtttacccggggtaaccggttttccccgggtaaccgggttaaccgggttaaacggtacgggttaaaccggtacggttaaaccgtaaccgggttaaccgtaaacggtttccggtaccggttacggttaacccgg

SEQ ID NO: 1922 - DNA, 745 bp, Homo sapiens
  misc_feature: GYAE6OF01B7IMD.13.5.A05.1.454.CMB.1.raw
  modified_base (238)..(238): a, c, t, g, unknown or other
  misc_feature (238)..(238): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccacggggacatcgtgatgacccagtctccagacctccctggctgtgtctcgtgggcgagacgggccaccatcaactgacaagtccagccagtagttgttttanacagctaccaaacaataaagaacttcgttacgtcttacggtaaccagacaacgaaaccgaggaacacgacctacctaagctacgtcctactaacttttacgtcgggactacgttaccgtaacggtacccggggtaacgtccccgggggttacccctacggtaacccgtaacgtttaccgaacgggttcgggccgtaacggggtccgggggttccggtacgggggtaacctaagggttacttttacccgtaccgttcccgttaccgtaaccctacgttaaccgacgacccgaccgtaccgtcggacgacggtcctaaggtaaagtagtcgggttacggtcgttaagttttaacttaacgttcgtactagtacttaattaacttaagttaccgttaccttcccgtaccggtaccgtaccgttaccgttaccggtttcggggaccgggaacgggtaaccgtaaggggtaacggacgtaacgtaacgtaaacggacgttgggtcggtaccg

SEQ ID NO: 1923 - DNA, 624 bp, Homo sapiens
  misc_feature: GYAE6OF01CFI8E.13.5.A05.1.454.CMB.1.raw
  modified_base (457)..(457): a, c, t, g, unknown or other
  misc_feature (457)..(457): n is a, c, g, or t
tcagtcacgtactacacgaccggtgctcgatttagatagatagacaggggggagctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgcaagtccagccagagttgttttatacacgctaccaacaataagtaacttcttagcttggtaccagacaacgaaaccaggacacgccctacctaagctcgcctctatttacgtgggctatcctacgtaccggggtaacgtccccggggtccctacggaccgtatttcgaggtcggcgacggtcgggtacgtgggactaggtactttcacctctcaccatccgagcacgcgtgcgtacggctaggaagngttggtacggtacgttagttttaatttacgtcggtacacgtacctaattacttaagttaacgtaccttccgtaccggtacgtccttaccgttacggttccgggacggggtaaccggtaccgtacgggaggtaacgaacgtaccggaaacgtacgtggtccggtaccg

SEQ ID NO: 1924 - DNA, 725 bp, Homo sapiens
  misc_feature: GYAE6OF01CBQOY.13.5.A05.1.454.CMB.1.raw
  modified_base (521)..(521): a, c, t, g, unknown or other
  misc_feature (521)..(521): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgaggacgggcccaccatccaactcgacaacgtccacgccaagtacgtttgttttaactacgagcctaaccaaactaaaataaacgtaaccttttcgttaacggccgtttacggtaaccctaggacctaaacggaaaaccgacgggaaccacggtacccccttaccgtaagtcctcgacttacgtaagttttacgtcgggacttagtaccgttacgtaccgggtaacggttccccgggtcccgtaggtaaccgtacttcgaggtcggcgtacgggtccgggtcgtacgggactaaggttacctttacgaccttccgacctactacgtcgaacncaacggtcctcggacgacggtacctaagtaagtacgtggtaccggtactttaggtttaacttcgtacgtacgaacgtaactaatttacgttactacgttacctccggtacgcgttacctaggtttacccggttcgggaaggtaacgggtaccgtagggttacgaacgtaacggtaaacctaaccggaacgttgggcgtacccgg

SEQ ID NO: 1925 - DNA, 862 bp, Homo sapiens
  misc_feature: GYAE6OF01C7YD9.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtcgccccgacgggacatcgtgatcgacccagtcctccagacctccctggctgtgtctcgtgggcgagacgggcccaccatacaactgacaacgtccacgccagtagttagttttaactaccacgtcctaccaaataaaacttaaacgtaaacctttactacgtaccgttacggtaacccacgaccaaacggaaaccgacggaaccacggtacccctaccgtaaacgccgttacggtccttactaacgttttacggtcgggtactacgttccgtaaccggtaccccggggtaaccggttccccgggtacccgtacggtaacccgtatttaccgaacgggtcggtaccggtacggggtccgggttaccggtacggggtacctaaaggtttacctttaccgaccctttaccgtaacccgtaccctaacgtccgaaccggtaccgtacccggtaccgtcggaaccggtacggtaaccgttacgggtaaacgttaacggtgggtttaccgggttacttttaagtttttaccgttaaccggttacgttaaccgaacgttaaacgtatttaaacggtttaccttaccggtttacccgtacccgttacggtaccggtaccctttacgtacccggggtttacccgggacccgggtaaaggggttaaccggtaaacggggtacgggtaaacctaaacccggttaaacggaaaccgggtacggttcgggttacccgggtaccg

SEQ ID NO: 1926 - DNA, 861 bp, Homo sapiens
  misc_feature: GYAE6OF01CEDOR.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatcgacccagtctccagactccctggctgtgtctcgtgggcgaggacggccaccatcaactgacaacgtccagaccagtacgttgttttaactacagtcctaccaaacaataaacgaactttcttacgtcgttacggtaaccagacgaacgaaaacccgaaggaaccaacgaccccttaccgtaacgtcctcggaccttactaacgttttaccgtcggggactaacgttaccgttaacggttacccgggggtaaaccggtttcccccgggggttaccccttaccgggaaccccggttaagtttacccggtaacgggttcgggaccgtaacggggtccggggttaccggttacgggggaactaacggtttacgttttacccgaccgtttacccttaccgaaccctaccgttaccgaacggtaccgaccgtcccgtacggtaccggacgggtaccgtacgggtaaacggtacggttacgggttaacggttacgtttaaacggtttttaaccgtttaaccgttcggttaacgtaaccgggttaacttaaacgtttaagttttaaccgttaacccggtttaccgttacccggttacccgggtacggttacccgttaccgttaccgggtttaccgggtacggggtaacccgggtaacgggttaacgggtaaggtaacgtaacggtaaccgtaaaccggtacgtcgggtaggtaccgg

SEQ ID NO: 1927 - DNA, 683 bp, Homo sapiens
  misc_feature: GYAE6OF01ENT0L.13.5.A05.1.454.CMB.1.raw
  modified_base (233)..(233): a, c, t, g, unknown or other
  misc_feature (233)..(233): n is a, c, g, or t
  modified_base (318)..(318): a, c, t, g, unknown or other
  misc_feature (318)..(318): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagttgttttanacagctaccaaacaataagaacttcttagcttaggtaccagacaagaaaccaggacacgcctacctaagctcgctctatttacgnggactatctacgtaccgggaacgtcccgggtcctacggaccgtagttcgaggtcggcgacggtcggtcgtcgggactagtactttcgactcgtacacctatacgacgacacgtccgtgacgacggtacgtaaggtaacgtagttcggtacggtacgtttacgttttacgtttaacgtcgttacgaagtacgttaaagtttaagtttaacttaacggttacccttacccgttaccggtaacggttcccgttaaccgttacccggtttccggggtaaccggggtaaccggggtaaaccggtaaacgggggttacggtaaacggtacgttaaaccgaaaaccgggttaacgttggtacccgggtaccg

SEQ ID NO: 1928 - DNA, 884 bp, Homo sapiens
  misc_feature: GYAE6OF01DVDFH.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtcgcccacggggacagtcgtgatcgacccagtcctccagacctcccgtggctgtgtctcgtgggcgaggacggccaaccatacaactcgacaacgtccagccagtagttagttttaacacacgtcctaccaaactaaattaaacgtaacctttcgttaagtccgttacggtaaccagacaaacgaaaccgaggacacgtcctacgtaacgtctcgtctaccgtatttaccgcggactaacgttcgttaacggtacccggggtaacgttcccggggtacctacggaacccgttagttacggacggttcggaccggtacgggtcccgggggtacgttacggggaaacccgttaaggtttaccgtttccccgtaacgttcccgttacccgtaaaccgtaacgttaccccgaacggtaccgtaacccgtaccgtacgggtaccgtaacgggttaccgtaaggttaaacggtcggtacggttacgggttaaccgttttagtttaaccgtttacgtcccggtaacgtaacgtaaccgtttaaaagtttacgtttaaccgttaaccggtttacccgttaccccggtaacgggtacccggttaccgtttaaacccggtttacccggggtttaccggggtaaacccgggggtaaacgggttaaaccccgggttaaagggggttaaccggtaaaaccgggtttaacccgtaaaaaccgggttaaaaccgttaacccgggttacgggttaacccgggtaacccgg

SEQ ID NO: 1929 - DNA, 695 bp, Homo sapiens
  misc_feature: GYAE6OF01CYE7U.13.5.A05.1.454.CMB.1.raw
  modified_base (203)..(203): a, c, t, g, unknown or other
  misc_feature (203)..(203): n is a, c, g, or t
  modified_base (326)..(326): a, c, t, g, unknown or other
  misc_feature (326)..(326): n is a, c, g, or t
  modified_base (362)..(362): a, c, t, g, unknown or other
  misc_feature (362)..(362): n is a, c, g, or t
tcagtcacgtactacacgaccggtgctcgatttagatagatagacagggggagctacaacaggcaggcaggggcagcaagatggtgttgcagacccaggtcttcatttctctgttgctcgtggactcgttctgggtcgcccgagggactagtcgtgacgtcgaacctgtcctacgactcctccgtggtctgttcgtcgtcggngggacgagggacggaccactactacgaacgtcggacctaacgtccgaagaccgtaggtagtttacgtttaacacacgtacctaaccaaagtaagtaactactttgtactacgttacggaaccngaacgaacgaaccgtaggacaccgtcctacgtaacncgtactacgtacgttacgttcgcgactacggttacgtaccgggtaaccggtaccggtccgggtaccaacggtactagtcgacggcgacgacggtcgtacggacgcgtaatacgtctacctacgtctacacgtcgacgacgcgtcgacgtacgagtacgtagtaaggtagtacggtcggttacttaacgtttacgttctaacgacgtacgtaagttaacttaacgttacgtacgttccgtacgttaccgcggttacctacgtacgggttacgggacgggtaacggtacgggtaacgagaacgttaacgaaccggtaaggtacgtgggtcgaccg

SEQ ID NO: 1930 - DNA, 746 bp, Homo sapiens
  misc_feature: GYAE6OF01EBJB7.13.5.A05.1.454.CMB.1.raw
  modified_base (230)..(230): a, c, t, g, unknown or other
  misc_feature (230)..(230): n is a, c, g, or t
  modified_base (236)..(236): a, c, t, g, unknown or other
  misc_feature (236)..(236): n is a, c, g, or t
  modified_base (265)..(265): a, c, t, g, unknown or other
  misc_feature (265)..(265): n is a, c, g, or t
  modified_base (524)..(524): a, c, t, g, unknown or other
  misc_feature (524)..(524): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatcgacccagtctccagacctcctggctgtgtctcgtgggcgaggcgggccaccatcaactgcaagtccagccagtgttnttttanacagcctaccaaacaaataagtaaccttnttagtcttggtaaccagacaacgaaaccgaggaccacgtacctaccgtaaggccttacggccttacttacgttttacggcgggtacctagttaccgtacggttaaccccggggtaacggttcccccgggggttcccctacggaacccgttacgttccggaaggtcggaccgtacgggtccggggttacgtacggggaacctaggtaacttttccgaccttacgtaccacctactccgaagtccgacgtccgtcggacgnggtactaggaagtacgttggtacgttaccgtttaagttttacgttacgtgtaaccgtagtaactaaatttacgtttaagttaccgtacccgtttacccgaccgggtacgttacccgttaccggttaccggggttaccgggtaggggaacgggttaaacccggtaggggtacggtaaacggtaaaccgtaacggtaaaaccgggtcggtttggcgggtaaccg

SEQ ID NO: 1931 - DNA, 879 bp, Homo sapiens
  misc_feature: GYAE6OF01DEKAW.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatcgacccagtctccagacctccctggctgtgtctcgtgggcgaggacggcccaacactacaactcggactaacgtcccacgcctaaggtacgtttagttttaacacgacgcctaaccgaaaactaaaacttaaacgtaaacttttccttaaggtaccgtttacggtaacccaaggacgaaacgaaaaccgaacggaccacggtccccttacgtaacgtaccgttcggtaccttactaacgttttacgtcggggtactacgtaccgttacggtacccggggtaaccggttccccggggttacctacggtaaccgttacgttacgagggtcggacggtacggggtccggtcggtacgggtaactagtactttaccgaaccttccgtacctaacctacgtaccgaacgtccgtacgtccctacggaccgtacggtaccgtaaggaacggttacgtttcgggtacgggttaacttttaacgggtttttaacttaaccggtagttaaccgtaacgttaaccgttaaaatttacgtttaaacggtttacccgttaacccgtttccccggtaacccgggttcggtttaccccgttaccggttttaaccccgggttaccgggggtaacccggggggttaaaccgggtaaccgggtaaacggggttacccgggaaacggttaaccggttaaacccggttaaaacgggtaaccggttcggggtaacgttaccccggg

SEQ ID NO: 1932 - DNA, 823 bp, Homo sapiens
  misc_feature: GYAE6OF01C7TDT.13.5.A05.1.454.CMB.1.raw
tcagtcacgtactacacgaccggtgctcgatttagatagatagacgagggggagctacaacaggcaggcaggggcagcaagatggtgtgcagacccaggtcttcatttctcttgttgctcgtggactcgtcgtggtcgcccgacggggacagtcgtagactcggacccagtcctccgagtacctccgtggctgtcgtcgtacggcgggacgaggacggcccaacgactacaactcgactaacgtccagccgtaggtagttacgtttaacaccgacgacctaacaaaataataaacgtactttacgtagtcgttacggaccaacgtacgaaaacgaaaccgacggaacgtacctcccgttaacgaagtcctcgtaccttagttaacgtttaccggaggacctacgttaccggttaaccggaaccggggttaacccgtcccggggtttacccaacggtacgttaaacgtttaccggaggggtttacccgacgggttaccggggtccggggtttaacgtacgggaaatttaccggttacttacggaccctctaaccgaccttacgaccgtacgacgtacccgtcgtacgacggacggttacgaaggtacggtactcgggttaacgtaccgttttaagtttaccgtaactcgaacgtaacgttaaacttaagttaaccgtttaacgtaacccggtacccgttacccggtacggttacggtaccccttacggttaacccggggttacgggaaccggggttaacggaaaccgggttagggtacgttaaacgaacccgtaaacggaaacggttcggttaggccgtaaccg

SEQ ID NO: 1933 - DNA, 764 bp, Homo sapiens
  misc_feature: GYAE6OF01DHQP7.13.5.A05.1.454.CMB.1.raw
  modified_base (180)..(180): a, c, t, g, unknown or other
  misc_feature (180)..(180): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctcgtggtcgcccgacggggacagtcgtgatcgacccagtctccagtacctcccgnggtctgtcgtctcgtgggcgaggacggccaccgataccaacgtgaccaacgtccgacgaccgtaaggtacgtttagttttaacaacgaacgtaccttaaacccaaaacgttaaacgttaaaacggttaaccttttacgttaacggtaccgtttacgggtaaccaaggaccgaaaacgaaaaccgtaggacctaacggtacccctacgtaacggtctacgtacctatttaacgtttaccgcggtaactacgtacgtacggtacccggggttaacgtcccgggttacccacggtaacgttgttacgacggtcggacgcgggttcggacgtagggaacctacgttactccgacttacctacaccgtaatcgacgtccgacgtccgtgacgagtaccgaaggtaacggtgtacgggtagtttaacttggtttaaccttcggtcgtaacgagtacttaagttagttaacgtacgttaccgtccgtaacgtacgtccgttacgttccggttaccggggaacgggacggttaaccggaagggtcggaaacgttaccgtaacggaaaaccggtcggttcggtaccgtaaccg

SEQ ID NO: 1934 - DNA, 798 bp, Homo sapiens
  misc_feature: GYAE6OF01CP1AY.13.5.A05.1.454.CMB.1.raw
tcagtcacgtactacacgaccggtgctcgatttagatagatagacaggggggagctacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggacgggccaccatcaactgacacgtccagccagtagttagttttagacagtcctaccaaaataaataacgtaactttactagtaccgttacggtaaccaagtacaaacgaaaccgaggaaccacgtcctaccgtaagcctgtactactactttacgcggtactacgtactacggtacccgggtaacggtcccggggttacctacggtaaccgtacgttcggtaggtcggaccgtagggtcccgggtacgtacggggtaacaacggtttacttttacccgaacttcccgtaaccgtaaccctaactaccgacgtacgaccgtcccgtacgacggtacggtaccgtaaggtaaacggtacggttacggtacgggttacgtttaacgttttaaccgttaccgttacggttacgtaaccgttaacgttaaacgtttatttaaacgttaccggtttaaccctacccgttaacccggtaccggttacccgtttaccggttaccgggtttacccggggaacggggttaaccggggtaaacccggtaaggggtacgtaaacggtaaccgttaaacgaaacccggttaacgtacgggttacggtaccg

SEQ ID NO: 1935 - DNA, 829 bp, Homo sapiens
  misc_feature: GYAE6OF01BLL9L.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctcgtggtcgcccgacggggacatcgtgatcgacccagtctccacgtacctccgtggctgtgtctcgtgggcgagacggccacatacaacgtgacaacgtccacgaccgagtagttcgtttaacacgacgtacctaaccaaaactaaagtaaacgtaacctttcgttaacggtaccgtttacggtaaaccgaacggtaaccgtaaaacgaaaaccgaggtaacctaaccggtccccttaaccgtaacgtccgttacgacctttaacgttaacgttttacgcgggtacctacgttaccgttaacggtacccgggtaaccggttcccggggtaccctacggtaacccgttagtaccggtacggtcgggacgtacggggtaccgggtacggtacgggtaacgtaacgtttacctttaccgacttaccgtaccgaacctaccgtacgacgtaccgtcgtaccgtacggaccgtacggtcgttaacggaacggtagttacgggttaggttaccgtttaggtttaactttacggtacgtaactacgtaacgtaagtttaacgttaacgttaaccggttaccgtacggtacccggtacgtaccggttaccgttacggggtccgggtaacggggtaaccgggtaacggtaaggggtaacggaacggtaaccggtaaaccggtaaaacggttcggtacggggtacggtaaccgg

SEQ ID NO: 1936 - DNA, 760 bp, Homo sapiens
  misc_feature: GYAE6OF01AWRQ5.13.5.A05.1.454.CMB.1.raw
  modified_base (248)..(248): a, c, t, g, unknown or other
  misc_feature (248)..(248): n is a, c, g, or t
  modified_base (254)..(254): a, c, t, g, unknown or other
  misc_feature (254)..(254): n is a, c, g, or t
tcagtcacgtactacacgaccggtgctcgatttagatagatagacagggggagctacaacaggcaggcgaggggcagcaagatggtgttgcagacccaggtcttcatttctctgttgctctggatctctggtcgcccgacggggtacagtcggtgatcgacccgagtcctcacgcctccgtggctgtgtctcgtgggcgaggcggaccacgctacaacgtgactaacgtccacgtaccgagtaggttnttttanacgacgtaccgtaccaaacgtaaataacgttaacttccgttacggtcgtttacggtaccaacgtaccaacgaaccgacgacacgtcctaccgtagccttacgacttacgttacgttcggtcgtactacgttaccgttaacgggtccgggtaaaccggttccccgggtaaccgtaccggtaccgttacgtacggtcggtcggaccggtacggggttccgggtcgtacggggtaacctacggttaccgttcctaccgttaccgtacctaacccgtaacttcgaaccggtaccgttccggtccgtacggtaccggtaaggtccgttaaagggacgtacgggttcgtccggttacgtttacgttacgtttacgtacgtaccgtaagtacttaagttacgttaacttaccgtacgttaaccgtcggtcgtaccgtccggttcggtaacgggtacgggaacggtacggtaaggtaggtaccgtaacgttaaccgaggttacttcggcgtacg

SEQ ID NO: 1937 - DNA, 884 bp, Homo sapiens
  misc_feature: GYAE6OF01EHUK6.13.5.A05.1.454.CMB.1.raw
  modified_base (202)..(202): a, c, t, g, unknown or other
  misc_feature (202)..(202): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggactatcgtgatcgacccagtcctccacgtcctcccgtgtcgtgtcgtcgtcggtcgggngacggaccggccctaaccactacaacgtcgacgtaaccgtccgacgaccgtaaggttacgttttacgtttacaccgtacgtacctaaccgaaaactaaattaaaccgttaacctttacgttaacggtccggttacggtaaccagaaccgaaacgtaaaccgacggaccaccgtaccctaacgtacgtcgttaccggtacttacgtttaccgtttacggcggtactacgttacgtacccgggtaccgggtaccgggtccccggtcctacgtaccggtcgtacggtcggtacggcggtaaccgggttcgggtaccgtaacgggtaacgttcgttaacctttacccgtacctaccgttaacccaccgtaatacccggacgtacgtacccggtacgtaccggaacggtacggtaactaaacggggtattaacggggttcggttaaccgttaccgttttttaacgggttaaccttccggggttaactaagggttaccctaaagtttttaaacgttacgttttacccggttaaaccccgttaccccggttaccgggacgttacccggttaccccgtttagggtttaacccgggggttaccggggaacggggtaaccgtaacggggtaaaggtagggttaaacccctaaaggtaacccgggtaaggtttcgtccggggtaactaccccg

SEQ ID NO: 1938 - DNA, 873 bp, Homo sapiens
  misc_feature: GYAE6OF01B0XSX.13.5.A05.1.454.CMB.1.raw
  modified_base (251)..(251): a, c, t, g, unknown or other
  misc_feature (251)..(251): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatcgacccagtctccagacctccctggtctgtcgtctcgtggggcgaggacgggccaccataccaactgacaacgtccagccgagtagtttaggttttanactacgccttaaccaaaacgtaaattaaacgtaacctttacgttaaggtctttacgggtacccaaggaaccgaacgaaaaccgaacggaaccgaccggtaccctaccgtaaacggtcctaccggtcttacgtaattttaccggtcgggacctaagttaccttaacgggttaccccgggggaaaccggttcccccggggtaccctacggtaaccccggtagtttacggaacggggttcgggaccggtaacggggtccggggttacgtacggggactaacggttaacgttttacccacttacccgttaccaccgttacgtcgacgtaccgtaacggtccccgtagaccggtacggtacgttaacggaacgttagtcggggtacggttacgttttaaggttttttaaccgtttaaccgttacggttaccgtaaacggttaacttaaaacgtttacttttaaggttaacccgtttacccgtaccccggttacggtacggttacccgtttcccgtaaaccggggttttccggggaaaccggggtaaccggtaccgggttaaagggttaccgggtaagttaaaccgtaaacggtaaacccggtacggttacgggttcccggtaaccgg

SEQ ID NO: 1939 - DNA, 844 bp, Homo sapiens
  misc_feature: GYAE6OF01DDJJR.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtcgcccgacgggacatcgtgatcgaccctagtcctccacgacctcccgtggctgtctctcggtgggcggacggacgggcccaccactaccaacgtcgaactacgtaccaacgtaccgtaaggttagtttacgtttttaacacgaccggtacctaacccaaaacttaaaagttaaacgtaaccttttaccgttaacggtaccgtttacggaacccagaaccgaaacggaaaccgacggaacctaccgtacccctacgtacgtacgttacgtaccttacttaacgtttacggtacggtacttaacgttccgttaacgtaaccccggggtaccggttcccggttaccgtacggtaacctagtttccggacgggttcggaccggtcgggtaccggggttacggtaacggtacgttaacggttacctttacccgaccttacccgtaaccaccgtacgtaccgtaccgtaacgacccggtaccgtcgaccgggtacggtaaccggtacgggtaacgtacgggttaggttaccggttaacgtttacggttttaaccgttacggttagaaccgttacgttaaagtttacttaacggtttactaccgtttacccggaccggttaacgtccggttaccttaccggtacgggttccgggaaacgggtccggtaacggaggttacggaaactaccggtaaactaccgggtacgttggacgtacccg

SEQ ID NO: 1940 - DNA, 828 bp, Homo sapiens
  misc_feature: GYAE6OF01C35T4.13.5.A05.1.454.CMB.1.raw
  modified_base (384)..(384): a, c, t, g, unknown or other
  misc_feature (384)..(384): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctcgtgggtcgcccgacggggacatcgtgactcgacccagtctccagacctccctggctgtgtctcgtcgggcgaggcggaccaccatacaactgactaacgtcccagacctagtagtttagttttaacaaccacgtacctaaccaaaactaaaacgtaaacgttaacctttacgttaagtcgttaccggtaaccagtaacaaaccgtaaaccgaggaccaccgtaccctactaacggctcgtactacgtaactttacgnggactataccgtaccggtaccgggtacgtcccggggtactacgtaccgtagttcgaggtcggacgacggtcgggtacgtcggaactagttaactttcccacgttcctaaccaacctacgtaccacggtaccgacggtaccgtacggacgtacggtacgtagggtaaattcggtagggttccgtttaacggttttacgtttaacgttaacgtttacggaacttaaacggaaacttttaaagtttaacgttaaacgtttaacccgtttacccggtaacccgggtttacccggaacggtttaccggttaaccccggttttaccgggtaaaccgggggtaacccggggggtaaacggggttaacccggttaaaagggggtaaccggtaacggttaaaccgaaaacccgggttaaagttaaacccggggtgggttaaccggtaacccgg

SEQ ID NO: 1941 - DNA, 874 bp, Homo sapiens
  misc_feature: GYAE6OF01C540T.13.5.A05.1.454.CMB.1.raw
tcagtcacgtactacacgaccggtgctcgatttagatagatagacaggggagctacaacaggcaggcagggcagcaagagtgtgttgcagacccaggtcttcatttctctgttgctctggatctctggtcgcccgacgggactatcgtgatcgacccagtctccacgtaccttccgtggtctgtgtctcggtgggcgaggacggccaccgacttaccaacgtcgactaacggtcccacggacccgaaggttacgtttacgttttaaacgtaccacgtacccctacctaaaaactaaaacgttaacgtaaaccttttacgttacgttaccggtttacggtaaacccaacgaacgtaaaccgaaaacccgtaacggtaacctaacccggttccccttaaccgttaaaccgtccgttacggtccctttaaccgtttacggttttacggtaccgggtaaccttaacggttaccgtaaccggtttacccggggtaaaccgttccccggggttacccgtacggtaaccgttacgtaccggtacgtccgggtcggacgggtaccgggttcggtacggtaccgttaaggttctttaccgtccttactacccgtacgtactaccgtcgacgtaccgccgtacgcgtacggtctaacggaagtacgtaggttacgtaacgttttacgtttaacgttccgtacgttaccgtaaacggttaagttaaactttacgtttaaacgttacccgttaccggttcccgttaacccggtacggttacctaccggtttaccgggttcccgggacgggttaacccgggtaacgtaaaccggggttagtaaccggtaaactaaaccggttaaccgtacgggtgtcggtaacccgg

SEQ ID NO: 1942 - DNA, 876 bp, Homo sapiens
  misc_feature: GYAE6OF01E58KW.13.5.A05.1.454.CMB.1.raw
  modified_base (157)..(157): a, c, t, g, unknown or other
  misc_feature (157)..(157): n is a, c, g, or t
tcagtcacgtactacacgaccggtgctcgatttagatagatagacagggggagctacaacaggcaggcagggcagcaagatggtgttgcacgacccaggtcttcattttctcttgttcgctctaggatctctggtcgacccgacggggacagttcgngactcgacctagtcctaccacgacctccgtggtcttacgtcgtctcggtcgggcgacggacggacccaaccacgtaccaacgtcgaccgtaacgtcccgaacgaccgtaggttaacgtttcgtttttaacgaccgttaccgtaaccttaacctaaaacgttaaacgtaaaccggtttaaccttttacgttaacggtaccgttttaaccgggttaacctaaccggaacgttaaaccggaaaaccccggtaacgggaaccctaccggtaccctttaaaccccggtaaagttccgtacgtaaccgtttaccgtttaacggtttaccgggtaacggtaccttaaaccgttacccggtaaaccggttaccccggggttaaaccgggtttccccgggtaccttaacggtaacccgtacgtttaccggtagggtaccggtacccggacgggtttaccgggggtactaccgggtaaactacggtttaccctttaccggtaaccctttcgtaaccctaccgtaacttccgaacgtaccgtaccgtcgtacgacggacgtacgtaacgtacggtagttacggtcgttacttacggtttacttcggtacgtacgaacgttacgtaaactttagtaacgttacgtaccgttacgtcggtccttacgacgttacggtcggacggtacgtaacggtacgaggaactaacggacttaaacggtctagtgtaccg

SEQ ID NO: 1943 - DNA, 956 bp, Homo sapiens
  misc_feature: GYAE6OF01AYS9D.13.5.A05.1.454.CMB.1.raw
  modified_base (154)..(154): a, c, t, g, unknown or other
  misc_feature (154)..(154): n is a, c, g, or t
tcagtcacgtactacacgaccggtgctcgatttagatagatagacagggggagctacaacaggcaggcaggggcagcaagatggtgttgcagacccaggtcttcatttctctgttgctcgtggactctctggtcgcccgacggggactagtcgngatcgacctagtcctaccgacgtacctccgtggctgtagtctcggtcgggcggaaggtaccgggcccaacgtactaccgaactcgaaccgaaccgtccgaacgccgtaacggtagtttagttttaacactacgtacctaaaccaaactaaacgttaacgttaaccttttacgtacgttccggtttacggtaaccaaggtaaccgaaacgtaaacccggaaggaaccctacccggtaccctttaaaccgtacggaccttaccggacctttacggtttaaaccgtttaccgggtaggtaacctttaccgtaaccgtttacccgggtaacccgggggttaaccgggttacccccgggtaccggttaaacccgtacgggtttaacgtacggtacggggttcccggaacgggttaacccggggtccggggttaacgttaagggggaacccttaacggtttaccggtttaccccaacgttttcccgaaccgtaccctaaccgggttacaacccgcgttaccggaccgtcaacggtaccgtagggtaacgtaagggtccgttagggttaagttaccggtttagtttacttacgggttaccgtaacgttccggttaaaatttaccgttaacgtttaacggttaccgttaacccccggttgggtaaacccgtttcgttaccggttaaccggtttaccccgggggttaaggaccggggggttaaaaccggtcgggggtaaaacgtaccgggttaaccgtaaacgggttaaacccggtaaacggttacgggttcccgggtaacggttaacccg

SEQ ID NO: 1944 - DNA, 836 bp, Homo sapiens
  misc_feature: GYAE6OF01CXKIS.13.5.A05.1.454.CMB.1.raw
  modified_base (486)..(486): a, c, t, g, unknown or other
  misc_feature (486)..(486): n is a, c, g, or t
tcagtcacgtactacacgaccggtgctcgatttagatagatagacgagggggagctacaacaggcaggcaggggcagcaagatggtgttgcacgacccaggttcttctattttctcttgttgctcgtggactctcgtggtccgcccggacggggacagttcgtgtacgtaccgaccctagttccctaccgaacgtcccttcccgtggtccgttggtcgtccgttcggcggggacggaacggtaccgggacccaaccgtacttaccgaaacgtcgaacctaacgtacccacgtaccgtaaggttacgttttacgttttacgaaccgtacgtaccttaaacccgaaaactaaaagttaaaccgttaaccttttacgtaacggttaccgttaaccggaacctaacggaaaccgaaaccggtaaaaccacgggaacctaccggtacccttaaccgtagtaccgtctaccgtttaacgttagtttaccggngtaccttacgttaccggtaccggtaaccggtaccggtccccgggttaccgacgttacgtacgtcggtaggacgtaccggtacgggtccggttcggtacggttactacggttacttaccctcgtacctacgtaacgacgtacaccgtacggcgtaccgtcggacgtgtaacgtcggtagtagtcggttagtacgtttaaggttcctagtcgaactacgtaattactattaaccgtaacgttccaacgggttacgtccgttcgtacccggttacggtccgggtaacgggtaccggtacgggtaaagtacggtaagtaacccggaagttaacccggacgtccggtacgtaccg

SEQ ID NO: 1945 - DNA, 809 bp, Homo sapiens
  misc_feature: GYAE6OF01DSHGG.13.5.A05.1.454.CMB.1.raw
  modified_base (53)..(53): a, c, t, g, unknown or other
  misc_feature (53)..(53): n is a, c, g, or t
  modified_base (172)..(172): a, c, t, g, unknown or other
  misc_feature (172)..(172): n is a, c, g, or t
tcagtcacgtactacacgaccggtgctcgatttagatagatagacaggggganctacaacaggcaggcaggggcagcaagatggtgttgcagacccaggtcttcatttctctgttgctctggactctctgggtcgcccgacggggactagtcgtgactcgaacccagttccnccgacgtacctccgtggtctgttcgtcgtcggtggggcgaaggaccggaccacataccaacgtcggacctaacgtccacgacgtaagttacgtttcgtttaacgacacgtacctaacaaaacgtaaagttaacgtacgtttccgtagtaccgttacgtaacgagtaccgaaacgaaaccggtagaaccgtactacccgtaaccggtaagcctaactcttacgtaaacgttttcggacggtactccgttacgtaccgggtaccggtaaccgggttcccggtactacggtacgtaattacggacggtacgggcgtacggtcgggtagtaggtaccgttagttcttaccgtactcgacctaacgtactacgaactccggacgttaccgacggtaacggaccggtaacgtacgggtaaaggtcggtacggttaagggttacctttaacgttaagttacgttaccgtaacgttaagttaacctttaagtttaaccgttaccgtttaaccggttaccgtaacccgtaccgggttacgttaccgttaccgggttacggggttaccgggaagggttaaccgggtaaacgggtacgggtaacgtaacgtaaacgtaacgtaaagttacgggtagttaaccgtaccg

SEQ ID NO: 1946 - DNA, 685 bp, Homo sapiens
  misc_feature: GYAE6OF01APCQI.13.5.A05.1.454.CMB.1.raw
  modified_base (257)..(257): a, c, t, g, unknown or other
  misc_feature (257)..(257): n is a, c, g, or t
  modified_base (272)..(272): a, c, t, g, unknown or other
  misc_feature (272)..(272): n is a, c, g, or t
  modified_base (460)..(460): a, c, t, g, unknown or other
  misc_feature (460)..(460): n is a, c, g, or t
  modified_base (463)..(463): a, c, t, g, unknown or other
  misc_feature (463)..(463): n is a, c, g, or t
tcagtcacgtactacacgaccggtgctcgatttagatagatagacagggggagctacaacaggcaggcaggggcagcaagatggtgttgcacgacccaggtcttcatttctctgttgctctggatctctggtcgacccgacggggacagtcgtgatcgacccctagtcctaccacgacctccctggctgtcgtctcgtgggcgaggacggaccacctatccaactggacaacgtccacgccgagtagtttgttttanacacgcctaacaaanaagtaacgtaacttcgtaacgtcgttacgtaccagccaaacgaaccgaggaccacgccttaacgtagctcgtctactacgtttacgcggtacactacgtacggtaccgggtaaccgtcccgggtccacgtaccgtatcgtaggtcgcgtacggtcggttcgacgggactggtacttcactcactacancancgtacgcgacgagcgtacgagaacgtgtacgtaccggtatttacgttaacgttacgtgtaccctagttaaccgtaagtttagttaaaccgttaacggttaacccctcggttaacccggtaccgtttacgtaacccggttacggttaccggggacggtaaacggggtcggtaacgggtaagggaccgtaacgtaaacgtaaccgtacggtgtaccgggtaacc

SEQ ID NO: 1947 - DNA, 729 bp, Homo sapiens
  misc_feature: GYAE6OF01ASHDM.13.5.A05.1.454.CMB.1.raw
  modified_base (536)..(536): a, c, t, g, unknown or other
  misc_feature (536)..(536): n is a, c, g, or t
  modified_base (595)..(595): a, c, t, g, unknown or other
  misc_feature (595)..(595): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctcgtggtcgcccgacggggacacgtcgtgactcgaccctagtcctccacgtacctcccgtggctgtcgtcgtcggtcgggacgaggacggcccacgactacgaacgtcgacgacgtccgacgaccgtaggttacgtttacgttttaacacgtacgtcctaaccgaaactaaattaacgtaacctttcgtacgtacgttacggtaaccagtaaccgaaacgaaaccggtacggaaccaccgtacccctacgttaacggcctacgtaccttacgtagttcgacggtctacgttacgtaccggtaccgggtaacggttcccgggtacctacgaccgttagtacgtggtacggacggtcgggtcggtacgtacgggacttcggttaacttccacgttaccaccgactcgtaccgngccgacctcggacgacgtacgacgtaaggagtcgttcggaacgttgtttacttacggtntcgtaagtactaaggttaattacgttactacttccggtccgtaccgtacgtccgtacggttacccgggtcggtaacggacgggttaacgacgggtacgtaacgtaacggtaaccgaagtcgttcggcgtaaccg

SEQ ID NO: 1948 - DNA, 965 bp, Homo sapiens
  misc_feature: GYAE6OF01CT0YQ.13.5.A05.1.454.CMB.1.raw
  modified_base (538)..(538): a, c, t, g, unknown or other
  misc_feature (538)..(538): n is a, c, g, or t
  modified_base (545)..(545): a, c, t, g, unknown or other
  misc_feature (545)..(545): n is a, c, g, or t
  modified_base (561)..(561): a, c, t, g, unknown or other
  misc_feature (561)..(561): n is a, c, g, or t
tcagtcacgtactacacgaccggtgctcgatttagatagatagacagggggagctacaacaggcaggcaggggcagcaagatggtgttgcagacccaggtcttcattttctctgttgctctggatctctggtcgcccgacggggacatcgtagatcggacccctaggttcctccacgtacccgttccctggccttggttcgttccttacggtcggggacggacgggtaccgggccctaaccgaacttccaaacgtacggaccgtaaacgtcccgaacgcccgtaaaggttagggttttacgtttttaacactacggtaccctaaccgtaaaataacttaacgtaaccgtttactttacgttacgttacggtaacccaggtaaccgaaacggtaaacccgaagggtaccgaacccgttacccggttaccgtaaagtcctacgtcctttaccgttaacgttttacggcgggtaccttacttaccggtaacggtaccccggggtaaccggttccccgggggttaccacggtaacccggttnttaacgngggtacggtaaccggngggtaccgggtacgttacggggaaactttacggttaccgtttacgacccgttacccgtacccgtaccgtacgggtaaccgtaccgaaccgcccgtacccggtcggtaaccgtaccggagttaagaaaggtcggttagggttcgttacgttttaagggttttaaccctacggtttacgaccttaaggttaccttaaagtttaaacggtttaccgtttaaccggttaccccgggtttaccgttacccggggttaccgtaaacccggttttccggttaacccgggggttttacgggggaacccggggttaacggggtaacccggggttttaaggggaaaccgggttacggttaaaccgggttaaaaccgggaacccggttttacgggtagggttacccgggttaacg

SEQ ID NO: 1949 - DNA, 697 bp, Homo sapiens
  misc_feature: GYAE6OF01BCPST.13.5.A05.1.454.CMB.1.raw
  modified_base (334)..(334): a, c, t, g, unknown or other
  misc_feature (334)..(334): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatacaactgcaagtccagccagtagttgttttatacacgcctaccaaacaataagtaactttcttagcctttaggtaccagacaacgaaaccaggaccacgcctaccgtaagctcgcttactagtttaccgnggctatccgtacgtaccgggtaacgtcccggggtcctaggacccgtattcgaggtcggcgtagggtccggtcgtagggactaggttactttaccaccttcctaccaacctacgtacgacgctacgcccgtcggaccgaggtaccgtaggaaacggtcgttagggtacggtacgtttaagttttaacgttacgttgtaccgaagtaccgtaaatttactttaagtaccgttacccgttcccggtaccggtacggttcccgttaccgttaaccgggtttccggggaaccggtacggggtaacccgtaaggggttacggaaacggtaaccgtaacccgtaaaaggtccggttgggtcggtacccgg

SEQ ID NO: 1950 - DNA, 709 bp, Homo sapiens
  misc_feature: GYAE6OF01EXFGJ.13.5.A05.1.454.CMB.1.raw
  modified_base (85)..(85): a, c, t, g, unknown or other
  misc_feature (85)..(85): n is a, c, g, or t
tcagtcacgtactacacgaccggtgctcgatttagatagatagacagggggagctacaacaggcaggcaggggcagcaagatggngttgcagacccaggtcttcatttctctgttgctctggatctctggtgcccacggggacatcgtgatcgacccagtctccagtacctcccgtggcttgtgtctcgtgggcgaggacgggcccaccatacaactgacgtaacgtccacgccagtagtttacgtttaacacacgtcctaacgaaacaagtaaacgtaacgttcttaggtaccgttcggttaaccgacgtacaacgaaaccgtaaggaacgtaacccaggacctccgttaaacgtcctagtacgttcgtacgttacgtacggtactacgtccgtacgtacccgggtacgtcccgggtacctcgtaccgtagttcggacgtgggccggtacggtccgggtacgtacgggtaccttacgtacttcctacctacctactaccgtacgtaccgacgtccgcgccgtacggacgtacgtacgtgtagtacggttagtaggttacgttacgtttacgtaacgtgtactaagtacttaacttaacgttacgtaccgttaccgtaccgttaccgtacgtccgtacggtacggttacgggtacgggtacgggacggtaacgggtacgtaacgtaacgtaacgtaacggtacgtacgg

SEQ ID NO: 1951 - DNA, 871 bp, Homo sapiens
  misc_feature: GYAE6OF01E1P3N.13.5.A05.1.454.CMB.1.raw
  modified_base (250)..(250): a, c, t, g, unknown or other
  misc_feature (250)..(250): n is a, c, g, or t
  modified_base (365)..(365): a, c, t, g, unknown or other
  misc_feature (365)..(365): n is a, c, g, or t
tcagtcacgtactacacgaccggtgctcgatttagatagatagacaggggagctacaacaggcaggcagggcagcaagatggtgtgcagacccaggtcttcatttctctgttgctctggatctctggtcgcccgacggggacatcgtgatgacccagtcctccaagtcctcccgtggctgtcgtctcgtgggcaggacggccaccatccgaacgtcgacaacgtccgagcctaggagttttcgttttaanaccgacgtacccttaccaaactaaacgtaacgtaaccgtttacgttaacgtccgtttcgggtaaccagaccaacggaaacccgaggaaccacggtccctaccgtaactcggtacncttacgtacgtttacgtaccgggtactactacgtaccggtaccggtaaccggttaccccggggttcctacggtacccgtactttaccggaaggttcgggacgtaacggggtccggggttcgtaccggggttaactacggtttaactttcccggtaaccctttacccgttacccgaaccctaacgtaccgtaacgaccgtaaccggttcccgaacgaccggtacggtaacgtacgggtaacgttacgggttacgtaacggttacgtttaaacgttttcgttaccgttacggtaaccgtaacgttaacccgttaaaagttttacgttaaaccgtttacgttaacccccggtttcccgttaccgggtaccggtttaccgtaccccgggtttaacccggtacgggggtaacccggttaaacgggggtaaaccccgggttaaggggtaccggttaacgggtaaaacccttaacggtaaaccgggttaccgttccgggttaacggtaccggg

SEQ ID NO: 1952 - DNA, 843 bp, Homo sapiens
  misc_feature: GYAE6OF01BILCF.13.5.A05.1.454.CMB.1.raw
  modified_base (184)..(184): a, c, t, g, unknown or other
  misc_feature (184)..(184): n is a, c, g, or t
  modified_base (394)..(394): a, c, t, g, unknown or other
  misc_feature (394)..(394): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctgtggtcgcccgacgggacatcgtgatcgacccagtcctccatacctcccgtggctgtntctacgtcgggcgaggcggcccacactacgaactgacgaacgtccacgacctaggtagtttagtttacacacgtcctaaccaaactaaagtaacgtaacctttacgttacgtacggtttacggtaaacccagtaccgaaaaccgaaacccgtaaggacctaccggtacccctaccgtaacgtcctacgtaccttacttacgtttaccggnggacttacttacgtaccggtaccgggtaccggtccccggtcctaacggaccgtacgtcgaggtcggtacggacgggtccggtaggtacggaacgttacgttaccgttaccctaccgttaccctaaccgtaaccctcgttaaccgcgttaccggaccgtttcccgtagggaacccgttaagggtcgtaaaggtacgtacgggtttgggtaccggtttaactttttacgtttaaacgttaccgtcggttaaagtaaccgttaaaccttaagttttaacttaaaccggttaccccgtttaacccgcccggtttaacgggaccgttttaccggttacccgtttaaacggggtcccggggtaaacgggtaaccccgggttaaggtaacggggttaacgtaaacgtaaacccggttaacccggttaaaggtcccggtttagggtccgttaacccg

SEQ ID NO: 1953 - DNA, 842 bp, Homo sapiens
  misc_feature: GYAE6OF01C7BTE.13.5.A05.1.454.CMB.1.raw
tcagtcacgtactacacgaccggtgctcgatttagatagatagacaggggactgatcaggactcctcagttcaccttctcacaatgaggctccctgctcagctccgtgggctgactaatgctcgtcgggtctcgtggactccaggtggggattagttgtgatcgactcatcctcctactcctcccgtcgcccgtccaacccgtggacgacggcccggtcctaccctatcccgttccgtgaccgtacggttactaacgacgacggactcccgtctagactaaagtaaagtaagtagtaattaaccgttacgtttagtttggggtagtttaggttactcgtacggacgtaacggaacggtaccgagggaccgaccgttcctacccaaccttaaccggtcctaagtaccgtttaagttacggtttaacggggttaaccgttaacggtccccgggggtacccgggttaccccgggttccggttaaacgacgtttacggggttacgaaccgggttcggacggtagggaacggttaaaggaaccgggtacaaacggtacgtttaacttttaaccgaacggtaaaagaacctacggaagtacggaagggtaggacgggtagtacggttaggtaagggtaacggtttaggggttttacgggttactaacgggttacgaagttaccgaggttaacggtacctacttaaccgtaacgtaccgttacggtaccgggtaacccgttccgggttaccggtaacccgggtacgggtaaaccgttaagggaaccgggttaaagtaaacccgttaacggaaacgttaacgggcgtttaaccggccgtacgtaaacccc

SEQ ID NO: 1954 - DNA, 888 bp, Homo sapiens
  misc_feature: GYAE6OF01AZFZ8.13.5.A05.1.454.CMB.1.raw
  modified_base (248)..(248): a, c, t, g, unknown or other
  misc_feature (248)..(248): n is a, c, g, or t
  modified_base (263)..(263): a, c, t, g, unknown or other
  misc_feature (263)..(263): n is a, c, g, or t
tcagtcacgtactacacgaccggtgctcgatttagatagatagacagggggagctacaacaggcaggcagggcagcaagatggtgttgcagacccaggtcttcatttctctgttgctctggatctctggtcgcccgacggggacatcgtgatcgacccagtctccagtacctccgtggctgtgtctcgtcgggcgaggtacggccacctactcaacgtgacaaacgtccagaccaggtagttgtttanacgcgtctaccaaanataacgtacttctagtacgttaggtaaccagtacgaacgtaaaccgacggaacctacggtacccctaccgtaacggtcgtacgtaccgttaacgttacgtttaacggtcgggtacctaaggttccgttaaccgggtaccccgggtaaacggtccccccggggtaacccgtacccggttagtacggtacgtaacgggtcgtaacggtcgggtcggtaacggaacgttacggtaaacgtttcccgtaaccgttacccgtaccgtaacctacgttacccgaacggccggttacccgtacgtacggtaaccggtaaccgggtacggttaaccggtaaaacggtcggtttaacgggttacggttaaccggtttaacgttttaacggttaccggttaacgttaaccgaacgttaacccgtttaaaagttttacccgttaaacggttttaaccggttaacccgttacccgtcccgggttaaacgttccccgttaacccgggtttaccggttttcccgggggaaccggttaaccggggtaaagggtcccggggttaaacggtaaccggttaaccggtaaacccgtaaacggttaaaccgggggttcgggttaccgtacccgggttaaccccgg

SEQ ID NO: 1955 - DNA, 828 bp, Homo sapiens
  misc_feature: GYAE6OF01BON3F.13.5.A05.1.454.CMB.1.raw
  modified_base (417)..(417): a, c, t, g, unknown or other
  misc_feature (417)..(417): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatcgacccagtcctccagacctcccgtggcttgtcgtctcgtgggaccgaggacgggcccaccgactccgaactcgacaacgtccacgaccgtagtacgttagttttacacgagtcctaaccgaaactaaataaacggttaaccttttacgtttaacggtacccgtttacgggtaaacccacggaaccgtaaacgaaaacccggacggaacccgtaccgtaccctaaccggttaactccgttcgtaccgttacttaacgtttacggnggtacctagttacgtacggtaccgggtaaccggtccccgggtaccacgtacccgttataccggtacggtgaccgtacgggtccggtacggtacggacttagttaccgttacgtacccttcggtaaccaccgtacgtacgaaccgccgtaaaccggtcctacggaaccgttggtcgtaaacgggtagtacgtttcgggacctttaacggtttacttttaccgtcggttaccgtaacgttaaggtaacctttaaacgtttacgtaccgtttaaccccgtaaccctttcccgggttaccgtaccgtttaacccgggttaccgggttttaccgggaccgggaaacgggttaacccggtgggtaaacgggtacgttaaacacggtaaacccgtaacggtcggttcgacccggtagg

SEQ ID NO: 1956 - DNA, 484 bp, Homo sapiens
  misc_feature: GYAE6OF02IPOBL.13.5.A05.1.454.CMB.1.raw
tcagtcacgtactacacgaccggtgctcgatttagatagatagacaggggagctacaacaggcaggcagggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccggaatccgggcctgaccgattcagtgcagcgggtctgggacagatttcactctcaccatcagcagcctgcaggctgaagatgtgcagtttattactgtcagcaatattatagtactctccgagctcactttcggcggaggccaaggtgagatcgaaacgaactgtgtcg

SEQ ID NO: 1957 - DNA, 262 bp, Homo sapiens
  misc_feature: GYAE6OF02ILMAH.13.5.A05.1.454.CMB.1.raw
  modified_base (260)..(262): a, c, t, g, unknown or other
  misc_feature (260)..(262): n is a, c, g, or t
tcagtcacgtactacacgaccggtgctcgatttagatagatagacagggagggccccgtaatggggcctggtggagggttcttctttgactgctgggccagggaaccctggtcaccgtctcctctgcctccaccaagggtccatcggtcttcccctggcgccctgctccaggagcacctccgagagcacagcggccctgggctgcctggtcaaggactacttcctagtacgtgactgagcgggctggcaaggcgcatagnnn

SEQ ID NO: 1958 - DNA, 496 bp, Homo sapiens
  misc_feature: GYAE6OF02H8X5M.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtcctgaccgattcagtggcagcgggtctggacagatttcactctcacatcagcagctgcaggctgaagatgtgctagtttattactgtacagcaattattatagtactcctcgagctactacgttcggcgagggaccaaggtggagataccgaaacgacgtgtgtcg

SEQ ID NO: 1959 - DNA, 262 bp, Homo sapiens
  misc_feature: GYAE6OF02HEZ0V.13.5.A05.1.454.CMB.1.raw
  modified_base (260)..(262): a, c, t, g, unknown or other
  misc_feature (260)..(262): n is a, c, g, or t
tcagtcacgtactacacgaccggtgctcgatttagatagatagacagggagggccccgtaatggggcctggtggagggttcttctttgactgctgggccagggaaccctggtcaccgtctcctctgcctccaccaagggcccatcggtcttcccctggcgccctgctccaggagcacctccgagagcacagcggccctgtgctgcctggtcaaggactacttcctagtacgtgactgagcgggctggcaaggcgcatagnnn

SEQ ID NO: 1960 - DNA, 264 bp, Homo sapiens
  misc_feature: GYAE6OF02GO09X.13.5.A05.1.454.CMB.1.raw
  modified_base (263)..(264): a, c, t, g, unknown or other
  misc_feature (263)..(264): n is a, c, g, or t
tcagtcacgtactacacgaccggtgctcgatttagatagatagacagggagggcccccgtaatggggcctggtggagggttcttctttgactgctggggccagggaaccctggtcaccgtctcctctgcctccaccaagggcccatcggtcttccccctggcgccctgctccaggagcacctccgagagcacagcggccctgggctgcctggtcaaggactacttcctagtacgtgactgagcgggctggcaaggcgcatagnn

SEQ ID NO: 1961 - DNA, 518 bp, Homo sapiens
  misc_feature: GYAE6OF02I024Z.13.5.A05.1.454.CMB.1.raw
  modified_base (403)..(403): a, c, t, g, unknown or other
  misc_feature (403)..(403): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagntgtgctagtttatactgtcagcaattattatagtacctcctcgaggtctcgtacgtttcggaccggtagggaaccctaagggtggagacgtaccgaaacgacgttaggtgtaccg

SEQ ID NO: 1962 - DNA, 493 bp, Homo sapiens
  misc_feature: GYAE6OF02ILONP.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtcctgaccgattcagtggcagcgggtctgggacagatttcactctcacatcagcagcctgcaggctgaagatgtgctagtttattactgtcagcaatattatagtactcctcgagctctacgttcggcgaggaccaaggtgagatacgaaacgtactgtgtcg

SEQ ID NO: 1963 - DNA, 498 bp, Homo sapiens
  misc_feature: GYAE6OF02IXY21.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcaggctgaagatgtggcagtttattactgtcagcaatattatagtactcctcgagctcactttcggcggagggaccaaggtggagagtacgaaacgactgtggtacg

SEQ ID NO: 1964 - DNA, 499 bp, Homo sapiens
  misc_feature: GYAE6OF02HW48C.13.5.A05.1.454.CMB.1.raw
  modified_base (403)..(403): a, c, t, g, unknown or other
  misc_feature (403)..(403): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaaacaataagaacttcttagcttggtaccagcagaaaccaggacagcctcctaagctgctcatttactgggcatctatccgggaatccgggtccctgaccgattcagtggcagcggtctgggacagatttcactctcaccatcagcagcctgcaggctagaagntgtggctagtttattactgtcagctaatattatagtactcctcgagtctctacgtttcggcggagggaccaaggtgagatacaaacgactgtgtcg

SEQ ID NO: 1965 - DNA, 506 bp, Homo sapiens
  misc_feature: GYAE6OF02IPN5Y.13.5.A05.1.454.CMB.1.raw
  modified_base (231)..(231): a, c, t, g, unknown or other
  misc_feature (231)..(231): n is a, c, g, or t
  modified_base (455)..(455): a, c, t, g, unknown or other
  misc_feature (455)..(455): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggctagtttattactgtcagcaattattaatagtacttcctcgagcctnacgtttcggcggagggacccaagggtgagacgtacgaaacgactggtagcg

SEQ ID NO: 1966 - DNA, 222 bp, Homo sapiens; identical to SEQ ID NO: 1865
  misc_feature: GYAE6OF02G9LGD.13.5.A05.1.454.CMB.1.raw
  modified_base (221)..(222): a, c, t, g, unknown or other
  misc_feature (221)..(222): n is a, c, g, or t

SEQ ID NO: 1967 - DNA, 493 bp, Homo sapiens
  misc_feature: GYAE6OF02JBI2R.13.5.A05.1.454.CMB.1.raw
  modified_base (489)..(489): a, c, t, g, unknown or other
  misc_feature (489)..(489): n is a, c, g, or t
tcagtcacgtactacacgaccggtgctcgatttagatagatagacagggggagctacaacaggcaggcaggggcagcaagatggtgttgcagacccaggtcttcatttctctgttgctctggatttctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtcctgaccgatcagtggcagcgggtctgggacagatttcactctcaccatcagcagctgcaggctgaagatgtgcagtttattactgtcagcaatattatagtactcctcgagctcacttcggcggagggaccaaggtgagagtacaacgactgtaggntacg

SEQ ID NO: 1968 - DNA, 496 bp, Homo sapiens
  misc_feature: GYAE6OF02IVWOI.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccggggtccctgaccgattcagtggcagcgggtctgggacagatttcactctcaccatcagcagcctgcaggctgaagatgtggcagtttattactgtcagcaatattattagtactcctccgaggctcactttcggcggagggaccaaggtggagatcaacgaactgtggcg

SEQ ID NO: 1969 - DNA, 508 bp, Homo sapiens
  misc_feature: GYAE6OF02GBUNV.13.5.A05.1.454.CMB.1.raw
  modified_base (231)..(231): a, c, t, g, unknown or other
  misc_feature (231)..(231): n is a, c, g, or t
  modified_base (448)..(448): a, c, t, g, unknown or other
  misc_feature (448)..(448): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcaggcgggtctgggacagatttcactctcaccatcagcagcctgcaggctgaagatgtggcagtttattactgtcagtcaatattatagtactcctcgngctcacgtttcggcggtacgggacctaaggtggacgagtaccaacggaactgtggtaccg

SEQ ID NO: 1970 - DNA, 505 bp, Homo sapiens
  misc_feature: GYAE6OF02I2V2M.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccgggtccctgaccgattcagtggcagcgggtctgggacagatttcactctcaccatcagcagcctgcacggctgaagatgtggctagtttattactgtacagcaatattatatactctccgagctctacttcgggcggtagggaccgaaggtggagacgtacaaacgaacgtgtaggtcg

SEQ ID NO: 1971 - DNA, 505 bp, Homo sapiens
  misc_feature: GYAE6OF02I2PVX.13.5.A05.1.454.CMB.1.raw
  modified_base (306)..(306): a, c, t, g, unknown or other
  misc_feature (306)..(306): n is a, c, g, or t
  modified_base (399)..(399): a, c, t, g, unknown or other
  misc_feature (399)..(399): n is a, c, g, or t
  modified_base (402)..(402): a, c, t, g, unknown or other
  misc_feature (402)..(402): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttacngggcatctatccgggaatccgggtcctgaccgattcagtgcagcggtctgggacagatttcactctcaccatcagcagcctgcaggctgaagntgngctagtttatactgtacagcaatattatagtactcctcgagctcgtacgtttcggcggtacgggaccaagggtgaacgtagtacgaaacgtacgttgtgtacg

SEQ ID NO: 1972 - DNA, 514 bp, Homo sapiens
  misc_feature: GYAE6OF02JYW1H.13.5.A05.1.454.CMB.1.raw
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttctagcttggtaccagcagaaaccaggacagcctcctaagctgctcatttacnggcatctatccggaatccgggtcctgaccgtntcagtggcaggcggtctgggacagactttcactctcacatcagcacgcctgcaggctagaagagtggtgtctagtttattacgtgtacgagctaatattatagtactccgtcgagtctctacgttcggacggaggaccgtaaggtggacgtacgtacgaacgtaacgtcggtaggtcg

SEQ ID NO: 1973 - DNA, 504 bp, Homo sapiens
  misc_feature: GYAE6OF02GLHB3.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccgggaatccggggtccctgaccgattcagtggcagcggtctgggacagatttcactctcaccatcagcagcctgcaggctgaagatgtggctagtttattactgtcagcaatattatagtactcctccgagctctacgtttcggacggtacgggaccaaggtgagatacgaaacgacgtgtggtacg

SEQ ID NO: 1974 - DNA, 512 bp, Homo sapiens
  misc_feature: GYAE6OF02H2HN6.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataaagaacttcttagcttggtaccagcagaaccaggacagcctcctaagctgctcatttactgggcatctatccggaatccgggtccctgaccgatttcagtggcagcgggtctgggacagattcacgtctcaccatcagcagcctgcaggctgaagatgtggctagtttacttacttgtctagactaatattaactagtactcctaccgagtctctacgtttcggacggaggaccgaaggtgagagtacaaacggtactgtggtacg

SEQ ID NO: 1975 - DNA, 535 bp, Homo sapiens
  misc_feature: GYAE6OF02G2JHW.13.5.A05.1.454.CMB.1.raw
  modified_base (231)..(231): a, c, t, g, unknown or other
  misc_feature (231)..(231): n is a, c, g, or t
  modified_base (306)..(306): a, c, t, g, unknown or other
  misc_feature (306)..(306): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttacnggcatctatccggaatccgggtcctgaccgattcagtggcagcggtctgggacagatttcactctacaccatcagcagcctgcaggctagaagatgtgctagtttattactgtacagacaatattatacgttactccgtaccgtaggtcttcgtacgtttcgggaccgggtaacgggtaaccgtaagggtcggaacgtactaaccgtaaacgacgttcggtaggtaccg

SEQ ID NO: 1976 - DNA, 507 bp, Homo sapiens
  misc_feature: GYAE6OF02HXKFB.13.5.A05.1.454.CMB.1.raw
  modified_base (345)..(345): a, c, t, g, unknown or other
  misc_feature (345)..(345): n is a, c, g, or t
tcagtcacgtactacacgaccggtgctcgatttagatagatagacagggggtgggtccaggaggcagaactctgggtgtctcaccatggcctggatccctctacttctcccctcctcactctctgcacagctctgaggcctcgtatgagctgacacagccactctcggtgtcagtgtccccaggacagacggccaggatcacctgctctgcagatgcattgccataacattttgcttattgctgtcagcagaaaccaggccaggccaggccaggccccctatattcctgatataaaaagacattgaaggggccctcagtgatccctgagcgattctctggctccntctcagggcaacagtcacgttgaccatcagtggagtccaggcagagggacgaggctagacctggttagtgactttcgagcgagaacaactagtcggaccttcgtagattttcggacgggaggaccaaccgttgaccgtctggccgtcacgcccaaggtcccg

SEQ ID NO: 1977 - DNA, 495 bp, Homo sapiens
  misc_feature: GYAE6OF02FVGH8.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccgggtccctgaccgattcagtggcagcggtctgggacagatttcactctcaccatcagcagcctgcaggctgaagatgtgctagtttatactgtcagcaatattatagtactcctccgagctcacgtttcggcggtagggaccaggtggagataccgaagactggtgtcg

SEQ ID NO: 1978 - DNA, 305 bp, Homo sapiens
  misc_feature: GYAE6OF02HNKK0.13.5.A05.1.454.CMB.1.raw
  modified_base (297)..(305): a, c, t, g, unknown or other
  misc_feature (297)..(305): n is a, c, g, or t
tcagtcacgtactacacgaccggtgctcgatttagatagatagacagggctctggagtccccagccgcttctctggatccaaggatgattccgccaacgcagggatattactcatctctgggctccagtctgacgatgaggctgactattactgtttgacttggcacaacaacgcctggatcttcggacctgggaccacggtcaccgtcctaggtcagcccaaggcccaaccccactgtcactctgttccccaccctcctctagtacgtgactgagcgggctggcaaggcgcatagnnnnnnnnn

SEQ ID NO: 1979 - DNA, 502 bp, Homo sapiens
  misc_feature: GYAE6OF02FR19F.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccgggtcctgatcgattcagtggcagcgggtctgggacagatttcactctcaccatcagcagcctgcaggctgaagatgtggctagtttattactgtcagcaatattatagtactcctcgagctcgtacgttcggcgggtacggaccgaaggtgagacgtacgaacgtacgtgtacgg

SEQ ID NO: 1980 - DNA, 507 bp, Homo sapiens
  misc_feature: GYAE6OF02IW9GC.13.5.A05.1.454.CMB.1.raw
  modified_base (305)..(305): a, c, t, g, unknown or other
  misc_feature (305)..(305): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttacnggcatctatccggaatccgggtcctgaccgattcagtggcagcgggtctgggacagatttcactctcaccatcagcagcctgcaggctgaagatgtggctagtttatactgtcagacaattattatagtactcctacgagtctcgtacgtttcggcggtacgggaccaaggtggacgtactacgaaacgacgtggtagtacg

SEQ ID NO: 1981 - DNA, 532 bp, Homo sapiens
  misc_feature: GYAE6OF02I4JT2.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatatctggtgcccacggggacatcgtgatgacccagtctccagactccctggctgtgtctctgggcgagagggccaccatcaactgcaagtccagccagagtgtttatacagctccaacaataagaacttcttagcttggtaccagcagaaaccaggacagcctcctaagctgctcatttactgggcatctatccgggaatccggggtcctgaccgattcagtggcagcgggtctgggacagtatttcacttctcacctatcagcagcctgcaggctagagagtgtcgcgtagtttatactgtcgagtctaatatttactagtacttaccgtcgtacgtccttcgtacgtttcgggccggtaagggtacccgaaggtaggtagacgtacgaacgtaacgtggtacgtacg

SEQ ID NO: 1982 - DNA, 557 bp, Homo sapiens
  misc_feature: GYAE6OF02FZGZ1.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcaagaaaccaggacagcctcctaagctgctcatttactgggcatctatccgggaatccggggtccctgaccgattcagtggcaggcgggtctgggacagtatttcactctcaccatcagcagcctgcaggctagaagatggtgctagtttattacgttgtcagtactaattattaattacgtaccttacctaccgtacggtccttacgtaccgtttcgggacgggtaacgggtaaccgtaagggttagggaacgtaacgttaccgaaacggtacgttaggtggtaccg

SEQ ID NO: 1983 - DNA, 524 bp, Homo sapiens
  misc_feature: GYAE6OF02JFQUK.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccaggacagcctcctaagctgctcatttactgggcatctatccgggaatccggggtccctgaccgattcagtggcaggcggtctgggacagatttcactctcaccatcagcagcctgcaggctagaagatgtggctagtttattactgtacagctaatattatagtacctctccgagctacacgtttcgggacgtacgggtaccgaacggttggaacgacgtacgaaaccggtacgttacggtggtacg

SEQ ID NO: 1984 - DNA, 505 bp, Homo sapiens
  misc_feature: GYAE6OF02GT0M3.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttcttagcttggtaccagcagaaaccagacagcccctaagctgctcatttactggcatctatccgggaatccgggtcctgaccgattcagtggcagcggtctgggacagattcactctcaccatcagcacgctgcaggctgaagatgtgctagtttactagtgtcagtcaattattatagtactcctacgagctctactttcggcggtaaggacctaaggtcggagtacgtacgaaacgactgtacggctacgg

SEQ ID NO: 1985 - DNA, 221 bp, Homo sapiens; identical to SEQ ID NO: 1842
  misc_feature: GYAE6OF02HF3HH.13.5.A05.1.454.CMB.1.raw
  modified_base (221)..(221): a, c, t, g, unknown or other
  misc_feature (221)..(221): n is a, c, g, or t

SEQ ID NO: 1986 - DNA, 561 bp, Homo sapiens
  misc_feature: GYAE6OF02I4TH2.13.5.A05.1.454.CMB.1.raw
  modified_base (405)..(405): a, c, t, g, unknown or other
  misc_feature (405)..(405): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttatacagctaccaacaataagaacttcttagcttggtaccagcagaaaccaggacagcctcctaagctgctcatttactggcatctagtccggaatccgggtccctgaccgtattcagtggcagcggtctgggacagtatttccactctcaccatcagcacgcctgcaggctagaagntgtggctagtttacttactgtacagtactaagttattaattacgtaccttccgtaccgtaggtccttacgtaccgtttacgggaccggtaacggggtaacccgtaacgggttaggaacggtactaaccggaaaccgtaacgttgggtacggtaccg

SEQ ID NO: 1987 - DNA, 514 bp, Homo sapiens
  misc_feature: GYAE6OF02I75SF.13.5.A05.1.454.CMB.1.raw
tcagtcacgtactacacgaccggtgctcgatttagatagatagacagggggtgggtccaggaggcagaactctgggtgtctcaccatggcctggatccctctacttctccccctcctcactctctgcacagctctgaggcctcgtatgagctgacacagccactctcggtgtcagtgtccccaggacagacggccaggatcacctgctctgcagatgcattgccataactattttgcttattgctgtcagcagaaaccaggccaggccaggccacggcccctatacttcctgataataaaaagacaattgaggggcctacagtgatccctgagcgattctcgtgctcatctcagggacaacacgtcacgtttgaaccatcagtggagtcgaggcaggaaggacgaggctagacttgttaggtgtactttcagtcaagacaagagtagtactacgttgagttttcggaaggtacggactaacgtcgaccgtcgtgctacgacgtaccgagtcccg

SEQ ID NO: 1988 - DNA, 557 bp, Homo sapiens
  misc_feature: GYAE6OF02I6V1L.13.5.A05.1.454.CMB.1.raw
  modified_base (310)..(310): a, c, t, g, unknown or other
  misc_feature (310)..(310): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagctccaacaataagaacttcttagtcttggtaccagcagaaaccaggacagcctacctaagctgctacatttacngggcatctagtccggaactccggggtccctagaccgattcagtggcaggcgggtctgggacagtactttcactcctcaccatcagcacgcctgacgaggctagaacgagttgtcggcttagtttacttatcgtacagtactaattattaagtacgtaccttccctacgaacggtcttacgtaccggtttcgggacggacgggtaacaagggtaggaacacgtaaccgaacgtaaccgtggtacgtcg

SEQ ID NO: 1989 - DNA, 224 bp, Homo sapiens
  misc_feature: GYAE6OF02GO8DZ.13.5.A05.1.454.CMB.1.raw
  modified_base (221)..(224): a, c, t, g, unknown or other
  misc_feature (221)..(224): n is a, c, g, or t
tcagtcacgtactacacgaccggtgctcgatttagatagatagacagggtggaggctgaggatgctggggtctattactgcatgcaagctacacactggcctccgctcaccttcggccaagggacacgactggagatagaacgaactgtggctgcaccatctgtcttcatcttcccgccatctgatagtacgtgactgagcgggctggcaaggcgcatagnnnn

SEQ ID NO: 1990 - DNA, 499 bp, Homo sapiens
  misc_feature: GYAE6OF02HWXXR.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctccaacaataagaacttcttagcttggtaccagcagaaaccaggacagcctcctaagctgctcatttactgggcatctatccggaatccgggtccctgccgattcagtggcagcgggtctgggacagatttcactctcaccatcagcagcctagcaggctgaagatgtgctagtttattactgtcagcaatattatagtacctcctccgagctctacgttcggacggagggaccgaaggtggagatacgaacgactggtgtcg

SEQ ID NO: 1991 - DNA, 516 bp, Homo sapiens
  misc_feature: GYAE6OF02F0F0G.13.5.A05.1.454.CMB.1.raw
  modified_base (231)..(231): a, c, t, g, unknown or other
  misc_feature (231)..(231): n is a, c, g, or t
  modified_base (242)..(242): a, c, t, g, unknown or other
  misc_feature (242)..(242): n is a, c, g, or t
  modified_base (404)..(404): a, c, t, g, unknown or other
  misc_feature (404)..(404): n is a, c, g, or t
  modified_base (407)..(407): a, c, t, g, unknown or other
  misc_feature (407)..(407): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaanaataagaacttcttagcttgtaccagcagaaaccaggacagcctcctaagctgctcatttactgggcatctatccgggaatccggggtccctgaccgattcagtggcaggcgggtctgggacagtatttcactctcaccatcagcagcctgcaggctgaagntgnggctagtttattactgtcagtactaattattatagtactaccgtccgagtctacacgtttcggacgtacgggaccgtaaggtcggagactaccgaagacgtggtagtcg

SEQ ID NO: 1992 - DNA, 519 bp, Homo sapiens
  misc_feature: GYAE6OF02JFCWY.13.5.A05.1.454.CMB.1.raw
  modified_base (230)..(230): a, c, t, g, unknown or other
  misc_feature (230)..(230): n is a, c, g, or t
  modified_base (399)..(399): a, c, t, g, unknown or other
  misc_feature (399)..(399): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctccaacaataagaacttcttagcttggtaccagcagaaaccaggacagcctcctaagctgctcattactgggcatctatccgggaatccgggtcctgaccgattcagtggcagcgggtctgggacagattcactctcaccatcagcagcctgcaggctgaaagngtgtggctagtttatactgtacagcaattattatagtactcctccgagctcacgtttcggacggtacgggaaccaagggttcggaacgtaagttccgaaaacggtacttaggtagtaccg

SEQ ID NO: 1993 - DNA, 598 bp, Homo sapiens
  misc_feature: GYAE6OF02H8RN2.13.5.A05.1.454.CMB.1.raw
  modified_base (455)..(455): a, c, t, g, unknown or other
  misc_feature (455)..(455): n is a, c, g, or t
  modified_base (590)..(590): a, c, t, g, unknown or other
  misc_feature (590)..(590): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatgacccagtctccagacctccctggctgtgtctcgtgggcgagagggccaccatcaactgcaagtccagccagagtgttttatacagcctacaacaataaacgtaacttcttagcttaggtaccagacaagaaccaggacagcctacctaagctgcctctactttacgcgggactatcgttaacgtccgggtaacgtccccggggtcctacggacccgtattccgagttcggcgacggcggtcgtagggactagtactttcactctacacatacacgcagcctgcgaggtctagaacgtgtcgngtactagtttattacgtagtacagtactaaattactttaagtactactaccgttaccgaggtaccttagtaccgttacgggacggtacgggtaaccgtaagggtgaacgtacgtaaccgaaaccgtacggttagnggtaaccg

SEQ ID NO: 1994 - DNA, 751 bp, Homo sapiens
  misc_feature: GYAE6OF02JWR8K.13.5.A05.1.454.CMB.1.raw
  modified_base (173)..(173): a, c, t, g, unknown or other
  misc_feature (173)..(173): n is a, c, g, or t
  modified_base (231)..(231): a, c, t, g, unknown or other
  misc_feature (231)..(231): n is a, c, g, or t
  modified_base (240)..(240): a, c, t, g, unknown or other
  misc_feature (240)..(240): n is a, c, g, or t
  modified_base (311)..(311): a, c, t, g, unknown or other
  misc_feature (311)..(311): n is a, c, g, or t
tcagtcacgtactacacgaccggtgctcgatttagatagatagacagggggagcgtacaacaggcaggcaggggcagcaagatggtgttgcagacccaggtcttcatttctctgttgctctggatctctggtgcccacggggacatcgtgatgacccagtctccagactcccnggctgtgtctcgtagggcgtagacgggccaccgatccaacgtgacaagtccagccagngttgtttanacagctaccaacaataacgaacttctagtctagtaccagcaacgaaccgaggacacgaccctaccgtaacncgtgtcctacgtacgtttaacgtcggggacctacttaccgtacggtccccggggtaaagttccccggggttccctaccggacccgttatttcccgaggttaccggcgacgggtaccgggttcgtaggggaacctaacggttactttacgtacccgttcgtaccaaccgtacgttaccggacgcccgtaacgacccggtgtacccgaaggggtccctaagggtaacgtaacgttcgggtccggtaacgttaggtttttaaccgtaccgttagttaccgtaacgtagttaaactttacgtttaagttaaccggttacccttaccgtacccggtaaggtcccttacggttaccggttaacgggccgggttaacgggaaccggtttaacgggcggtaacgaaccggtaacccggtaaagggtaccggtttcggcggttaacccg

SEQ ID NO: 1995 - DNA, 558 bp, Homo sapiens
  misc_feature: GYAE6OF02G9ASH.13.5.A05.1.454.CMB.1.raw
  modified_base (232)..(232): a, c, t, g, unknown or other
  misc_feature (232)..(232): n is a, c, g, or t
  modified_base (314)..(314): a, c, t, g, unknown or other
  misc_feature (314)..(314): n is a, c, g, or t
  modified_base (368)..(368): a, c, t, g, unknown or other
  misc_feature (368)..(368): n is a, c, g, or t
  modified_base (419)..(419): a, c, t, g, unknown or other
  misc_feature (419)..(419): n is a, c, g, or t
  modified_base (426)..(426): a, c, t, g, unknown or other
  misc_feature (426)..(426): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagcctaccaaacaataaagaacttcttagcttggtaccagcaagaaaccaggacagccctcctaagctagctcatttacngggtcatctatccgggaatcccgggtccctgaccgattcagtgcaggtcgggtntcgggacagtatttcactcacaccatacagcagcctgcgaggtctagaagngttaggnggtctagtttattacgtgttacagtactaatattaactacgttactccgtaccgagtcctacttaccggttaccggcggaacgggtaaccgtaaggtggaacggtactaacgaacgtaacgtggtcggtacg

SEQ ID NO: 1996 - DNA, 596 bp, Homo sapiens
  misc_feature: GYAE6OF02FH0M4.13.5.A05.1.454.CMB.1.raw
  modified_base (236)..(236): a, c, t, g, unknown or other
  misc_feature (236)..(236): n is a, c, g, or t
  modified_base (355)..(355): a, c, t, g, unknown or other
  misc_feature (355)..(355): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccaccatcaactgacaagtcccagccagagttgttttanacagctaccaaacaataagaacttcttagtcttggtaccagcaagaaaccaggacagcctcctaagctgctcatttactgggcatctacgtccgggtaacgtccgggtcctcgaccgtnttcaggtggcgaggcgggtcgtagggacagtacttcactctaccacactcacgacacgcctcgaccgaggaccgtaggaagtagtggtacggtacgttagttttaacttagttacgtacgacgtactaattaattaagttacgttacctccgtaccgtacgtctaccgtacggtttcggacgggtacgggtaaccgtagggtaggtacgtacgtaaccgtaacggtacgtcggtacgtacg

SEQ ID NO: 1997 - DNA, 632 bp, Homo sapiens
  misc_feature: GYAE6OF02JHAOW.13.5.A05.1.454.CMB.1.raw
  modified_base (230)..(230): a, c, t, g, unknown or other
  misc_feature (230)..(230): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgtttanacagctaccaacaataagaacttcttagcttggtaccagcaagaaaccaggacagcctacctaagctgctctatttacgtcgggcatctagtccgggaagtccgggtccctgacccgattcgagtggcaggcggggtctcgggactaggtatttccgaactcctaccacctatacgacgccacgcccttaggccacgggccttaggaacgtagtggtacgggtacttaaggttttacttaacgtgtacccgtaaggtactaaactttattaagttaacgttacccttcccgtaccggtacgtccttaccggtaccggtttcggggaccgggtaacgggtaaccgtaagggtacggtaacgtacgtaaccggtaaaccggtaacggttcggtaccggtaccgg

SEQ ID NO: 1998 - DNA, 622 bp, Homo sapiens
  misc_feature: GYAE6OF02JODX7.13.5.A05.1.454.CMB.1.raw
  modified_base (234)..(234): a, c, t, g, unknown or other
  misc_feature (234)..(234): n is a, c, g, or t
  modified_base (299)..(299): a, c, t, g, unknown or other
  misc_feature (299)..(299): n is a, c, g, or t
  modified_base (312)..(312): a, c, t, g, unknown or other
  misc_feature (312)..(312): n is a, c, g, or t
  modified_base (353)..(353): a, c, t, g, unknown or other
  misc_feature (353)..(353): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctgctgtgtctcgtgggcgagagggccaccatcaactgacaacgtccagccagagttgttttanaccagcctaccaacaataagaacttcttagcttggtaccagcagaaccagacagcctacaagctnctactacttacgnggactatactacgtccggaagtcccgggtcctacgaccgtnttcgagtcgcgtacggcgggtacgtgggacaggttacttccacgttcctaccacctatccacgacgacgccgtcgagtaacggcgtacggaagtagtcggtacgacttacgtttacgtttctagttacacggtactaagttaacgttacgttacgttaccgtccgttaccgacggtaccttacgtaccggttaccgggaaccggtacgggtaaaccggtagggtaggtacggtaaacgtaccggtaaaaccgcgttaggtacgtaccgg

SEQ ID NO: 1999 - DNA, 269 bp, Homo sapiens; identical to SEQ ID NO: 1873
  misc_feature: GYAE6OF02I2VBE.13.5.A05.1.454.CMB.1.raw
  modified_base (262)..(269): a, c, t, g, unknown or other
  misc_feature (262)..(269): n is a, c, g, or t

SEQ ID NO: 2000 - DNA, 618 bp, Homo sapiens
  misc_feature: GYAE6OF02F9BGQ.13.5.A05.1.454.CMB.1.raw
  modified_base (233)..(233): a, c, t, g, unknown or other
  misc_feature (233)..(233): n is a, c, g, or t
  modified_base (317)..(317): a, c, t, g, unknown or other
  misc_feature (317)..(317): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgcaagtccagccagagttgttttanacagctccaaacaataagaacttcttagcttaggtaccagacagaaaccaggacacgcctacctaagctgcctactatttacgngggcactactacgtaccgggtaactcccggggtccctggacccgtattccgaggtcggcgacggcggtcgtgggactagtactttcactctacaccatcagcacgtcctgcaggcagaagtgtgtagtactagttttattacgtgtacaagtactaatttacttaagttacgttacccgttaccgtaccgtacggtccttacggttaccggtttccgggaaccggggtaacgggtaaccggtaagggtacggtaacggtaacgttaaccgaaaccggttacggttacggtacggttacccg

SEQ ID NO: 2001 - DNA, 725 bp, Homo sapiens
  misc_feature: GYAE6OF02IXVOJ.13.5.A05.1.454.CMB.1.raw
tcagtcacgtactacacgaccggtgctcgatttagatagatagacagggggtgggtccaggagcagaactctgggtgtctcaccatggcctggatccctctacttctccccctcctcactctctgcacagccctgaggcctcgtatgagctgacacagccactctcggtgtcagtgtccccaggacagacggccaggatcacctgctctgcagatgcattgccataacattttgcttattgctgtcagcaagaaaccaggccaggccaggcccaggccccctatacttcctgaactaataaaaacgactaattcggaagggggccccttacaggttcgaacttccccgtaggacgcggtaactttccgtcgttcggaccttcccgaattccttacgaacggggtaaccaaaccgtacgttacctaacggttaccgtaacccaattaccgaggttggaacggtacccgagggaccgaagggaacgggaacggaacgggtccgtaggtaacccgttagggtttaagtcggttaacgtttaccgtaggacgtaacgaaccgtaaaccgtagggttaccgggtaaccgttttaccggttaacggtttacgttttaaccgggtaaccgggtaacggggtaaaccctaaacggttaaccggtaacccggttacccgtacggtaccggtaccgtaaccggaccccggtaaacggtcccggttaacccccggg

SEQ ID NO: 2002 - DNA, 588 bp, Homo sapiens
  misc_feature: GYAE6OF02H1NEP.13.5.A05.1.454.CMB.1.raw
  modified_base (411)..(411): a, c, t, g, unknown or other
  misc_feature (411)..(411): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaagtccagccagagtgtttatacagctacaacaataacgaactttactagcttggtaccagcaagaaccaggacacgccctactaagctgctcatttacgcgggctactcgtacgtccgggtaacgtccggggtcctagacccgtattcgaggtcggacgacggcgggtcgtagggacagtactttcaccgtctacacctntacgacgctacgccgtcgacgaggtcctaggacgtagtggtcggtactaagtttactaacgtgtactagtaactaattactttaagtctaactccgtaccgtaggtacctcgttacgttcgggaccgagggtaaccgtaaggcggacgtaacgtaccgtaaacgtcgtaggtgtacg

SEQ ID NO: 2003 - DNA, 496 bp, Homo sapiens
  misc_feature: GYAE6OF02HMO66.13.5.A05.1.454.CMB.1.raw
  modified_base (306)..(306): a, c, t, g, unknown or other
  misc_feature (306)..(306): n is a, c, g, or t
  modified_base (339)..(339): a, c, t, g, unknown or other
  misc_feature (339)..(339): n is a, c, g, or t
  modified_base (392)..(392): a, c, t, g, unknown or other
  misc_feature (392)..(392): n is a, c, g, or t
  modified_base (471)..(471): a, c, t, g, unknown or other
  misc_feature (471)..(471): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctgactgtgtctctgggcgagagggccaccatcaactgcaagtccagccagagtgttttatacagctccaacaataagaacttcttagcttggtaccagcagaaaccaggacagcctcctaagctgctcatttacngggcatctatccgggaatccgggtcctgaccgnttcagtgcagcggtctgggacagatttcacttctcaccatcacgcacgctgcngctgaagtatgtgctagtttatatgtacagcaattattatagtactcgtcgagctctacgttcggcggaggacctaggnggagactacgaacgactggtgtacg

SEQ ID NO: 2004 - DNA, 684 bp, Homo sapiens
  misc_feature: GYAE6OF02HH6BP.13.5.A05.1.454.CMB.1.raw
  modified_base (235)..(235): a, c, t, g, unknown or other
  misc_feature (235)..(235): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacgggacatcgtgatgacccagtctccagacctccctggctgtgtctcgtgggcgagacgggccaccatcaactgacaagtccagccagtagttgtttanacagcctaccaaacaataacgtaacttcttagtcttacggtaccagtacaacgaaaccaggacacgccctactaagtctgccttactatttacgcggtactattcgtaacggtccgggtaacgtccccgggtcctacgtaccgtacttcgaggtcggcgagggtcgggtcgtacgggactacggtactttccacgttcctaccaacctacgtacgacgaccgacgtcctcggtaccacgggtactaacgggtaaagttcggttacggtacgggttaacttttacggttttaactttaacggttcggttaaccaacgttaaacgttaattttaacgtttaagttaccggttacccttacccggtacgtaccgtaccgttacggttaccggttcgggaccgggtaacggtacgtagggtacgacgtactaacgaacggtacgtggcgtacg

SEQ ID NO: 2005 - DNA, 739 bp, Homo sapiens
  misc_feature: GYAE6OF02I4MAD.13.5.A05.1.454.CMB.1.raw
  modified_base (146)..(146): a, c, t, g, unknown or other
  misc_feature (146)..(146): n is a, c, g, or t
  modified_base (237)..(237): a, c, t, g, unknown or other
  misc_feature (237)..(237): n is a, c, g, or t
tcagtcacgtactacacgaccggtgctcgatttagatagatagacagggggagcggtacaacaggcaggcaggggcagcaagatggtgttgcagacccaggtcttcatttctctgttgctctggatctctggtgcccacggggacngtcggtgatcgacccagtctccagctccctggctgtcgtctcgtgggcgaggacggccaccatcaactcgcaagtccagcagagtgtttanacagctacaaactaagtaacgaactttcgtaagtcgttaggtaaccaggacaaagaaaacccgtaggaacctacgtaccctaccgtaacgcctagtaccttactaacgttttacggacgggtctaactttacgtacggttacccggggaacgttaccccggggtcctacgggacctaagttccgaggttcggcgacgggtcggtcgtagggaactaggttaacttccaacgtttccaccgaacttacgtaccaacggtccgtaacggtccgtacggaccggaaggtaccttaagggaaacgtttaggttcggtaaccgggttactttaacgttttaaccggttaacgtacgttaaccgtaagtaacgtttaaaactttcggtttaaacttaccgttacccgttaccggtacggaccgttacgttacgtttaacgggcgacggggtaacgtaacggtaacggtagtacgtaaccgtaacgtaacggtacgttaggttaccgcg

SEQ ID NO: 2006 - DNA, 528 bp, Homo sapiens
  misc_feature: GYAE6OF02GJ7XQ.13.5.A05.1.454.CMB.1.raw
  modified_base (232)..(232): a, c, t, g, unknown or other
  misc_feature (232)..(232): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttanacagctccaacaataagaacttcttagcttggtaccagcagaaaccaggacagcctcctaagctgctcatttactgggcatctatccggaatccggggtccctgaccgattcagtcggcagcgggtctgggacagatttcactctcaccatcagcagcctgcaggctgaagatgtgctagttttattactgtacagctaattattaatagttacctcctccgaggtcctctacgttcgggacggtacgggaaccgtaagggtggaagactacgaaaccggtacgttggtagtaccg

SEQ ID NO: 2007 - DNA, 602 bp, Homo sapiens
  misc_feature: GYAE6OF02ISSQ3.13.5.A05.1.454.CMB.1.raw
  modified_base (231)..(231): a, c, t, g, unknown or other
  misc_feature (231)..(231): n is a, c, g, or t
  modified_base (310)..(310): a, c, t, g, unknown or other
  misc_feature (310)..(310): n is a, c, g, or t
  modified_base (369)..(369): a, c, t, g, unknown or other
  misc_feature (369)..(369): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttcttagcttaggtaccagcaagaaaccaggacacgccctacctaagctgctcattcnggcatctatccggagtccgggtcctgaccgtattcagtgcgaggcggtcgtggacagtnttacactctacactactcacgcagccgtgcacggtctagaagtacgtggtacgtacgtagttttacttacgttcgtactagtactaaattactttaacttaacgttaccttccgtaccggtcggtaccttaccgttaccggttttacgggaccggggtaacgggaacccgtaaaggggttacgggaacggtaacgttaaccgaaaccggtaacggtttacggtaggtacccgg

SEQ ID NO: 2008 - DNA, 554 bp, Homo sapiens
  misc_feature: GYAE6OF02GRHD5.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaaacaaataagaacttcttagcttggtaccagcaagaaaccaggacagccctcctaagctgctctatttactgggcatctatccgggaatccggggtccctgaccgattcagtggcagcggtctgggacagtatttcactctacaccatcagcacgctgcagctagaagatgtaggtctagtttacttacgtgtacagtacgtaattattaatagttactccgtacgtacgtcttactaccgtttcgggaccggtacgggtaaccgaagggttaggaacgtacgtaaccgaaaaccggtagttaggtggtaccg

SEQ ID NO: 2009 - DNA, 548 bp, Homo sapiens
  misc_feature: GYAE6OF02GNS9G.13.5.A05.1.454.CMB.1.raw
  modified_base (309)..(309): a, c, t, g, unknown or other
  misc_feature (309)..(309): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctaccaacaataagaacttcttagcttggtaccagcagaaaccaggacagccctactaagctgctcatttacgnggcatctagtccgggaatccgggtcctgaccgattcagtggcaggcgggtctagggacagtatttcactctcaccatcacgcagcctgcaggctagaatagtgtgactagtttatacgtgtcagactaattattaagtacgttacctccgtaccgtaggtccttactacggtttcggacgggtacgggaccgtaagggtggacgtacgtaccgtaaacggtacgttacggtaggtaccg

SEQ ID NO: 2010 - DNA, 541 bp, Homo sapiens
  misc_feature: GYAE6OF02I4GLH.13.5.A05.1.454.CMB.1.raw
  modified_base (231)..(231): a, c, t, g, unknown or other
  misc_feature (231)..(231): n is a, c, g, or t
  modified_base (307)..(307): a, c, t, g, unknown or other
  misc_feature (307)..(307): n is a, c, g, or t
  modified_base (412)..(412): a, c, t, g, unknown or other
  misc_feature (412)..(412): n is a, c, g, or t
tcagtcacgtactacacgaccggtgctcgatttagatagatagacagggggagctacaacaggcaggtaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctaccaacaataagaacttctagcttggtaccagcaagaaaccaggacagcctactaagctgctcatttacnggcatctatccgggaatccggggtcctgaccgtattcgagtggcaggcgggtctaggggactagtatttcatttctcacctatcagcagcctgacgagccgaagngtgtgctagtttattactgtacagactaattattagtacgtaccttccgtaccgagtcttacctacgtttcggacggtacgggaaccctaagggtgagataacgaacgtaacgtggcggtctagtaccc

SEQ ID NO: 2011 - DNA, 331 bp, Homo sapiens
  misc_feature: GYAE6OF02IR1ZQ.13.5.A05.1.454.CMB.1.raw
  modified_base (255)..(255): a, c, t, g, unknown or other
  misc_feature (255)..(255): n is a, c, g, or t
  modified_base (295)..(295): a, c, t, g, unknown or other
  misc_feature (295)..(295): n is a, c, g, or t
  modified_base (316)..(331): a, c, t, g, unknown or other
  misc_feature (316)..(331): n is a, c, g, or t
tcagtcacgtactacacgaccggtgctcgatttagatagatagacagggctctggagtccccagccgcttctctggatccaaggatgattccgccaacgcagggatattactcatctctgggctccagtctgacgatgaggctgactattactgtttgacttggcacaacaacgcctggatcttcggacctggaccacggtcaccgtcctaggtcagccccaaggcccaaccccactgtccacttcctgttcccnccgtcccctcctacgtacgtacgctacgacgtacgggcgngtcggagaacggcactagagnnnnnnnnnnnnnnnn

SEQ ID NO: 2012 - DNA, 506 bp, Homo sapiens
  misc_feature: GYAE6OF02HETOA.13.5.A05.1.454.CMB.1.raw
  modified_base (232)..(232): a, c, t, g, unknown or other
  misc_feature (232)..(232): n is a, c, g, or t
  modified_base (308)..(308): a, c, t, g, unknown or other
  misc_feature (308)..(308): n is a, c, g, or t
  modified_base (410)..(410): a, c, t, g, unknown or other
  misc_feature (410)..(410): n is a, c, g, or t
  modified_base (500)..(500): a, c, t, g, unknown or other
  misc_feature (500)..(500): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaaactgcaagtccagccagagtgttttanacagctccaaacaataagaacttcttagcttggtaccagcagaaaccaggacagcctcctaagctgctcatttacngggcatctatccgggaatccggggtccctgaccgattcagtggcagcgggtctggggacaggatttcactctcaccatcagcagcctgcaggctgaagatgnggcagtttattactgtcagcaaatattataagtactcctcgaggctctactttcggcggtagggaccaaggtggagatcaaacgaactgnggtacg

SEQ ID NO: 2013 - DNA, 581 bp, Homo sapiens
  misc_feature: GYAE6OF02HVYJW.13.5.A05.1.454.CMB.1.raw
  modified_base (231)..(231): a, c, t, g, unknown or other
  misc_feature (231)..(231): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacagctccaacaataagaacttctagcttggtaccagcagaaacagacagcctctaagctgctcattactggcatctagtaccgggaatcccggggtcctacgaccgtatttccgaaggttggacaggccgggttcgtagggacaagtattttcacctcgtaccacctatcaagcacgcctgcaggtctagaaagtatggtaggactaagtttaacttacgttgtacagactaaattattaataacgttaacttcccgtaccgagtcctacgtaccgtttcgggccggtaacgggtaaccgtaacggtaggaaggtaactaccgaaaaccggtaacgtcggtaggtaccg

SEQ ID NO: 2014 - DNA, 556 bp, Homo sapiens
  misc_feature: GYAE6OF02FWU36.13.5.A05.1.454.CMB.1.raw
  modified_base (308)..(308): a, c, t, g, unknown or other
  misc_feature (308)..(308): n is a, c, g, or t
  modified_base (408)..(408): a, c, t, g, unknown or other
  misc_feature (408)..(408): n is a, c, g, or t
  modified_base (432)..(432): a, c, t, g, unknown or other
  misc_feature (432)..(432): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagttgttttatacagataccaacaataagaacttcttagcttggtaccagcagaaaccaggacagcctcctaagctgctcatttacnggcatctatccgggaatccgggtcctgaccgattcacgtggcagcgggtctgggacagtatttcactctcaccatcagcagcctgcacggctgaagatgnggctagttttacttacttgtaccngactaattatttataacgttaccttcctccggtacgtcttactaccggtttcgggacggtaacggggaacccgtaagggtacgggtagaacgtaaccgtaaacggtacgtacgggtggtaccgg

SEQ ID NO: 2015 - DNA, 544 bp, Homo sapiens
  misc_feature: GYAE6OF02H6S3T.13.5.A05.1.454.CMB.1.raw
  modified_base (132)..(132): a, c, t, g, unknown or other
  misc_feature (132)..(132): n is a, c, g, or t
  modified_base (234)..(234): a, c, t, g, unknown or other
  misc_feature (234)..(234): n is a, c, g, or t
  modified_base (249)..(249): a, c, t, g, unknown or other
  misc_feature (249)..(249): n is a, c, g, or t
  modified_base (292)..(292): a, c, t, g, unknown or other
  misc_feature (292)..(292): n is a, c, g, or t
  modified_base (321)..(321): a, c, t, g, unknown or other
  misc_feature (321)..(321): n is a, c, g, or t
  modified_base (365)..(365): a, c, t, g, unknown or other
  misc_feature (365)..(365): n is a, c, g, or t
  modified_base (383)..(383): a, c, t, g, unknown or other
  misc_feature (383)..(383): n is a, c, g, or t
  modified_base (408)..(408): a, c, t, g, unknown or other
  misc_feature (408)..(408): n is a, c, g, or t
  modified_base (427)..(427): a, c, t, g, unknown or other
  misc_feature (427)..(427): n is a, c, g, or t
  modified_base (443)..(443): a, c, t, g, unknown or other
  misc_feature (443)..(443): n is a, c, g, or t
  modified_base (496)..(496): a, c, t, g, unknown or other
  misc_feature (496)..(496): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtncccacggggacatcgtgatgacccagtctccagactccctggctgtgtctcgtgggcagagggccaccatcaactgacaagtccagccagtagttgttttanaccagcctccaaaanaataagaactttcgttaagcttggtaacccagccaagaaaccnggacagccctccaagctgctcatttacgnggccattctacgtcggacttcccgggcctagaccgtattcaggngcgagcgggtgtgggacngtattaccactctcacctatcagcngtcctgcaggcctagagtngtgctattttatacgngtacagactaattacttataactccttccgtacgtgtcctcgttacgttcggnggtaccggactaggtacgaggtacaccggaaacgtacgtcggtgtccg

SEQ ID NO: 2016 - DNA, 222 bp, Homo sapiens; identical to SEQ ID NO: 1865
  misc_feature: GYAE6OF02FRFF4.13.5.A05.1.454.CMB.1.raw
  modified_base (221)..(222): a, c, t, g, unknown or other
  misc_feature (221)..(222): n is a, c, g, or t

SEQ ID NO: 2017 - DNA, 548 bp, Homo sapiens
  misc_feature: GYAE6OF02FGSE7.13.5.A05.1.454.CMB.1.raw
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
  modified_base (306)..(306): a, c, t, g, unknown or other
  misc_feature (306)..(306): n is a, c, g, or t
  modified_base (406)..(406): a, c, t, g, unknown or other
  misc_feature (406)..(406): n is a, c, g, or t
  modified_base (446)..(446): a, c, t, g, unknown or other
  misc_feature (446)..(446): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacngctccaacaataagaacttcttagcttggtaccagcagaaaccaggacagcctcctaagctgctcatttacngggcatctagtccgggaactccggggtccctgaccgattcagtggcaggcgggtctgggacagtatttcactctcacatcagcacgctgcagctagaagntgtgactagtttattactgtacagtactaaattatttaanacgtactcccgtacggacgtactccgtaccgtttcgggacgggtaacgggaaccgtaagggtacggaagtacgtaaccgaaacgtacgttggtacggtaccg

SEQ ID NO: 2018 - DNA, 741 bp, Homo sapiens
  misc_feature: GYAE6OF02HTU7R.13.5.A05.1.454.CMB.1.raw
tcagtcacgtactacacgaccggtgctcgatttagatagatagacagggggagctacaacaggcaggcagggcagcaagatggtgttgcagacccaggtcttcatttctctgttgctctggatctctggtgcccacggggacatcgtgatcgacccagtctccagacctcccgtggctgtgtctgtggcgaggacggccaccatctaactgacaacgtccagccagtagttacgttttaatacgagtcctaccaaactaattaaagtacctttacgttaagcgtttacggaccagaccgaacgaaaccgagggaactaggtaccccttaccgtaaacgtcgtacgtacctacgttaacgttttaccggtacgggtactaacgttaccgttaaaccggttacccggggtaaccggttacccccggggttacccttaaccggtacccgtaagtttccggaaggttcggaccgtacggtcgggtacgtacggactaggtactttacgcttaccgtacacctagtacgacgctacgtccgtgaccgtaggtactaggtaacgtacgtggttagtacgttagttttacgtacgttagttacgacgtaacttaagttaacgtttaactaacgttccttaccgtacgtaccgttctaccggtttaccggttcgggacggtaaccgggtaaccgtaaggggtacgtaacgtacgtaaaccggtaacgtaacggttcggtaccggtaccg

SEQ ID NO: 2019 - DNA, 572 bp, Homo sapiens
  misc_feature: GYAE6OF02F6GLE.13.5.A05.1.454.CMB.1.raw
  modified_base (416)..(416): a, c, t, g, unknown or other
  misc_feature (416)..(416): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctaccaacaataagaacttcttagcttggtaccagcagaaaccaggacagcctcctaagctgctcatttactgggcatctagtccgggaatccggggtccctagaccgattcagtggcagcgggtctgggacagtatttcactcctcaccatcagcacgtccgtgacgacggctgaaagtntggtcgtcttagttttacttagtcgtacagtacgtaattaacttagtaaccgttacctcctaccgtacgtccttacgtaccggtttccgggacgggacgggtaaccgtaagggtaggtacgtacgtaaccgaaacggtacgtacggtcggtaccgg

SEQ ID NO: 2020 - DNA, 672 bp, Homo sapiens
  misc_feature: GYAE6OF02FUJ6T.13.5.A05.1.454.CMB.1.raw
  modified_base (233)..(233): a, c, t, g, unknown or other
  misc_feature (233)..(233): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcagagggccaccatcaactgacaagtccagccagagttgttttanacagctaccaaacaataagaacttctaagcgttacggtaccagtacaagaaaccaggacacgcctaccgtaagcctgcctactatttacgtgggctagttctacgtccggggtaactcccggggtcccctaggacccgtattccgaggtcggcgtacggtcgggttcgtaggggactaggtactttccacttcctacctaccactcgagaccacgtccgtagccgacggctaggaagtagttacggtgtacgttagttttacgttacgttgtactacgtactaaagttactttaacgttaaccgttaccgttacccgtaccggttacggtacccgttaccggttaccggtttccggggaaccggtaaccggggtaacccgttagggtaacgggtacggtaacgtaaccggaaacggtaccggttacggtacggttaccg

SEQ ID NO: 2021 - DNA, 506 bp, Homo sapiens
  misc_feature: GYAE6OF02HO1VQ.13.5.A05.1.454.CMB.1.raw
  modified_base (231)..(231): a, c, t, g, unknown or other
  misc_feature (231)..(231): n is a, c, g, or t
  modified_base (234)..(234): a, c, t, g, unknown or other
  misc_feature (234)..(234): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttanacngctccaacaataagaacttcttagcttggtaccagcagaaaccaggacagcctctaagctgctcatttactgggcatctatccgggaatccgggtccctgaccgattcagtggcagcgggtctgggacagatttcactctcaccatcagcagcctgcaggctgaagatgtgctagtttacttactgtcagcaatattatagtactccgtcgaggtctctacgtttcggcggtagggaccgaaggtggagtacgtacaaagacgtgtagtacg

SEQ ID NO: 2022 - DNA, 766 bp, Homo sapiens
  misc_feature: GYAE6OF02JVPT6.13.5.A05.1.454.CMB.1.raw
  modified_base (180)..(180): a, c, t, g, unknown or other
  misc_feature (180)..(180): n is a, c, g, or t
  modified_base (224)..(224): a, c, t, g, unknown or other
  misc_feature (224)..(224): n is a, c, g, or t
  modified_base (233)..(233): a, c, t, g, unknown or other
  misc_feature (233)..(233): n is a, c, g, or t
  modified_base (240)..(240): a, c, t, g, unknown or other
  misc_feature (240)..(240): n is a, c, g, or t
  modified_base (261)..(261): a, c, t, g, unknown or other
  misc_feature (261)..(261): n is a, c, g, or t
  modified_base (270)..(270): a, c, t, g, unknown or other
  misc_feature (270)..(270): n is a, c, g, or t
tcagtcacgtactacacgaccggtgctcgatttagatagatagacagggggagctacaacaggcaggcgagggcagcaagatggtgttgcagacccaggtcttcatttctctgttgctctggatctctggtgcccacggggtacatcgtgatcgacccagtctcagactccctggctgtntctgtgggcgtaggacgggccacgtatacaactgctaagtccanccagcgttntttacanagtctcaacatagactcttanctggtaccngacgacgaaaccgtgacacgctaccgtaagctcgacgtacttactttacgacgggtctacgttactaaccgttaccgggaaggtccccggggttacccgtacggtacccgtacgttaccgaacggtttccgggacgtaacgggtccgggggttaccttcggggaaaccgtacggtaccgttttacccggaaccttccgtaccgtaacccgtactaccggtaaccgtacgtaccgtaccgttcggaccggtacgggtacccgttaaacgggaaacgttcggttaaccgggttacgggttaacccgtttaaacggttttaccggtttttaacgtacgtttacccggttaacgttaccgtaaagttttacgttaacgtttaaccggtaacccgtaccgttaccgaccgttactacggtttacgttcccgggtacgggttaacggaacccggttaaggtccggtaacgtactaaccgtaaacgcgttacggtacgtacgg

SEQ ID NO: 2023 - DNA, 679 bp, Homo sapiens
  misc_feature: GYAE6OF02I5TCR.13.5.A05.1.454.CMB.1.raw
  modified_base (289)..(289): a, c, t, g, unknown or other
  misc_feature (289)..(289): n is a, c, g, or t
  modified_base (498)..(498): a, c, t, g, unknown or other
  misc_feature (498)..(498): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtcctccagactccctggctgtgtctcgtgggcgagacggccacatcaactgacaagtccagccagtagttgttttaagtacagtcctaccaacaataagtacttacttagcttacgtaccagcaagaaacnggaccagtccctaccgtaaggcctggacctactaacgtttaccgtgggactacgtacttacggtaccggggtaacgttcccgggtaccctcgaaccgtacttcgaacgtggccgtaggccggttcgaggggtacacggtttacttcaccttcgtacctaccgatccgacgtcgacgtccgtcgaccgtacggatacgggaaagttcggngttacggtacgttaacgttacgttcgtagtcgacgtactaaacgttaagtttacctaacgttacccttaccgtaccgtacggttacttacggttaaccggtttcggggaacgggtaacggtaaccggtaagggttacgtaacgggacttaaaccggaacgtaaccggttggtaggtacccg

SEQ ID NO: 2024 - DNA, 756 bp, Homo sapiens
  misc_feature: GYAE6OF02IE2G4.13.5.A05.1.454.CMB.1.raw
  modified_base (240)..(240): a, c, t, g, unknown or other
  misc_feature (240)..(240): n is a, c, g, or t
  modified_base (256)..(256): a, c, t, g, unknown or other
  misc_feature (256)..(256): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacagtcgtgactcgacccagtctcccagacctccctggctgtcgtctcgtgggcgagcggccaccatacactgccaagtccagcagtagttgtttanacacgtctacccaaanaactaaacgtaactttacgtacgtcttacggtaaccaggtacaacgtaaaccgaggaccaccgtcctacctaaggccttacgaccttactaggttacctacgggctaagttccgtaacgtccccgggggtaaacttcccggggtaccctaggtcccgaagtttccgaggttacgggctacgggggacgggttcctacgggggtacctaacggtaccttttccaacgtcccgttacccaaccgtacgtaccaacggtccgaacgtccgtacggctacgggtactacggttaaacgtacggttacgtcgggttacttagttttaccgtacgtacggttaccgtaagtaaccttaaagttaacctttaacgttaccggttaaccctccgtttacccgggaacgttccttaaccggttaccggtaaccggggtaaccgggtaagggtaacccgtaagggtaccgaacggtactaccggaaaccggtacgtccggtaggtacccg

SEQ ID NO: 2025 - DNA, 582 bp, Homo sapiens
  misc_feature: GYAE6OF02FRFX4.13.5.A05.1.454.CMB.1.raw
  modified_base (231)..(231): a, c, t, g, unknown or other
  misc_feature (231)..(231): n is a, c, g, or t
  modified_base (427)..(427): a, c, t, g, unknown or other
  misc_feature (427)..(427): n is a, c, g, or t
  modified_base (449)..(449): a, c, t, g, unknown or other
  misc_feature (449)..(449): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccacatcaactgcaagtccagccagagtgttttanacagctaccaaacaataagaacttcttagcttacggtaccagcaagaaaccaggacagcctacctaagctgctactatttacgtcgggcacttctacgtaccggggtaacgtcccggggtccctacggaccgtattcgacggttggcgacggtcggggtccgtagggacagttactttccactctactacatcgancacgcctgcgacggctagaagngtggtgcttagtttactagtcgtacacgtactaattattactatacctccgtacgtagtccttcgtacgttcgggacggtaacggtaaccgtaaggtaggaagtactaaccggtaacgtacgtggtacgtacg

SEQ ID NO: 2026 - DNA, 622 bp, Homo sapiens
  misc_feature: GYAE6OF02IH6DZ.13.5.A05.1.454.CMB.1.raw
  modified_base (235)..(235): a, c, t, g, unknown or other
  misc_feature (235)..(235): n is a, c, g, or t
  modified_base (334)..(334): a, c, t, g, unknown or other
  misc_feature (334)..(334): n is a, c, g, or t
  modified_base (617)..(617): a, c, t, g, unknown or other
  misc_feature (617)..(617): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgaggacggccaccatcaactgacaagtccagccagtagttgttttanacagcctaccaaacgtaataacgtaactttacttagtcttacgggtacctaggacaacgaaaccgaggacacgccctacctaagctgctctatttacgnggacatactacgtaccgggtacgtccgggtcctacggaccgtattcgaggtcggacgaggtcggtcgtaggacagtacttcacctctacgactagcagcagtacctgacgcggactagtaagttctttacgacttaacttacttacgtacgtacctaagaaacgtataaccgtaacttaacttacgtaccgtacgggttaccgtccggaccggtaacggtaccgaaagggttacgaaacgttaaaccgaacgtacgttacgtacggtactaccgactaccgtntaccg

SEQ ID NO: 2027 - DNA, 665 bp, Homo sapiens
  misc_feature: GYAE6OF02IW1JM.13.5.A05.1.454.CMB.1.raw
tcagtcacgtactacacgaccggtgctcgatttagatagatagacaggggactgatcaggactcctcagttcaccttctcacaatgaggctccctgctcagctcctggggctgctaatgctctgggtctcgaggtgccagatgtgacatccagatgacccagtctccatcctccctgtctgctatctggtaggagacagactcaccatcacttgccaggcgagtcaggacattaacaacttatttaaattggtactcagacaagaaaccgtaggtaaacgccctaaagccttccgtagactacctacgactacgactacttccgtaaagttttacggaaacgtacggggttacccagttaccgtaaggttcgaaggttagggaacgttaggtacgttcgtacggggaactaggttactttttacgttccaaccgtatacgacgtacacggtacctgcgtacgtacgtagtaacgtacttaggttacactaacgtatttacgttaacctgtacagtacctagtatacggtaacttaccttccgtaccgtacttacccgtaccgttaccggaaccgtaaccgggcttaaacccggtcggttaaggtaaccggttaacgtttaaaacccggtcgtttaacgggtcgtaacgtaccggtaccttaaccg

SEQ ID NO: 2028 - DNA, 707 bp, Homo sapiens
  misc_feature: GYAE6OF02HGHQW.13.5.A05.1.454.CMB.1.raw
  modified_base (323)..(323): a, c, t, g, unknown or other
  misc_feature (323)..(323): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgaccaagtccagccagtagttgttttatacagtcctaccaaactaataaagtaacttcttagcgttggtaccagacaagaaaccaggacagcctactaagctgctctacttacgnggcaatctaacgtccgggtaactcccggggtcctacgaccgtacttccgaaggtcggacgacggtccggggttcgtacggggaactacggtacgttttaccacgttcctaccacctactaccgacgtactacgccgtggcctagggacctaggaacgtagtcggtaggtacgttaacgttttaacgttacgtacgttaccgacggtaacctaaagttaactttaacgttaacgtttaaccgtaccccgttaccggtacgtacccgttaaccgttaccggttttaaccgggaccgggttaacggggtaacccgtaaacggggttacgggtaacggtaacgtaacccgtaaaaccggtaaccggtttacgggtaccggtaacccgg

SEQ ID NO: 2029 - DNA, 680 bp, Homo sapiens
  misc_feature: GYAE6OF02HF75J.13.5.A05.1.454.CMB.1.raw
  modified_base (238)..(238): a, c, t, g, unknown or other
  misc_feature (238)..(238): n is a, c, g, or t
  modified_base (305)..(305): a, c, t, g, unknown or other
  misc_feature (305)..(305): n is a, c, g, or t
  modified_base (321)..(321): a, c, t, g, unknown or other
  misc_feature (321)..(321): n is a, c, g, or t
  modified_base (337)..(337): a, c, t, g, unknown or other
  misc_feature (337)..(337): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatcgacccagtctcagcctccctgctgtgtctcgtgggcgagacgggccaccatacaacgtgacaagtccagccagagttgttttaanacgacgctaccaaataaataagtaacctttcttaagcgtttaggaccagcaaacgaaaccgaggacncgacctactaagcgtnacgttctaatttacgngggtactaagttccgtaagtcccggggaagttccccggggtacctaggacccgtaattccgaggtacggctaggcgggttactcgggaactaggtacttacgacgttctacgactaacgtacacgaccgtacgccgtggacgtacggacgttaggaacgtacgttggtcggtaacgttaagtttacgttaacgcggttaccgtaagaaccttaaattaacgttagttaacccgttaacgtccgttacgacggtaccttacgtaaccggtttcggacgggttaaacgggacccgtaagggtcgtaaggtaacgtaacccgtaaaagggtctaggttacgggacc

SEQ ID NO: 2030 - DNA, 784 bp, Homo sapiens
  misc_feature: GYAE6OF02JUSY0.13.5.A05.1.454.CMB.1.raw
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagagggccaccatcaactgcaacgtccagccagagttgttttanacagctaccaacaataagaacttntagcttaggtaccagcaagtaaaccaggacacgtccctaccgtaagctacgcctctacgtttaccgtagggctatcgtaacgtccggggtaacgttcccggggtacctggaacccgtagtttacgaacgggtcggtaccgtaacggtcggggttacgtacggggaactacggttacttttaccaaccgttcctacccgtaaccgtactttaccggacggtacccgtaacggtcccgttacggacccggtaacggtcccgttaagggaaaacggttcgggttcggtaaccggggttagttttaaacccggtttttaacggttaccgttaccggttaccgtaaacgggttaacccttaaagttttaacgtttaaccgtttaaccggttaaccccgttacccggtttaccggacggtttacccttacggttacccgggtttaccgggaacgggttaaccgggtacgtaaacgggttcggtaaacgtacgtaacccggtaaaccggacggtttacggtacggtaacccgg

SEQ ID NO: 2031 - DNA, 697 bp, Homo sapiens
  misc_feature: GYAE6OF02HJPRT.13.5.A05.1.454.CMB.1.raw
  modified_base (235)..(235): a, c, t, g, unknown or other
  misc_feature (235)..(235): n is a, c, g, or t
  modified_base (369)..(369): a, c, t, g, unknown or other
  misc_feature (369)..(369): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagacgggccaccatcaactgcaacgtccagccagtagttgttttanacgagctaccaaacaataacgaactttcttaagtcttaggtaccagacaacgaaaccaggacagcctacctaagtctagctctatttacgtcggtacattccgtagtaccggggtaacgtcccggggttacccncggacccgtacttacgaggtcgggacgtacggtccgggttcgtagggaacctaggttacttttaccgacttacctacctaccgactaccgaacgtaccgtaacgtcccgtacgtacgacgggtaccgtaaggtaacgtacggtcggttacgggtacttaacggtttttacttacgttcgttacgtaacgtaataagtttaatttaacgttaacgttaccctaccgtaccgtacgtccgttaccgttaccggtttcggggaccggtaacgggtaacccggtaggtacgggtactaaggtaaccgtaacggtacggtggttacggtaccg

SEQ ID NO: 2032 - DNA, 546 bp, Homo sapiens
  misc_feature: GYAE6OF02IO1PL.13.5.A05.1.454.CMB.1.raw
  modified_base (232)..(232): a, c, t, g, unknown or other
  misc_feature (232)..(232): n is a, c, g, or t
  modified_base (266)..(266): a, c, t, g, unknown or other
  misc_feature (266)..(266): n is a, c, g, or t
  modified_base (306)..(306): a, c, t, g, unknown or other
  misc_feature (306)..(306): n is a, c, g, or t
  modified_base (329)..(329): a, c, t, g, unknown or other
  misc_feature (329)..(329): n is a, c, g, or t
tcagtcacgtactacacgaccggtgctcgattttagatagatagacagggggagctacaacaggcaggcaggggcagcaagatggtgttgcagacccaggtcttcatttctctagtttgctctggatctctggtgcccacggggcatcgtgatgacccagtctccagactccctggctgtgtctctgggcgagagggccacatcaacttgcaagtccagccagagtgtttanacagctcaacaataagaactctagcttggtaccngcagaaccagacagcctcaagctgctcatttactggcatntatcggatccgggtcctgaccgnttcagtgcagcgggtctggacaggtactttcgaactcgtacacccatcaggcagcctagcaaggtctagaagatggtacgcgttagtttacttaaccgtggttaccagtacctaattaagttactaggtactacccgtcgtaagtccctacgtctttaccggcggacgggaaccgtaaggtcggagtacgttaagaaccgtaacgtaggtggtaccg

SEQ ID NO: 2033 - DNA, 730 bp, Homo sapiens
  misc_feature: GYAE6OF02GU8RE.13.5.A05.1.454.CMB.1.raw
  modified_base (234)..(234): a, c, t, g, unknown or other
  misc_feature (234)..(234): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagacctccctggctgtgtctcgtgggcgagagggccaccatcaactgcaagtccagccagagttgttttanacagcctaccaaacaataagaacctttcttagcttaggtaccagcaagaaaccaggacacgccctacctaagcctagcctactaattttacgcgggactacttacgtacgtacccgggtaacgttcccggggtaccctacggaacccgtattcgaggtcggacgacggcgggtacgtagggacgtaggtactttccgaaccgttcctaccgtaacctacgttacgaacgtccgaaccgtccgtggaccgtacggtaccgtaacggtaaacgtacgttacgggtacggtacgtttaacgttttaacgttaccgttaggtaactaaccggtacttaaacgtttaactttaacgttaacgttaacccgtacccgttaccgggtaaccggtcttaccggttaaccggttccggggtaacggtaaccggggtaaccggtaacgggttagggtaacgtaacgttaaaccggaaacggtttaaccgtacgggtacggtacccg

SEQ ID NO: 2034 - DNA, 697 bp, Homo sapiens
  misc_feature: GYAE6OF02JBBSU.13.5.A05.1.454.CMB.1.raw
  modified_base (233)..(233): a, c, t, g, unknown or other
  misc_feature (233)..(233): n is a, c, g, or t
  modified_base (516)..(516): a, c, t, g, unknown or other
  misc_feature (516)..(516): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatgacccagtctccagactccctggctgtgtctctgggcagagggccaccatcaactgcaacgtccagccagagttgttttanacagctccaaacaataagaactttctagtcttggtaccacgacaacgaaaaccgaggaacacgtacctacctaagctgcctactatttaacgtcgggactatccgtacgtacccggggtaacgtcccggggtccctcgtacccgatttcgaggtcggacgacggtcgggttcgtacgggactaacggtcttttccgaccttccgttaccaacccgtatccctaacggccgtaacgccgttacggaccgacgggtccgtaacggaacgtaggttaggtccggtntttaacgttttacttacgtcggtaccttacggtaacctaagtttacgtttaagttacttaacccgttacccgtaccgtacggttcctacggtttaccggttacccgggaccgggtaacggggtaaccgtaagggtacggtaacggactaacccgaaacggtaaccgttggtaccggtaccg

SEQ ID NO: 2035 - DNA, 644 bp, Homo sapiens
  misc_feature: GYAE6OF02IXTI6.13.5.A05.1.454.CMB.1.raw
  modified_base (233)..(233): a, c, t, g, unknown or other
  misc_feature (233)..(233): n is a, c, g, or t
  modified_base (373)..(373): a, c, t, g, unknown or other
  misc_feature (373)..(373): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtcctccagactccctggctgtgtctcgtgggcgagagggcccacatcaactgcaagtccagccagagttgtttanacagcctacaaacaataacgaacttcttagcttggtaccagacagaaaccaggactacgacctccgaagctagctctagttactggcatctacgtccgggaactccggggcctcgaccgatcgagtcgcgacgtcggtcnggacagtacttcatcgtccacgactcgacgtcacgcctgacacggtccgtaggaaacgacgttggacgaccgttaagttttaacttacgttcgtacgtacgtaacttaacgtttaattaaccgttaaacgttacccgttaccgtaccgtacggtacccgttacgtttaaccggtttccggggtaacgggtaacggggtaaaccccgtaaggggttaaccggtaaggtaaaccgtaaccgtaaaacccggtaacggttcggtacgggtaccg

SEQ ID NO: 2036 - DNA, 772 bp, Homo sapiens
  misc_feature: GYAE6OF02H9Y8T.13.5.A05.1.454.CMB.1.raw
  modified_base (184)..(184): a, c, t, g, unknown or other
  misc_feature (184)..(184): n is a, c, g, or t
  modified_base (233)..(233): a, c, t, g, unknown or other
  misc_feature (233)..(233): n is a, c, g, or t
  modified_base (238)..(238): a, c, t, g, unknown or other
  misc_feature (238)..(238): n is a, c, g, or t
tcagtcacgtactacacgaccggtgctcgatttagatagatagacagggggagctacaacaggcaggcaggggcagcaagatggtgttgccagacccaggtcttcatttctctgttgctctggatctctggtcgcccgacgggacatcgtgatcgaccagtctcagctcctggctgtgtctcgnggacgagcggcctaccatcaactgcaacgccagcctagagttgttttanaccanctaccaaataataacgaacttcttacgcgtttacggaccagacgaacgaaaccttaggaccacgaccctacttaaacggctactcctacgtaaccttttagcgggacctaagtttccgacgtacccggggtaaacgtccccggggttcccttacgacccgtaatttcccgaagttcggggaccacgggtcgggttcggtacggacccgtaaggttaaccgttttcgaaccctttcgtaccgtaacctaactaacccgaagtccggtttaaaccgtcccggtaaaggtcccgaggtaccgtaagggaaaacgtacgtttaccgggccgggtaactttacggtttaaacggtttaacgagggttaacccgaagttacccgaaatttaaccgggttattaaacccgggtactttccccggacccggtaagccgtttacttacccgggtttaacggacccggggttaaacggcccggttaaaagggtcgaaccgtaacggtaaaccgtttaaacccggaagttcgggacttaacccgg

SEQ ID NO: 2037 - DNA, 787 bp, Homo sapiens
  misc_feature: GYAE6OF02HVF92.13.5.A05.1.454.CMB.1.raw
  modified_base (254)..(254): a, c, t, g, unknown or other
  misc_feature (254)..(254): n is a, c, g, or t
  modified_base (379)..(379): a, c, t, g, unknown or other
  misc_feature (379)..(379): n is a, c, g, or t
tcagtcacgtactacacgaccggtgctcgatttagatagatagacagggggaggctacaacaggcaggcaggggcagcaagatggtgttgcagacccaggtcttcatttctctgttgctctggatctctggtcgcccgacgggacatcgtgatcgacccagtctccagacctcccgtggctgtcgtctcgtgggcgaggacgggccaccgacgtaccaacgtcggaccgaacgtccagccagtagttgttttanacgagacctaccaaacgtaataaacgtaactttacttaagcgtttacggtacctagcaacgaaaaccgaggaaccacgtaccccttaccgtaaacggcctacggtccttactaacgttttaccgngggacctaagttaccgtaccgttaccggggaacgttccccggggtacccttaggaaccccgtattaccgaggttcggaccgtacgggtccgggttacgtacggggactacgttacgttttaccgaccctttaccgtacctacccgtaactccgaaacgccgtaaccggcccgttacggaccgtacggggtactacgggtaaacggtacgttaggtacggttaacgtttaagtttttaccgttaagttaccggttacgaacgtactaaacgtttaagttaacgttacggttaacccttaccggttacccgtagttacccttacgttaccggtttcgggaaccggggtacgggtaaccgtaagggtcgaacggtacgtaaaccgaaccggttacgtacggtacggtaccg

SEQ ID NO: 2038 - DNA, 719 bp, Homo sapiens
  misc_feature: GYAE6OF02HQW7B.13.5.A05.1.454.CMB.1.raw
  modified_base (173)..(173): a, c, t, g, unknown or other
  misc_feature (173)..(173): n is a, c, g, or t
  modified_base (247)..(247): a, c, t, g, unknown or other
  misc_feature (247)..(247): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagacctcccnggctgtgtctcgtgggacgaggacgggccaccatccgaaactgacaaacgtccagcccaagtagttgttttaanacagtcctaccgaaacaataaagtaacttcgttagcttaggtaccagacaagaaaccaggtaccacgaccctaccttaagcctgtcttacgtaacttttaccggtgggtacctaacgttccgtacgttacccggggaacgttccccggggtacctacggaccgtagttccgagtcggtacgacggtccgggttagtacgggacacgtagttcctactactaccacctaagtactaacgcgacgtccgtagtacccgaggtactaggtaaacgttagtacggttacggaccgtttaagttttaacggtttacgagtttaaccgacgtaactaaatttaagttaaccgttaagttaaaccctcccgtaacgtacgtcctttaaccgtaccggtttacgggaccgggtacggggtaaccgtaaggggtaggtaacgtaacgtaaccggtaaccgtaaacgttcggttaggtaccg

SEQ ID NO: 2039 - DNA, 699 bp, Homo sapiens
  misc_feature: GYAE6OF02G9L1L.13.5.A05.1.454.CMB.1.raw
  modified_base (174)..(174): a, c, t, g, unknown or other
  misc_feature (174)..(174): n is a, c, g, or t
  modified_base (399)..(399): a, c, t, g, unknown or other
  misc_feature (399)..(399): n is a, c, g, or t
tcagtcacgtactacacgaccggtgctcgattttagatagatagacaggggggagcgtacaacaggcaggcaggggcaggacgaagatggtgttgcaggacccaggtcttcactttctctgttgctctggatctctggtcgcccgacggggacagtccgtgatgacccagtccnccagacctccctggctgtgtcctcgtcggcgagacgggccacactaccaactgaccaacgtccacgccgaaggtagtttagttttacacgacgtaccttaaccaaacgtaaacttaacgtaacctttacgttacggtaccgttacggtaaccgaagtaccgaaacggaaacccgtacggacctacggcccgttacgtaacgtcctacgccttacgtactttacgnggacacgtacgtaccggtccgggacgtcccgggtcctacggtacgtacgttcgaggttcggccgtacggtcggttaccgtagggacgtacgtacttaccgaccttctacctacgacgtaccgacgaccgacgccgtcggtaccgaggtacgtagaacggtgtacggtcgtactttagttagttcgtagtcgacgtataagttacgttacgtacgtacctcgtacgaccgtctacgtacgggtacggacggtaacggaccgaaggtacgacgtacgtaaccgaacgtcgtcggtaccgtcg

SEQ ID NO: 2040 - DNA, 583 bp, Homo sapiens
  misc_feature: GYAE6OF02GCXFU.13.5.A05.1.454.CMB.1.raw
  modified_base (310)..(310): a, c, t, g, unknown or other
  misc_feature (310)..(310): n is a, c, g, or t
  modified_base (373)..(373): a, c, t, g, unknown or other
  misc_feature (373)..(373): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctctgggcgagagggccaccatcaactgcaagtccagccagagtgttttatacagctaccaacaataagaacttcttagcttgtaccagacagaaaccaggacacgcctcctaagctcgctcatttacgnggcatctagtccggaatccgggtcctgaccgattcagtggcgaggcgggtcgtgggacaggtntttccgactctccaccactcagcacgccgtcgcgacggcgtagaaagtgtgtaggcttagtttaattacgttgtaacaacgtaattattattacgtacctccgtaccgtacgtccttacgtaccgtttaccgggacggggtaaccgggtaacggtaacggtagggaagtacgtaaccgtaaaccggtaacgtagggtacggcgttaccgg

SEQ ID NO: 2041 - DNA, 626 bp, Homo sapiens
  misc_feature: GYAE6OF02HPY8X.13.5.A05.1.454.CMB.1.raw
  modified_base (233)..(233): a, c, t, g, unknown or other
  misc_feature (233)..(233): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccacatcaactgacaagtccagccagagtgttttanacagctaccaactaataagtaacttcttagcttacggtaccagacagaaaccaggacacgcctacctaagtctgctctactttacgtggctatcgtacgtaccgggtaacgtcccgggtcctacggaccgtattacgagtcggcgtaggcgggtcgtaggactagtacttactactctacaccatcgacgtcacgtcctaggccgtaggactaggaacgtacgtaggtcggtactagttttaagttacgttacgtacgtacgtactaaagttatttaacttaacggtacctacccgttacgtacggtccttacgtacgtttccgggacggttacgggaaccggtaagggtacggtacgtaacggtaacgaaacgtaaccgtggtacggtaccg

SEQ ID NO: 2042 - DNA, 862 bp, Homo sapiens
  misc_feature: GYAE6OF02IF31H.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactccctggctgtgtctcgtgggcgagacgggccaccatcaactgactaagtccagccagacgttgttttaacacagcctaccaaacaataacgaactttcttaagtcctttacggtaccagaccaaagaaaccgaggaccacgccctacctaaggtctcgaccttactactttacgtcgggcctaacgttcctaacgttaccggggaacgttcccggggtacctacggtaaccgtacgttttacgacggttacgggacgtacgggtaccggggtttcggtaaccggggtaactaacggttaccggtttttaccgaacccgttaccgttaaccgtaaccccgttaaacgtaccgtaaaccggtacccgtaaccggttacccgttacggaaccggtaaccgggttaccgttaacgggtaaacggtacggtttacgggtacgggttaaccgtttaacggtttttaaaccgttttaccgttacggttaaccgtaaacggttaaacgtttaaacgttttaagtttaaaccggtttaaacggtttaccccgtttacccggttaaccgggttaacgttacccgtttaccgtttaaccgggttttaccgggaaccggggttaaccgggtaaaccgggttaacggttaacgggtaacgttaacgtaacccggtaaaacgttacggttacgggtaccggtaaccgg

SEQ ID NO: 2043 - DNA, 750 bp, Homo sapiens
  misc_feature: GYAE6OF02GBRZN.13.5.A05.1.454.CMB.1.raw
  modified_base (496)..(496): a, c, t, g, unknown or other
  misc_feature (496)..(496): n is a, c, g, or t
tcagtcacgtactacacgaccggtgctcgatttagatagatagacagggtgagctacaacaggcaggcaggggcagcaagatggtgttgcagacccaggtcttcatttctctgttgctctggatctctggtgcccgacggggacatcgtgatcgacccagtctccagcctccctggctgtgtctcgtgggcgaggacggccaccgtatccaacgtggacaacgtccagccaagtgtttagttttatacagcctaccgaaactaagtaaacgtaacttcttagtcttacggtaccacgacaacgaaacctaggactacggtacctaccgtaagtctgtactacgtactttacgtcggtactagttccgtaacggtacccgggtaacgttcccggggtaccttaggaccttacgtacgttacgtaggtacggacgtacgggtcgggttaccgtagggtacctaaggtttacttcccgtacgttcctaccgtaacccgnttaccgtacggacgtaccggtccgtacgaccgtaacggttaccgtaaggtaacgtacgtcggttacggtacgttttaacgtttaacgtacgtttacgtacgtaacgtaacgttaacgtttaacgttaacgtaacgttcccgttaccgttacgaccgttaccgttacgttaaccggtttacccggggaacggttaaccgggaacgttaacgggcgggttaaacctacgtaaaccgggtaacgttaccgttacggg

SEQ ID NO: 2044 - DNA, 883 bp, Homo sapiens
  misc_feature: GYAE6OF02GXXP5.13.5.A05.1.454.CMB.1.raw
  modified_base (172)..(172): a, c, t, g, unknown or other
  misc_feature (172)..(172): n is a, c, g, or t
  modified_base (192)..(192): a, c, t, g, unknown or other
  misc_feature (192)..(192): n is a, c, g, or t
  modified_base (233)..(233): a, c, t, g, unknown or other
  misc_feature (233)..(233): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatgacccagtctccagactcccnggctgtgtctgtgggcgagngggccacatcaactgcaacgtccagccgagagttgttttanacacgctaccaaacaataacgtaactttcgttaacgcgttttacggtaaccacgaccgaacgaaaacccgagggtaccacggtaccctaccgtaacgtcgtcggtaccttaccttaagttttaccggaggggtacctaacgtttccgttaacggtaccccggggggttaaacggttcccccgggggttacccttacggtaacccgttattttacccggaacgggttcgggaccggtaacgggttccgggggttaccggtacggggaaacttacggttacgttttcccgaacccgtttcctacccgtaaccgtacctacgaaccggtaccgtaccggtaccgttacgggacggtacgggtaccgttaacgggtaaaggttaccgttaacgggttcggttaaccgttttagggtttttaaaccttaccggttacggttaaccgaacggttaacctttaaacggttttaacttttaaaccgggtttaacccgtttaccgttaaccccggttacggttacccggtttaccgttacccggttacccggggttttacccggggaaccggggttaaccgggttaaccggttaacggggttacggaacggttaaccgtaacccggtaaccggttaacggttcggtacccggttaaccg

SEQ ID NO: 2045 - DNA, 229 bp, Homo sapiens
  misc_feature: GYAE6OF02G4A6N.13.5.A05.1.454.CMB.1.raw
  modified_base (220)..(229): a, c, t, g, unknown or other
  misc_feature (220)..(229): n is a, c, g, or t
tcagtcacgtactacacgaccggtgctcgatttagatagatagacagggtggaggctgaggatgctggggtctattactgcatgcaagctacacactggcctccgctcaccttcggccaagggacacgactggagatagaacgaactgtggctgcaccatctgtcttcatcttcccgcatctgatagtacgtgactgagcgggctggcaaggcgcatagnnnnnnnnnn

SEQ ID NO: 2046 - DNA, 603 bp, Homo sapiens
  misc_feature: GYAE6OF02GV3YW.13.5.A05.1.454.CMB.1.raw
  modified_base (233)..(233): a, c, t, g, unknown or other
  misc_feature (233)..(233): n is a, c, g, or t
  modified_base (246)..(246): a, c, t, g, unknown or other
  misc_feature (246)..(246): n is a, c, g, or t
  modified_base (272)..(272): a, c, t, g, unknown or other
  misc_feature (272)..(272): n is a, c, g, or t
  modified_base (287)..(287): a, c, t, g, unknown or other
  misc_feature (287)..(287): n is a, c, g, or t
  modified_base (300)..(300): a, c, t, g, unknown or other
  misc_feature (300)..(300): n is a, c, g, or t
  modified_base (310)..(310): a, c, t, g, unknown or other
  misc_feature (310)..(310): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctgggtgcccacggggacatcgtgatgacccagtctccagactccctggctgtgtctcgtgggcgaggaggccaccatcaactgcaagtccagccagagttgtttanacagctaccaaanaataagaacttcttagcttggtaacngcagaaaccaggacngcctcctaagctnctcatttacnggactatctagtccggaatccgggtccctgaccgtatacaggtcggacacggtcggggtctagggactaggtactttccacttctaccacctatcgagcagacctgcgacggctaggaacgtgtcgtcggtacttaggttttacttaccgttataccgagtacgtaaattaagtttaactaaccgttaccgttacctccgaacgtctacccgtacggtttccggggacggtaaccgggaacgtaagggtacggaagtaacttaaccggaaaccgtaacggttcgtacggtacg

SEQ ID NO: 2047 - DNA, 964 bp, Homo sapiens
  misc_feature: GYAE6OF02GFZGR.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatcgacccagtctccagactccctggctgtgtctcgtgggcgagagggccaccatcaactgcaagtcccagccagagttgttttaatacagtcctaccaaacaaattaaacgaacctttcgttaacgtcgttacgggtaaccaagtacaaacgaaaacccgaggtaaccacgtacccttaccgtaaacgtccgtacggtacccttacttaacgtttttaaccggtacggggtacctaacgtttccgttaaccgggttaccccgggggtaaaaccggttcccccggggggttaacccccttaacgggtaaccccgggttaacgttttaaccggtaacggggtttaccggggtacccgtaacgggggttacccgggggttaccggtttaaccggggggaaaccgttaaaccgggtttaacccgtttttacccggaaaccccgttttcccggttaaacccttaaaccccgttaaccggttaacccgtaacggtaaccccggtaccggttaccccggttaccggtaaccggtaaccgggttacccgttaagggttaaaacggttaaccggtttacgggttaccgggtaaccgttttaaacggtttttaacgtttaaccgtttaggtaaccgtaaaccggttaacttaaacggttttaactttaaacggttaacgttaaccccgtttacccgtaacccggttacgggtaccctttaccggtaccgggtttaacgggacccgggtaaacgggtaacccggttaaggtacggtaaacgtaccgtaaaccggtaacggtaaacggttggtaacccggtaccgg

SEQ ID NO: 2048 - DNA, 719 bp, Homo sapiens
  misc_feature: GYAE6OF02GEPPP.13.5.A05.1.454.CMB.1.raw
  modified_base (239)..(239): a, c, t, g, unknown or other
  misc_feature (239)..(239): n is a, c, g, or t
tcagtcacgtactacacgaccggtgctcgatttagatagatagacagggggagctacaacaggcaggcaggggcagcaagatggtgttgcaggacccaggtcttcatttctctgttgctctggatctctggtgcccgacggggacatcgtgatcgacccagtctccagacctccctggctgtgtctcgtgggcgaggaggccaccatacaactgacaagtccagccagagttgttttanacagctaccaacaataacgaacttcttacgcgttcggtaccagacaacgaaaccaggacacgcctacctaacgctacgctactactttacgtcgggcaacttccgtacgttacccggggtaacggttcccccgggggtccctacggtaaccccggtaactttccgggtaaacggttcgggaccggtacgggtcccggggttacggttacggggggaccttaacgggttacttttaccgtacccgttaccttacccgtaaacccggaactttacccgaacgtaccggtaaccggtccctacggggtcacgggtaccgtaggaaacgtgttacggtaggtccgtttaagttttaccgttaagttccgacgtaagtactaagttactttacgtacgttaccaccgtcgacgtctacgttacggtgggaccggacggtaacgtaacgggtgtaacggtactaaccgaaggtacgtcggtgtccg

SEQ ID NO: 2049 - DNA, 744 bp, Homo sapiens
  misc_feature: GYAE6OF02IG2XZ.13.5.A05.1.454.CMB.1.raw
  modified_base (151)..(151): a, c, t, g, unknown or other
  misc_feature (151)..(151): n is a, c, g, or t
  modified_base (386)..(386): a, c, t, g, unknown or other
  misc_feature (386)..(386): n is a, c, g, or t
  modified_base (521)..(521): a, c, t, g, unknown or other
  misc_feature (521)..(521): n is a, c, g, or t
  modified_base (659)..(659): a, c, t, g, unknown or other
  misc_feature (659)..(659): n is a, c, g, or t
  modified_base (729)..(729): a, c, t, g, unknown or other
  misc_feature (729)..(729): n is a, c, g, or t
  modified_base (736)..(736): a, c, t, g, unknown or other
  misc_feature (736)..(736): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacattcgngatcgaccagtcctccaagcctccctgctgtgtctcgtgggcgaggacgggcccaaccataccaacgtcgaccgtaagtcccaagaccgagtagtttacgtttactacgacgtacctaaccaaactaaagtaacgtaaccttttactaacggtacgtttacggaacagtaaccaagaaaaccgacggacctacggtccctaaccgtaacgtcgtcgtacctacttacgtttacgnggactacgtacgttacgtaccgggtacgttcccgggacctggaaccgtattcgaggtgctaggggtcggtacgggtagtaactagtacctttccgaaccgttcgtaacctaacctacgtaccggtaacggtaccncggttaaccgcggtaaccgacggtacgtaagtaacggtagttcggtacggtactttacggtttaatcgtaggtactaacgtaattaaagtttaagttaacctaacgggttaccctttaccgtaagggtaccgtttacncccggtttaacggttcgggaacggttacgggaaccgtagggtaacgtaacgtaccgtaactaaaccgggngttacgngtacccgg

SEQ ID NO: 2050 - DNA, 426 bp, Homo sapiens
  misc_feature: GYAE6OF02HKS6Y.13.5.A05.1.454.CMB.1.raw
  modified_base (130)..(130): a, c, t, g, unknown or other
  misc_feature (130)..(130): n is a, c, g, or t
  modified_base (367)..(367): a, c, t, g, unknown or other
  misc_feature (367)..(367): n is a, c, g, or t
  modified_base (369)..(370): a, c, t, g, unknown or other
  misc_feature (369)..(370): n is a, c, g, or t
  modified_base (372)..(376): a, c, t, g, unknown or other
  misc_feature (372)..(376): n is a, c, g, or t
  modified_base (379)..(426): a, c, t, g, unknown or other
  misc_feature (379)..(426): n is a, c, g, or t
tcagtcacgtactacacgaccggtgctcgattttagatagatagacagggctctggagtcccccagccgcttctctggatccaaggatgattccgccaaacgcagggatattactcatctctgggctccntctgacgatgaggctgaactatttactgtttgacgttggacaacaacaaccgcctggatcgttcggaccgtgggacctacggtccaccgttcctaggtccacgaccccgaaacggaccccaaacccccgtactcgtaccaaccttccgttcccgtttcccccgcccccttccttaccttacggtaccgtacggtaccgtggacgggccgggtacgtcggacgaggccgactaagtgngnnannnnngannnnnnnnnnnnnnnnnnnnnnnnnnnnnnnnnnnnnnnnnnnnnnnn

SEQ ID NO: 2051 - DNA, 791 bp, Homo sapiens
  misc_feature: GYAE6OF02JHOFK.13.5.A05.1.454.CMB.1.raw
  modified_base (132)..(132): a, c, t, g, unknown or other
  misc_feature (132)..(132): n is a, c, g, or t
  modified_base (200)..(200): a, c, t, g, unknown or other
  misc_feature (200)..(200): n is a, c, g, or t
  modified_base (359)..(359): a, c, t, g, unknown or other
  misc_feature (359)..(359): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtncccacggggtacatcgtgatgacccagtctccagactcctggctgtgtctcgtgggcagacggccacntcaactgcaagtcccagccagagttgttttacacgacgcttacccaaacaaattaacggaacctttcttaagcgtttacggtacccaggcaaagtaaacccaggaacctacgtcccgttacctaaaggtcctcggaccttactaacgtttttaaccggngggaccctagtttaccgttaacgttaccccgggggggtaaacttcccccggggggttccctaggtaaccccggtattttaccgaaggtcggttccgaaacgggttcggggtttaacgtccggggaactaacggttaaccctttttccaactttaccgaccccggtaaccctttaacgtacgacggaccctaacgggttcccctacggttacgaacggggtccttaaggaaaacgtgttaccgtcggtaaaccgtttaggtttaaacgttcgaacgttccgaaagtcttaaaagttacgttacgttaacgtacccgttccgtaccggtggtactttaaccggtcggtttggggaaacccgggttaggaaacccggtttagggaccgtaacggtacctaaaccggttaaaccggcgtttaggaccgggttaacc

SEQ ID NO: 2052 - DNA, 670 bp, Homo sapiens
  misc_feature: GYAE6OF02GZKH8.13.5.A05.1.454.CMB.1.raw
  modified_base (239)..(239): a, c, t, g, unknown or other
  misc_feature (239)..(239): n is a, c, g, or t
  modified_base (253)..(253): a, c, t, g, unknown or other
  misc_feature (253)..(253): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatcgtgatcgacccagtctccagacctccctggctgtgtctcgtgggcgaggacggccaccatcaactgacaagtccagccaagtagttgttttanacagcctaccaaanaataacgtaacttcttagtccttggtaccagaccaacgaaaccgacggaaccacgtaccctacctaagcctacgcttactacgtttaccgcgggtactacttcgtacggtacccggggaacggttccccggggtcctacggtacccgtattaccgaggttcggaccgtacgggtccgggggtacccgggagtacgtacgtttaccaccgttcctaccacctacgtacgactcgtacgaccgtggacgtaggtacgtagaacgtagttacggtgtacgttagtttactcgtgtacgtaagtctaaagttatacgtacttaccgtctacggactcctacgttacgttccgggacgggtaacggaccggttaaggacggaataccggaacgtaaacgtaccgttagggtacgtacgtacg

SEQ ID NO: 2053 - DNA, 729 bp, Homo sapiens
  misc_feature: GYAE6OF02F0HGS.13.5.A05.1.454.CMB.1.raw
tcagtcacgtactacacgaccggtgctcgatttagatagatagacagggggagctacaacaggcaggcaggggcagcaagatggtgttgcagacccaggtcttcatttctctgttgctctggatctctggtgcccacggggacatgtcccgatcgacccagtctcagacctccctggctgtgtctcgtgggcgaggacgggccaccataccaactcgacaacgtccacgccagtagttgttttaacacacgcctaccaacaataagaacttctagtcttaggtaccagacaacgaaaccaggacagcctaccaagctgctactatttacgtgggactatacgtacgtccgggaacgtcccggggtccctgaccgtacttcgagtcggctacggcgggtacgtggggacaggtactttaccgacttaccctacaacctacttacgacgtccgtacgcccgttggaccgtaacgggtctacggaaagtacggttggttacgggacgtttaacgtttttacgttaccgttggtaacctacgtaaccgttaaagtttaacgtttaagttaaccgttaacccgttcccgttaacccgggttacggttacccgttacccgttaccggtttacccgggggaaccggggttaaccggggtaacccggtaaacggggttacgggtaacgaacgttaaacccggtaaaaccggtaccgggtttacggacggttacccgg

SEQ ID NO: 2054 - DNA, 833 bp, Homo sapiens
  misc_feature: GYAE6OF02HDYGU.13.5.A05.1.454.CMB.1.raw
tcagtcacgtactacacgaccggtgctcgatttagatagatagacagggggagctacaacaggcaggcaggggcagcaagatggtgttgcagacccaggtcttctatttctcttgttgctctggatctctggtcgcccgacgggacatcggtgatcgaccctagtcctccacgtacctcccgtggtcttgtgtcgtcgtgggcgaggacggccaaccatcaacgtcgactaacgtccacgaccagttagttagttttaactacgacgtacctaacctaaactaaacgttaaacgtaactttacgttacgtacgtttacggtaaccaacggacaaacgaaaccgtaacggaccaccgtacctaaccgtaacgccgttacgtaccttacgttacgtttacggtacggtaccttacgtacgtaccggtacccggggtaaccggttccccggggtacctacggtacccgtagttaccgacggtcgggtacgacgggttccgggtacgtacgggtacgtacgttcgttacctccgttacgaccctacgacttacgccgtcgtacgccgttcgaccgtaaggtccgtaaggtaacgtcgtaggttacgtacgtttaaggtttcctacgttacggtactaaacgttacttaagtttaacgttcgttaaacccggttccttacccgggttaaccgttaccgggttaccccgtttaggttaccccggggtttaccgggaaccggggttaaacgggtaaccgggttaaacggggtaacccggttaaagggttaacccgttaaacggtaaacccgggtaccgtttacgggtaccggtaacccgg

SEQ ID NO: 2055 - DNA, 601 bp, Homo sapiens
  misc_feature: GYAE6OF02HGDGM.13.5.A05.1.454.CMB.1.raw
  modified_base (279)..(279): a, c, t, g, unknown or other
  misc_feature (279)..(279): n is a, c, g, or t
  modified_base (282)..(282): a, c, t, g, unknown or other
  misc_feature (282)..(282): n is a, c, g, or t
  modified_base (289)..(289): a, c, t, g, unknown or other
  misc_feature (289)..(289): n is a, c, g, or t
  modified_base (308)..(308): a, c, t, g, unknown or other
  misc_feature (308)..(308): n is a, c, g, or t
  modified_base (310)..(310): a, c, t, g, unknown or other
  misc_feature (310)..(310): n is a, c, g, or t
tcagtcacgtactacacgaccggtgctcgatttagatagatagacaggggactgatcaggactcctcagttcaaccttctcacaatgaggctccctgctcagctcctggggctgctaatgctctgggtcccaggatttagaggggatgctgtaatgactcagtctccactcctccctcgcccgtccacccttggaccagcccggcctccatcctcctgctagtttcctagtacaaacgcctacgtacatcaatgatggcacacctactgattggttcgnagngcagcanctcagcactaattatagtntntgacgagggccgtccgggaccagacagatcaggcggcaggtggtcaggcacgtgtactttacaacgtactaagaaatcgagacggaggggtacggaggtcagggtagtagtttggttaggtcggtacttattaactttagtgtacgtacgtagtaccgaagtaaccgaacaactccgtacgggtacccgtttacgtaccggtttacgggacccggtaacggggtaaccctaaggtaccgggttaacgaagtacgttaccaacggttaccggtaacgttcgggtacggtacc

SEQ ID NO: 2056 - DNA, 683 bp, Homo sapiens
  misc_feature: GYAE6OF02IU0YJ.13.5.A05.1.454.CMB.1.raw
  modified_base (146)..(146): a, c, t, g, unknown or other
  misc_feature (146)..(146): n is a, c, g, or t
  modified_base (241)..(241): a, c, t, g, unknown or other
  misc_feature (241)..(241): n is a, c, g, or t
  modified_base (414)..(414): a, c, t, g, unknown or other
  misc_feature (414)..(414): n is a, c, g, or t
  modified_base (435)..(435): a, c, t, g, unknown or other
  misc_feature (435)..(435): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacntcgtgatgacccagtcctccagacctccctggctgtgtctctgggcgagagggccaaccatccaactgcaacgtccacgccagtagttgttttanaccagctaccaaacaataaagaacttcttaggcttcggtaccagacacgaaaaccgagacacgtccctcctaagctgcctcgaacttttcgagggctattccgtacgttccggggaacgttcccggggtacctcggaaccgtgttcaggtggaccaggtcgggtgtacggganagtatttccacttcactaccngtaccagcgacgtccgtacgcgacgccgtaggtaacgagtacggtacgcgtttaagtttactttacgtacggttacaaggtaactaaattacgtttaactagttaccccgtaccggttacccgacgtaccgtttaccgttacccggttaccgggggtaaccgggaaccggggttaaccggaaacgggttacgggaacgtaaacggttacccgaaaacggtaacccggttagggtaaccgggttacccg

SEQ ID NO: 2057 - DNA, 781 bp, Homo sapiens
  misc_feature: GYAE6OF02GV2C2.13.5.A05.1.454.CMB.1.raw
  modified_base (246)..(246): a, c, t, g, unknown or other
  misc_feature (246)..(246): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctgggtgcccacggggacatcgtgatgacccagtctccagactccctggctgtgtctcgtgggcgtagacgggccaccgactcaaacgtgacaaagtcccagccagtacgttgttttaanaacgagacctaccaaacgtaaattaaacggaaacctttacgttaacgtcgtttacggtaaccgagtaccaaagaaaacccgaggaacacgaccctaccgtaacggtctacgtacctacgtaacgtttacgtcgggtactacttactagtaaccccggggtaacgttacccggggtcccgtacgaaccgttacgttacgaacgtcgggtacgacggttcccggggtacggtacgggtaacctaaggtactttccaacccgttctaaccaccttaacgcgtaacggacctacgttaaccggcgttacgtaacggacgttaacggaaagtaccgttaggttacggaacctttaggtttaaactttaaccggttagttaccgtaaccggtaagttaaaatttacgttaaacttaaccggttactacccgtaccgtaggttacccttaacgtaccgggtttaacggaaccgggtaaacgggtaccggttaagggtaccggtaagtaacttaacggaaaggtttacgtggtcggttaaccg

SEQ ID NO: 2058 - DNA, 713 bp, Homo sapiens
  misc_feature: GYAE6OF02FQT5P.13.5.A05.1.454.CMB.1.raw
tcagtcacgtactacacgaccggtgctcgatttagatagatagacagggggtgggtccaggaggcagaactctgggtgtctcaccatggcctggatccctctacttctcccctcctcactctctgcacagctctgaggcctcgtatgagctgacacagccactctcggtgtcagtgtccccaggacagacggccaggatcactgctctgcagatgcatgccataacattttgcttattcgctgtcagacaagaaaccacggccaaggcccgaaggtcccgaggaccccccttatacttccttaggactaaacgtaaaaaacgacctaattagggacggggtacccctacgaggttagacgttcccgtaggacggtacgtacttcgtaccttgggtcctaccgactcttaccgacggggaactaacgacgtacgtaacgttcgaacctagtaccgttaggagggtaccgtaccgaacgggtcaacggtaagggaccggacgggtcttaacgggtactttaggtttacggtacggtaacctttttacccggatacggtaacgtaaccgaaagtacggtaggttaccgttccgtttaggttaaccgtttttacgggaacccgggttaacgggtaaaacccctaaacggttaccgtaacccggtttaccggttacggtacccggttaaccggaccggtaccctacgggttaccccgg

SEQ ID NO: 2059 - DNA, 795 bp, Homo sapiens
  misc_feature: GYAE6OF02G56HV.13.5.A05.1.454.CMB.1.raw
  modified_base (250)..(250): a, c, t, g, unknown or other
  misc_feature (250)..(250): n is a, c, g, or t
tcagtcacgtactacacgaccggtgctcgatttagatagatagacgagggggagctaacaacaggcaggcgaggggcagcaagatggtgttgcagacccaggtcttcatttctctgttgctctggatctctgggtcgcccgacggggacagtcgtagatcgaccctagtctaccagacctcccgtggcttgtcgtctcgtggcgagcggccacgatcaacgtgacacgtccagaccgagtgttagtttanacgacgcctacgaaataactaacgtacttcttacgtcgttacgtacagacgaacgaacgacgacacgtacctactacgcgtacgtacttcttacgttcggacggtactacgttaccgtaccgggtaccggtaccggttcccggtaccgtacggtaccgttactcggtacggtcggtacggtacggggtccgggtacggtaacggtactaacgtttaccgttaccgtaccgttacccgtaccgaaccgtacgtaccgtaccggtaccgtaccgtaccgtaccggacggtacggtacggtaagtaacggttagttacggttacgttacgtttacgtttacgttacgttgtaaccgtaacgttaacgttaacgttacgtttaacgttaccgttacccgttaccgggttaccgttaccgttacccgtttaccggttaccggggttaaccggggtaaccggggttaaccgggtaaccgggttaacgggttaacggtaaccgttaacggttaaacccggtaaaccgggttacggttacggtaccgtaccgg

SEQ ID NO: 2060 - DNA, 807 bp, Homo sapiens
  misc_feature: GYAE6OF02IVG2I.13.5.A05.1.454.CMB.1.raw
  modified_base (125)..(125): a, c, t, g, unknown or other
  misc_feature (125)..(125): n is a, c, g, or t
  modified_base (147)..(147): a, c, t, g, unknown or other
  misc_feature (147)..(147): n is a, c, g, or t
tcagtcacgtactacacgaccggtgctcgattttagatagatagacagggggagctacaacaggcaggcaggggcagcaaagatggtgttgcagacccaggtcttcatttctctgttgctctggntctcgtggtgcccgacgggacntcgtgatcgacccagtcctccgagtacctcccgtggcttcgttgtcgttcgtggcgaggtacggccaccactctaacgtcgacgtacgtaccacgaccgagtagttagttttatactagacctaaccaactaaagttaacgtaaccgtttaccttacgtacgtttaccggtaacctacgaccaaccgaaaaccgaggaaccgtactaccccgttaccgtaacgtacgtccgttacctaccgtttaacgtttaccggtcgggaccttaacgttaccgttaccgggtacccgggtaccggttacccccggtacccgttacggaccgttacgttaccgttacgacggtcggcggtaacgggtccgttaccgggtacggggttaacgtaccgtttacgtttacccggtaaccttcccgttacccaaccttacgtaccgtacggtacctaccgaccgtcgtaccggtacgtacgtagtacggttagttccgaggtttaactttagtttacgttacttcggttaacgacgttaacgttaacgtttaagttaacgtttacctaccgtacgttaccgacggttccgtacggtttcccggtacgggaccgggtaacggtacggtaaggtacgtacggtaaccgtacggtaaaccggttcgtaggtaccg

SEQ ID NO: 2061 - DNA, 816 bp, Homo sapiens
  misc_feature: GYAE6OF02FVMEX.13.5.A05.1.454.CMB.1.raw
tcagtcacgtactacacgaccggtgctcgatttagatagatagacaggggggagctacaacaggcaggcaggggcagcaagatggtgttgcagacccaggtcttcatttctctgttgctctggatctctggtgcccgacggggacatcgtgatcgaccagtctccagactccctggctgtgtctcgtgggcgaggacgggccaccatacaacgtcgacaacgtccacgccgaaggtacgttagttttacacgacgtacctaccaaacaaataagtaaacctttcgttaagtccgttaacggttaccaagacctaacgaaaacccgagggaacacggtaccctaccgttaaagccttcggccttacttaacggttttacgtacggggtacctagtaccgttacggtaccgggggtaacgttccccgggggtcccttaaacggcccgttactttccgaagggttcggacgtacgggtccggggttccggaaggggtactacgggtttactttcccgtaacgttaccctaccaacccgtactccgtaacgcacggtcccggtacgtaccggcggtacgtacgggaaagtacgttacgggtacgtacggtttacgttttaacgttacggttacgtaccgagttacgtaaactttaagtttaacgttaccttaacccggttacccggtacggtaaccggtttaccgtccggtttaaccggttaccggggaacggggttaacccggaacgggttaacggggtacgggttaacgtaaccgggtaaacccggtaaggtaaccgggttaggtacgggttaacccg

SEQ ID NO: 2062 - DNA, 859 bp, Homo sapiens
  misc_feature: GYAE6OF02FLK9O.13.5.A05.1.454.CMB.1.raw
  modified_base (253)..(253): a, c, t, g, unknown or other
  misc_feature (253)..(253): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtagatgacccagtcctcagacctccctggctgtgtctctgggcgagacgggccacactacaactgaccaacgtccgaacgtacccaaggtagtttcgttttaanaaccgtacgtaccctaccgaaaaccgtaaattaaacgtaaacctttccgtttaacgtaccgtttacgggtaacccacgtaccgaaacggtaaaacccgacggtaaccgtaccgtacccctaacccgtaaacggtccgtcggtcctaccgttaagttttaaccggtggggtactaacttaccgtacgggtaccggggtaacggtaccccggggttaccgtacggtaacccggtacgtttacggtaggggtaccgggtaccgtacggggtaccgggttaccgggtacggggtaaccgtacgttaaccgttttccgtaccgttccgtaaccgtacctactaccggtacgacctacccggtacgtcggacgaacggtccgtaaaggttaacgtacgtagggttaccgacggtttacgttttaacgtttacgttacgttaacgtacgttaacttaaaccgtttaacgtttaagttaacccgtacccgtttcccgttaacggtacgttacccgttacggtttacccggtttacgggaacccgggtacgggaaccggttaacggtaggaacgttaaccggtaaccggtaaacgttcggtaccgttggtaccgg

SEQ ID NO: 2063 - DNA, 784 bp, Homo sapiens
  misc_feature: GYAE6OF02H63LH.13.5.A05.1.454.CMB.1.raw
tcagtcacgtactacacgaccggtgctcgatttagatagatagacaggggggagctacaacaggcaggcaggggcagcaagatggtgttgcagacccaggtcttcatttctctgttgctctggatctctggtgcccgacggggacagtcgtgatcgacccagtctccagacctccctggctgtcgtctcgtgggcgaggcggccaccatacaactgactaacgtccacgccgaaggtagttagttttataccgagcctaaccaaactaattaaacggtaactttcgttaagtccgtttacggtaccaggaccaaaacggaaaccgacgggaacctaacggtccccttaacctaaagtccgtacggaccttactaacttttacggcgggtactaacgtccggttaaacggtacccggggtaaccggttccccgggtacccgtacggaacccgttagttccggaggttcgggtaccgacggggtaccgggttcgaacgggtacgtacggttaactttccgaccttacctactacccgtaagtccgacgtacctacggtccgacggtaccgtacgggtactacggaaacgtacgttcgggtacggtactttacgtttaaccggttagttacgtacgtactaagtaaactttagtttaacgttaccgtaacccgttcccgtacggtaccgtacccttaccggttccggttacggggaaccgggtaacggacgggttaacgtaggaacgtaacgtaaacccggtaaacggtacgttacggcggtaaccg

SEQ ID NO: 2064 - DNA, 777 bp, Homo sapiens
  misc_feature: GYAE6OF02G8OCO.13.5.A05.1.454.CMB.1.raw
  modified_base (445)..(445): a, c, t, g, unknown or other
  misc_feature (445)..(445): n is a, c, g, or t
  modified_base (483)..(483): a, c, t, g, unknown or other
  misc_feature (483)..(483): n is a, c, g, or t
  modified_base (519)..(519): a, c, t, g, unknown or other
  misc_feature (519)..(519): n is a, c, g, or t
  modified_base (546)..(546): a, c, t, g, unknown or other
  misc_feature (546)..(546): n is a, c, g, or t
tcagtcacgtactacacgaccggtgctcgatttagatagatagacagggggagctacaacaggcaggcaggggcagcaagatggtgttgcagacccaggtcttcatttctctgttgctcgtggatctctggtcgcccgacgggacagtcgtgagtcgaccctgtctccagtcctccgtggcttcgtgtctcggtgggcgacggacggccaacctactaccgtaacgtcgaccgtaacgtccgacgaccgtaaggttagttttacgttttaacaaccgtacgtacccgttaaaccaaaaactaaagttaaacgtaaccttttacgtaacgttaccggtttaaccgtaaccgaacgaaccgaaaaccggttaaaaccgcggtaaacccgtaccgtaccccgttaaccgtaaacggtcccgttaacgaccttacgttaacgttaccgnggtactacgtacgtacggtaccggtacgtccgggtacncgtacgtagtcgtaggtcgacgtcgggtccggttanaacggtactacgttcgtaccgtcctcnccgtaactgacgtacgacgtcgtcgtacgacggtacggtatacgtaaggtccgttaggaccgttacttaagtttccggtagtacgtacgataaaccgtttaattaacttcggttaccgttaaccgtccgttaacggccttacggtttcggttacccgggtaagggaacccggaacgggttaacggaggttaacaaccgtagaacccgtaaacggtgttccggaacgtaccg

SEQ ID NO: 2065 - DNA, 751 bp, Homo sapiens
  misc_feature: GYAE6OF02GHFUW.13.5.A05.1.454.CMB.1.raw
  modified_base (241)..(241): a, c, t, g, unknown or other
  misc_feature (241)..(241): n is a, c, g, or t
  modified_base (268)..(268): a, c, t, g, unknown or other
  misc_feature (268)..(268): n is a, c, g, or t
  modified_base (295)..(295): a, c, t, g, unknown or other
  misc_feature (295)..(295): n is a, c, g, or t
  modified_base (330)..(330): a, c, t, g, unknown or other
  misc_feature (330)..(330): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccgacggggacatcgtgatgacccagtctccagacctcccgtggctgtgtctcgtgggcagacgggccaccatacaactgacaacgtccaagccaagagttgttttanacagactaccaaacaataagaaccttntaagcttagaaccagacaacgaaaccnggacagtccctacaagctgacctactaatttacgnggacacttacgtacgtaccggggacttcccgggtccctacggacctattacgacggtcgacgtagggtcgggtcgtacgggaactaggttactttaccgtaactccgtaacctaacctacttaccgaacgaccaaccgtaccgtacgaccggtaacgtccgtaaaggaaagtaggttacggttaacggtaccttttaaaggttttacccgtttaaacgttcgggtaactaaccggttaaacttaaaagtttaacgtttaacgttaaacccgttccctttaacccgggtaccgtaacggttacccgttaccgttaaccgggtttacccggggaaccgggttaaacggggtaaccgttaaacgggtacggtaaacgttaacccggtaaaccgtaaaaccggtacggttacggtacggtaaccg

SEQ ID NO: 2066 - DNA, 869 bp, Homo sapiens
  misc_feature: GYAE6OF02H33Z0.13.5.A05.1.454.CMB.1.raw
tcagtcacgtactacacgaccggtgctcgatttagatagatagacagggggagctacaacaggcaggcaggggcagcaagatggtgtgcagaccaggtcttcatttctctgttgctctggatctctggtcgcccgacggggacactcgtgatcgacccagtctccagacctccgtggcgtgtcgtctcggtgggcgaggacgggcctaaccactctaaccgtgacaacgtcccacgaccaaggtacgttactttttaacgacgtagtacctaaccaaaccgtaaagttaaaacggtaactttacgttaacgttcgtttaccggtaaccaacgaacgtaaccgaaaaccgacggtaaccgtaccggtaccccttaaaccgtaacgtccgttaacctacctttcgtaacgttttaccggtcggggtacctagtaccggttaccggtacccggggttaaccggttccccggggtttacccacggtaacccgtacgttttaacggacggtaccggacggtaccggggcggttaccggggtacgggtaactacgggtttaaccttaccttaccgtttaccgtacctaccgttaaaggtacccgtacgaccggtacctcggtccggtaaaccggtcgaagttaacggaagttacggtcgtaaccgttagtttaacgttaacgtttaccgttacggtaacgttaacggacttaaacttacggtttaactcccggttaaccttacccgggttcccgttaacgggttaccgttaaccggttttaccggtccggggtaaccgggttaaacccggaacgggttaaacggttgaacggtttacgaaaaccgttaacgggtacggtaccgttagggtacccg

SEQ ID NO: 2067 - DNA, 967 bp, Homo sapiens
  misc_feature: GYAE6OF02GGGK8.13.5.A05.1.454.CMB.1.raw
tcagtcacgtactacacgaccggtgctcgatttagatagatagacaggggggagctacaacaggcaggcaggggcagcaagatggtgttgcagacccaggtcttcatttctctgttgctctggatctctggtcgcccgacggggacatcgtgatgacccagtctccagacctccctggctgtgtctcgtgggcgaggacgggccaaccactccaactcgacaacgtccacgccaaggtagtttagttttaactacgacgtcctaaccaaactaaacttaaacggtaacctttacgttacgtaccgtttacggttaaccgacgtaccaaacggtaaaacccgacgggaaccgaaccggtaccccttaacccgtaaacggccttacgtacccttacctaacgttttaccggtacggggaccttacgttaccgtaaccggttacccgggggaaccggtttccccgggggttacccccttacggtaacccgttactttaccggtagggtacgggtaccgacgggggtccgggttaccgggtacgggggaacgtaacgggtttaccttttacccgtaccttacccgtacccgtaaccctagttacccgaacgggtacccgtaaccgggtacccgttcgggaacccgtaacggggtaccgtaagggttaaaccgtagggtttccgggttacgggttaaccgtttttaacgggtttttaaccgtttaaccggttacggttaaccgtaacggtaaactttaaacgtttaacgttttaaacgtttaaccggttaaaccccgtttacccggttacccgggtaaccggtttacccgttacccggtttaacccgggttttaccggggggaacccggggttaaccgggggtaaacccggttaagggggttaacgggtaaacggttaaccgttaaaccgggtaaacccggttaaccgggttacggttaccgggtaacccgg

SEQ ID NO: 2068 - DNA, 713 bp, Homo sapiens
  misc_feature: GYAE6OF02GQUV8.13.5.A05.1.454.CMB.1.raw
  modified_base (246)..(246): a, c, t, g, unknown or other
  misc_feature (246)..(246): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtcgcccgacggggacatcgtgatcgacccagtcctccagacctcccgtggctgtgtctcgtgggcgaggacggccaccgatacaactgaccgaacgtccagccagtagttgtttanacagcctaccaacaaataacgtaacttacgttagtccgttacgtaacctaggaacaacgaaaaccgacggaacacgacccttaccgtaagccgtgtacctactacgtttacgtcggtacctaatacgtaccgtaccgggtaaccgtcccgggtacctacggaccgtacgtcgacggtcggccgtacgggtccgggtacggtacggacgtaacttacgtttacctacccgttacgtacccaaccgtactaccgacgtaccgtacgtccgtacgccggacggttacgaagtaacgtacgttagtacggttactttaacgtttacgttacgtacggtaccgtacgtagtaacgttaattaccgttaacgtaccgtaccgtaccgtacgtacctacggttacggttaccggggacggtaacggtacgtaacggtagtacgtaactacggaacggtagtcggtacgtaccgg

SEQ ID NO: 2069 - DNA, 741 bp, Homo sapiens
  misc_feature: GYAE6OF02I2O0B.13.5.A05.1.454.CMB.1.raw
  modified_base (611)..(611): a, c, t, g, unknown or other
  misc_feature (611)..(611): n is a, c, g, or t
  modified_base (738)..(738): a, c, t, g, unknown or other
  misc_feature (738)..(738): n is a, c, g, or t
tcagtcacgtactacacgaccggtgctcgatttagatagatagacagggggagctacaacaggcaggcaggggcagcaagatggtgttgcacgacccaggtcttcatttctcttgttgctcgtggtactctcgtgggtcgcccgacggggacagtcgtagactcgacccacgtcctccacgcctccgtggtctgttcgtctcggtgggacgaggacggccacatacgactgacaacgtccacgcgagtagttcgtttaacacgtacgtacctaacaaaacgtaaacttaacgttaacttcgttacgtacgttacgaaccgaagaacgaaacgaaacggtaacgaccaccgtaccctacgtagtctacgtctacttacgttacggcgtactacgtcgttaaccggtaccggtaccggttaccgggttcctacggtaacgttacttacgggacggttacggacggtaccggggtcgttaacggacggtaactttaccggttacctttaccgtacgtaccctaccggtaacctaccgtacgaaccggttccgtccgtccgacgtaccgacggttagacgttaacgtggttaggtcttaagttacgttaacgttnaacgttacaacgtttactacgttaagttacttacgtccgtaccgtgtaactccgttacggtacgggtcggaacggtaacggaaggttacggagtaacgaccgtaaacggtaacggtgtacggttacncgg

SEQ ID NO: 2070 - DNA, 673 bp, Homo sapiens
  misc_feature: GYAE6OF02GDH99.13.5.A05.1.454.CMB.1.raw
  modified_base (136)..(136): a, c, t, g, unknown or other
  misc_feature (136)..(136): n is a, c, g, or t
  modified_base (539)..(539): a, c, t, g, unknown or other
  misc_feature (539)..(539): n is a, c, g, or t
  modified_base (558)..(558): a, c, t, g, unknown or other
  misc_feature (558)..(558): n is a, c, g, or t
tcagtcacgtactacacgaccggtgctcgatttagatagatagacagggggagctacaacaggcaggcaggggcagcaagatggtgttgcagacccaggtcttcatttctctgttgctctggatctctggtgcccncggggacagtcgtgatgacccagtctccagactccctggctgtgtctcgtgggcgaggagggccaccatcaactgacagtccagccaggagttagttttacacgacgtactacccgaaactaaataagtaaacctttcgttagtcttacgggttaccagtacaacggtaaaaccgaggaacacgacccttaccgtaaacgctggacctactaacttttacgcggggacctacttactaccggtcggggaacgttcccggggcccttacggaaccttacgtttacgaacggtcgggtacgacgggtcggggttctacggggacaaggtacttttccgaaccgttctaccgaaccgtatacgacgacgtacgccgtcggaccgtaggcctagtaagagtttcggnggtacctagtttatacgtntacgcgtattaagtaattagtaactccgtacgtcggacgtctaagttcccgttggggaccgtaacggggcctaaggggtagacgtacgaaccgtaaggaccgttggtacggtccg

SEQ ID NO: 2071 - DNA, 179 bp, Homo sapiens
  misc_feature: GYAE6OF01DJYM0.43.13.B02.1.454.CMB.1.raw
  modified_base (131)..(134): a, c, t, g, unknown or other
  misc_feature (131)..(134): n is a, c, g, or t
  modified_base (136)..(139): a, c, t, g, unknown or other
  misc_feature (136)..(139): n is a, c, g, or t
  modified_base (141)..(179): a, c, t, g, unknown or other
  misc_feature (141)..(179): n is a, c, g, or t
tcagtgtgagtagtcacgaccggtgctcgatttagtctagcgacttccgcgggcgtgggcaaggcgcataggtcactctgttcccgcctcctcacctactcacactgagcgggctggcaaggcgcatagcnnnncnnnntnnnnnnnnnnnnnnnnnnnnnnnnnnnnnnnnnnnnnnn

SEQ ID NO: 2072 - DNA, 148 bp, Homo sapiens
  misc_feature: GYAE6OF02FKXXS.43.13.B02.1.454.CMB.1.raw
  modified_base (128)..(148): a, c, t, g, unknown or other
  misc_feature (128)..(148): n is a, c, g, or t
tcagtgtgagtagtcacgaccggtgctcgatttagtctagcgacttccgcgggctggcaaggcgcataggtcactctgttcccgccctcctcactactcacactgagcgggctggcaaggcgcatagnnnnnnnnnnnnnnnnnnnnn

SEQ ID NO: 2073 - DNA, 436 bp, Homo sapiens
  misc_feature: GYAE6OF01AOAMC.44.31.C09.1.454.CMB.1.raw
  modified_base (430)..(436): a, c, t, g, unknown or other
  misc_feature (430)..(436): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttattctgtgcgaagagggggggactggatccacagtgggtgggtggttcaactcctggggccagggagccctggtcaccgtcgccgcagcctccaccaagggccccatcggtcttccccctggcaccctcctccaagagcacctctgggggcacagcggccctgggctgcctggtcaaggctacttccacgtctactgctgagcgggctggcaaggcgcatagnnnnnnn

SEQ ID NO: 2074 - DNA, 458 bp, Homo sapiens
  misc_feature: GYAE6OF01DSY6Z.44.31.C09.1.454.CMB.1.raw
  modified_base (433)..(433): a, c, t, g, unknown or other
  misc_feature (433)..(433): n is a, c, g, or t
  modified_base (448)..(458): a, c, t, g, unknown or other
  misc_feature (448)..(458): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacactactttttctggaaatgaacagcctgagagtcgaagacacggtccctttatttctgtgcgaaggagggggggactggatccacgaggtgggtgggtggttcaacgtccgtggggccagggagccctggtcaccgtcgccgcagcctccaccaagggcccatccggtcttccccctggccacccctcctccaagacgcaccctcgtgggggccacgaggccggccctggggctgcctgggtcaaggctacttcctatatactgtctgagcgggntggcaggcgcatagnnnnnnnnnnn

SEQ ID NO: 2075 - DNA, 440 bp, Homo sapiens
  misc_feature: GYAE6OF01D24VU.44.31.C09.1.454.CMB.1.raw
  modified_base (342)..(342): a, c, t, g, unknown or other
  misc_feature (342)..(342): n is a, c, g, or t
  modified_base (428)..(440): a, c, t, g, unknown or other
  misc_feature (428)..(440): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttatttctgtgcgaagagggggggactggatccacagtgggtggtggttcaactcctggggccagggagccctggtcaccgtcgccgcagcctccaccaagggccccatcggtctcccctggcaccctcctccaagngcacctctgggggcacagcggccctggggctgcctggcaaggctactccacgtctactgctgagcgggctgggcaaggcgcatagnnnnnnnnnnnnn

SEQ ID NO: 2076 - DNA, 521 bp, Homo sapiens
  misc_feature: GYAE6OF01BOX39.44.31.C09.1.454.CMB.1.raw
  modified_base (462)..(462): a, c, t, g, unknown or other
  misc_feature (462)..(462): n is a, c, g, or t
  modified_base (481)..(481): a, c, t, g, unknown or other
  misc_feature (481)..(481): n is a, c, g, or t
  modified_base (484)..(521): a, c, t, g, unknown or other
  misc_feature (484)..(521): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttatttctgtgcgaaggagggggggactggatccagaggtgggtgggtggttcaactccgtgggggccagggagccctggtcaccgtcgcccgcacggccctccacccgaacggggccccaagtccggtcctttcccccccgtggcccaccccgtccctaccaaagacgcaacccttcgtcgggggccacgaggccggccctgggcctgccctgggtcaaaggctacttccaagttactactgtctgaggccgggtntgggctaagggcgcatagncgnnnnnnnnnnnnnnnnnnnnnnnnnnnnnnnnnnnnnn

SEQ ID NO: 2077 - DNA, 594 bp, Homo sapiens
  misc_feature: GYAE6OF01CSAUD.44.31.C09.1.454.CMB.1.raw
  modified_base (552)..(553): a, c, t, g, unknown or other
  misc_feature (552)..(553): n is a, c, g, or t
  modified_base (555)..(556): a, c, t, g, unknown or other
  misc_feature (555)..(556): n is a, c, g, or t
  modified_base (558)..(562): a, c, t, g, unknown or other
  misc_feature (558)..(562): n is a, c, g, or t
  modified_base (564)..(566): a, c, t, g, unknown or other
  misc_feature (564)..(566): n is a, c, g, or t
  modified_base (568)..(568): a, c, t, g, unknown or other
  misc_feature (568)..(568): n is a, c, g, or t
  modified_base (570)..(594): a, c, t, g, unknown or other
  misc_feature (570)..(594): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaggccgcttcaccatctccagagacaattccggaaacactacttttttctggaaatgaacagcctgagagtcgaagacacggcccttttatttctgtgacgaaggagggggggactgggatccgacgaggtggggtgggtggttacaacgtccgtggggccagggagccctggtcaccgtcgccgcagccctcaccaagggcccatccggtccttcccccgtggccacccgtcctaccgaagacgccaaccctcgtcggggggccaacgacggtccggaccccgtggggcctcggcccgtcgggtttaccaaacgggacctttaacccgtttcccctacgggtaacttcccggtaccggttacctcgggtaacgggtcccggggacccgttcgggggaacccgaaacggggcccgaccgtaagttaacggcgnngnngnnnnncnnngntnnnnnnnnnnnnnnnnnnnnnnnnn

SEQ ID NO: 2078 - DNA, 594 bp, Homo sapiens
  misc_feature: GYAE6OF01AN8JJ.44.31.C09.1.454.CMB.1.raw
  modified_base (555)..(555): a, c, t, g, unknown or other
  misc_feature (555)..(555): n is a, c, g, or t
  modified_base (561)..(567): a, c, t, g, unknown or other
  misc_feature (561)..(567): n is a, c, g, or t
  modified_base (569)..(594): a, c, t, g, unknown or other
  misc_feature (569)..(594): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttatttctgtgcgaaggagggggggactggatccacgagtgggtgggtggttcaacgtccgtggggccaggggagcccgtggtcaccgtcgccgcacgccctccaccgaagggccccatccggttccttccccccgtggccacccctcctcccaaagacggccaccctcgtcgggggccaccgacggccgggcccccgtggggcctcgggccccgttggggttaccaaacgggtacccttaacctttccccgttaaatttaacttaaccgttcggttccgttacgggtacggcccgggggtccgttcgggggacccgaaacgggggtccccggtaccaacgttaacggancgtgtnnnnnnncnnnnnnnnnnnnnnnnnnnnnnnnnn

SEQ ID NO: 2079 - DNA, 468 bp, Homo sapiens
  misc_feature: GYAE6OF01AFLZX.44.31.C09.1.454.CMB.1.raw
  modified_base (455)..(468): a, c, t, g, unknown or other
  misc_feature (455)..(468): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacacttttttctggaaatgaacagcctgagagtcgaagacacggccctttatttctgtgcgaaggaggggggggactgggatccacagtgggtgggtggttcaacgtcctggggccaggggagcccgtggtcaccgtcgcccgcagcctccaccaagggcccatcggtcttccccctggccacccctcctcccaagacgccaccctcgtgggggccacaggccggcccctggggcctggcctgggtcaagggctacttcctcgactcgcgtctgagcgggctggcaaggcgcatagnnnnnnnnnnnnnn

SEQ ID NO: 2080 - DNA, 792 bp, Homo sapiens
  misc_feature: GYAE6OF01CGLZT.44.31.C09.1.454.CMB.1.raw
  modified_base (103)..(103): a, c, t, g, unknown or other
  misc_feature (103)..(103): n is a, c, g, or t
  modified_base (785)..(785): a, c, t, g, unknown or other
  misc_feature (785)..(785): n is a, c, g, or t
  modified_base (790)..(790): a, c, t, g, unknown or other
  misc_feature (790)..(790): n is a, c, g, or t
tcagacagtatatacacgaccggtgctcgatttagacgtctcatcaaggaaggaagggtccctgagactctcctgtgcagcctctggccttcccctttagganctatgccatgacctgggtccgccaggctcgagggaggggctcgagtgtgtctcgactaattcggcgctagtcgcaactgaccacatactacggagacgtccggtaggacgggccgtcttcaccactcctaccaagagtaactaacgttacccggaaacaccttactttttacgaggaaatagaactacgccgtaggagtaagtacgaaacgacctaccggtaccctttagtttctaggttcggacggtaaggggaggggggtactaggtaacgtccgaacggtacgggttcggggtagggttcggttaccgtaaccgttccgggacggggccgaagggggtccgtcccggtacggttacccggacccggtcggcccgtaccgaccggcccgtacccgaaccggaaccgggccctacgttccccggttcccttcccccgaccgggtcccctaccccgtcccgtacccaacggacgacccgtaacccgtcgggccgggaaccgccggtaaccgggcccggtcccggtccgggttcggtccggtacccggttacgggacccgtaacggttacccgttacccgtttcccggtactaccgtcccggcgttacgacgggtaccgggccgggtccggttaacgggccggtaaccggcccgggaaacgtcggttaaacggtcgacggtcncgtgngc

SEQ ID NO: 2081 - DNA, 566 bp, Homo sapiens
  misc_feature: GYAE6OF01BH5JU.44.31.C09.1.454.CMB.1.raw
  modified_base (137)..(137): a, c, t, g, unknown or other
  misc_feature (137)..(137): n is a, c, g, or t
  modified_base (373)..(373): a, c, t, g, unknown or other
  misc_feature (373)..(373): n is a, c, g, or t
  modified_base (524)..(524): a, c, t, g, unknown or other
  misc_feature (524)..(524): n is a, c, g, or t
  modified_base (530)..(530): a, c, t, g, unknown or other
  misc_feature (530)..(530): n is a, c, g, or t
  modified_base (532)..(533): a, c, t, g, unknown or other
  misc_feature (532)..(533): n is a, c, g, or t
  modified_base (539)..(539): a, c, t, g, unknown or other
  misc_feature (539)..(539): n is a, c, g, or t
  modified_base (542)..(543): a, c, t, g, unknown or other
  misc_feature (542)..(543): n is a, c, g, or t
  modified_base (546)..(547): a, c, t, g, unknown or other
  misc_feature (546)..(547): n is a, c, g, or t
  modified_base (549)..(549): a, c, t, g, unknown or other
  misc_feature (549)..(549): n is a, c, g, or t
  modified_base (551)..(551): a, c, t, g, unknown or other
  misc_feature (551)..(551): n is a, c, g, or t
  modified_base (553)..(553): a, c, t, g, unknown or other
  misc_feature (553)..(553): n is a, c, g, or t
  modified_base (558)..(560): a, c, t, g, unknown or other
  misc_feature (558)..(560): n is a, c, g, or t
  modified_base (562)..(562): a, c, t, g, unknown or other
  misc_feature (562)..(562): n is a, c, g, or t
  modified_base (564)..(564): a, c, t, g, unknown or other
  misc_feature (564)..(564): n is a, c, g, or t
  modified_base (566)..(566): a, c, t, g, unknown or other
  misc_feature (566)..(566): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcacatcnccagagacaattccggaaacactactttttctaggaaatgaacagcctgagagtcgaagacaccggtcccttttatttctgtgcgaaggagggggggactggatccagaggtgggtgggtggttcaactcgtggggcagggacgccctggtccaccgtccgccgcacgccctccaccgaacgggccccagtccggtccttcccccgtggccaccctcctccaagacgcaccgtcgnggggccacgtcgccgccgtgggctcggcctggtacgaacgtacctactttacccgacgttacctacgtcgcgttaggacggtccgggtacgttcgggaccgtaacgggcgaacgtaacgtacgagcgagcgtagcagcaggactcgcaagngcgcgncnncgctgngtnngcnncncncncatcnnncngngn

SEQ ID NO: 2082 - DNA, 437 bp, Homo sapiens
  misc_feature: GYAE6OF02GADNB.44.31.C09.1.454.CMB.1.raw
  modified_base (433)..(437): a, c, t, g, unknown or other
  misc_feature (433)..(437): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttatttctgtgcgaagagggggggactggatccacagtgggtgggtggttcaactcctggggccaggggagccctggtcaccgtcgccgcagcctccaccaagggcccatcggtcttccccctggccaccctcctccaagagcacctctgggggcacagcggccctgggctgcctggtcaaggactacttcctatatactgtctgagcgggctggcaaggcgcatagnnnnn

SEQ ID NO: 2083 - DNA, 435 bp, Homo sapiens
  misc_feature: GYAE6OF02HHB5W.44.31.C09.1.454.CMB.1.raw
  modified_base (431)..(435): a, c, t, g, unknown or other
  misc_feature (431)..(435): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttatttctgtgcgaagagggggggactggatccacagtgggtgggtggttcaactcctggggccaggggagccctggtcaccgtcgccgcagcctccaccaagggcccatcggtcttcccccctggccaccctcctccaagagcacctctgggggcacagcggccctgggctgcctggtcaaggctactccacgtctactgctgagcgggctggcaggcgcatagnnnnn

SEQ ID NO: 2084 - DNA, 436 bp, Homo sapiens
  misc_feature: GYAE6OF02FQW8A.44.31.C09.1.454.CMB.1.raw
  modified_base (345)..(345): a, c, t, g, unknown or other
  misc_feature (345)..(345): n is a, c, g, or t
  modified_base (430)..(436): a, c, t, g, unknown or other
  misc_feature (430)..(436): n is a, c, g, or t
tcagacagtatatacacgaccggtgctcgatttagacgtctcatcaaggaaggaaggggctcgagtgggtctcgacaattggcgctagtgcaactgacacatactacggagagtccgtgaagggccgcttcaccatctccagagacaattccggaaacacactttttctggaaatgaacagcctgagagtcgaagacacggccctttatttctgtgcgaagagggggggactggatccacagtgggtgggtggttcaactccgtggggccagggagccctggtcaccgtcgccgcagcctccaccaagggcccatcggtcttccccctggcaccctcctccaagngcacctctgggggcacagcggccctgggctgcctggtcaaggctacttcctatatactgtctgagcgggctggcaggcgcatagnnnnnnn

SEQ ID NO: 2085 - DNA, 584 bp, Homo sapiens
  misc_feature: GYAE6OF02GAMUX.44.31.C09.1.454.CMB.1.raw
  modified_base (253)..(253): a, c, t, g, unknown or other
  misc_feature (253)..(253): n is a, c, g, or t
  modified_base (574)..(574): a, c, t, g, unknown or other
  misc_feature (574)..(574): n is a, c, g, or t
  modified_base (576)..(576): a, c, t, g, unknown or other
  misc_feature (576)..(576): n is a, c, g, or t
  modified_base (582)..(582): a, c, t, g, unknown or other
  misc_feature (582)..(582): n is a, c, g, or t
tcagacagtatatacacgaccggtgctcgatttagacgtctcatcaaggaaggaagggtccctgagactctcctgtgcagcctctggcttcccctttaggagctatgccatgacctgggtccgccaggctccagggaaggggctcgagtgtgtctcgacaattggcgctagtgcaactgacacatactacggagagtccgtgaagggccgcttcaccatctccagagacaattccggaaacactactttttcnggaaatgaacagcctgagagtcgaagacacggccctttatttctgtgcgaaggaggggggggactggatccacagtgggtgggtggttcaactcgtgggccagggacgccgtggtcaccgtcgccgcacgcctccaccaacgggcccacgtccggtccttcccccgtggccctaccccgtccctacccgaacgacgccacctcgtcggggccacgcgccgcccgtgggctcgccgtggtaccaacggtaccttaccttccgtaatactacgtcgtctggacggccgggtcgtcgggaccgaaggggccgacgagtacggcngngctcgncg

SEQ ID NO: 2086 - DNA, 201 bp, Homo sapiens
  misc_feature: GYAE6OF01CPWA9.45.75.G09.1.454.CMB.1.raw
  modified_base (200)..(201): a, c, t, g, unknown or other
  misc_feature (200)..(201): n is a, c, g, or t
tcagacgcgatcgacacgaccggtgctcgatttagtatagacatcagggtccgggagatcatgagggtgtccttgggtttgggggaagaggaagactgacggtcccccaggagttcaggtgctgggcacagcggccctgggctgcctggtcaaggactacttcctcgatcgcgtctgagcgggctggcaaggcgcatagnn

SEQ ID NO: 2087 - DNA, 446 bp, Homo sapiens
  misc_feature: GYAE6OF01CUA4T.45.75.G09.1.454.CMB.1.raw
  modified_base (442)..(446): a, c, t, g, unknown or other
  misc_feature (442)..(446): n is a, c, g, or t
tcagacgcgatcgacacgaccggtgctcgatttagtatagacatcagggggaagaccgaagggcctggagtgggtctcagtaatttttagtacaggcacagcgtactacgcagattccgttaagggccgattcaccatctccagagacaattccaggaacacggtgtttcttgaaatgaacaccctgagacccgaggacacggctctatattactgtgcgagagatcgaacccagacccggaagaaattctaacaactactacggtatggacgtctgggccaagggaccaccgtcaccgtctcctcagcctccaccaagggcccatcggtcttccccctggcaccctcctccaagagcacctctgggggcacagcggccctgggctgcctggtcaaggactactcctcgatcgcgtctgagcgggctggcaaggcgcatagnnnnn

SEQ ID NO: 2088 - DNA, 504 bp, Homo sapiens
  misc_feature: GYAE6OF01C2IV9.45.75.G09.1.454.CMB.1.raw
  modified_base (224)..(224): a, c, t, g, unknown or other
  misc_feature (224)..(224): n is a, c, g, or t
  modified_base (421)..(421): a, c, t, g, unknown or other
  misc_feature (421)..(421): n is a, c, g, or t
tcagacgcgatcgacacgaccggtgctcgatttagtatagacatcaggggggggtcgtcaggaggcagcgcctctcgggacgtctccaccatggcctgggctctgctattcctcaccctcctcactcaggcacagggtcctgggcccagtctgccctgactcagcctgcctccgtgtctgggtctcctggacagtcgatcaccatggcctgcactggaaccaanagtgattgttgggattttagtttgctctggtatcagcaacacccaggcaaagcccccaaaactcatcatttatgatgtcaataatcggccctctaggggtttctcatcgcttctctggctccaagtctggcaatacggcctccctgaccatctctgggctccgagtctggaggacgagctgattattactgcagctnatatgcacgcagcatcgactctagtattcgggagagggaccaagctgacccgtcgtacggtcacgcccaaggctcgtcccccg

SEQ ID NO: 2089 - DNA, 545 bp, Homo sapiens
  misc_feature: GYAE6OF01DL22K.45.75.G09.1.454.CMB.1.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctctggtatcagcaacacccaggcaaagcccccaaactcatcatttatgatgtacaataattggccctcaggggtttctcatcgcttctctgctccaagtctggcaatacggcctccctgaccatctctgggctccgaggcctagaagacgaggctagatttattactgcagcacattataattagttctttccgtacgttcgggtattcgggcggaggtacctaagtcgtaccgtccgtaggtcacggcccaacggctaccgcccccgttacgtcctaccttcgtccgttaccccc

SEQ ID NO: 2090 - DNA, 516 bp, Homo sapiens
  misc_feature: GYAE6OF01AMGXL.45.75.G09.1.454.CMB.1.raw
  modified_base (297)..(297): a, c, t, g, unknown or other
  misc_feature (297)..(297): n is a, c, g, or t
  modified_base (365)..(365): a, c, t, g, unknown or other
  misc_feature (365)..(365): n is a, c, g, or t
  modified_base (375)..(375): a, c, t, g, unknown or other
  misc_feature (375)..(375): n is a, c, g, or t
  modified_base (393)..(393): a, c, t, g, unknown or other
  misc_feature (393)..(393): n is a, c, g, or t
  modified_base (446)..(446): a, c, t, g, unknown or other
  misc_feature (446)..(446): n is a, c, g, or t
tcagacgcgatcgacacgaccggtgctcgatttagtatagacatcaggggggggtcgtcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacaccaggcaaacgcccccaaatcatcatttangatgtacaataatcggcctcgaggggtttcaagtcgcttactctggctcagtctggcacacgcctccngacatctcgnggctcagctcgaggacgngctgtattattctgtgctcatatgcaggaccagctacgttgggtcgttcgggnggacggccaggttcgaccgtcgtcggacacgccgaagcgtcgtccccgtgtaccactccgtcgtaccccg

SEQ ID NO: 2091 - DNA, 519 bp, Homo sapiens
  misc_feature: GYAE6OF01CBZHB.45.75.G09.1.454.CMB.1.raw
  modified_base (411)..(411): a, c, t, g, unknown or other
  misc_feature (411)..(411): n is a, c, g, or t
  modified_base (486)..(486): a, c, t, g, unknown or other
  misc_feature (486)..(486): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccagccgggggggtccctcagactctcgtgtgcagcctctggattcaccgtcagtggcagcttcctgagctgggtccgccaggctccagggaggcctggagtgggtctcagtaattttagacaggcacagcgtactacgcagattccgtaaggccattcaccatctcagagacaattccagaacacggtnttctgaatgaacacctgacgacccgagacacggctctatattactgtgcgagagatcgaacccagaacccggaanaaacttcaacaactactacgtatggacgtacgg

SEQ ID NO: 2092 - DNA, 567 bp, Homo sapiens
  misc_feature: GYAE6OF01BILN0.45.75.G09.1.454.CMB.1.raw
tcagacgcgatcgacacgaccggtgctcgatttagtatagacatcaggggctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccagccgggggggtccctcagactctcgtgtgcagcctctggattcaccgtcagtggcagcttcctgagctgtgtccgccaggcctccgaggggaagggcctgggagtggggtctcagttaatttttagacaggtcacagcgtactacgcagacttccgttaagggccattccaccatctccagagacaattcccaggaacacggttgtttcttagaaatcgaacaccctgacgacccgaggaaccacggctcgtattattactgtcgacgagagataccgaacccgcggaacccggaagtaaacttcctaaacaacttactacggttaatcgggtacgtcggtacgggg

SEQ ID NO: 2093 - DNA, 563 bp, Homo sapiens
  misc_feature: GYAE6OF01DN3SS.45.75.G09.1.454.CMB.1.raw
  modified_base (556)..(563): a, c, t, g, unknown or other
  misc_feature (556)..(563): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagtacaggcacagcgtactacgcagattccgttaagggccgattcaccatctccagagacaattccaggaacacggtgtttcttgaaatgaacacctgagacccgaggacacggctctatattactgtgcgagagatcgaacccagacccggaagaaattctaacaactactacggtatggacgtcgtggggccaaggggacccaccgtcacccgtctcctcacgccctccaccaacgggcccagtccggtccttcccccgtcggccaccctcctccaacgacgccacctcgtcggggcacgacgccggcccgtgggctcgccgtggtccaacggacctaccgttccgtcgtactccgcgtcgtcgacggcgggctcgggccgaagggcgcgagtagnnnnnnnn

SEQ ID NO: 2094 - DNA, 597 bp, Homo sapiens
  misc_feature: GYAE6OF01CC2RJ.45.75.G09.1.454.CMB.1.raw
  modified_base (591)..(591): a, c, t, g, unknown or other
  misc_feature (591)..(591): n is a, c, g, or t
  modified_base (593)..(597): a, c, t, g, unknown or other
  misc_feature (593)..(597): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagacaggcacagcgtactacgcagattccgttaagggccgattcaccatctccagagacaattccaggaacacggtgtttcttgaaatgaacacctgagacccgaggacacggctctatattactgtgcgagagatcgaacccagacccggaagaaacttctaacaactactacggtatggacgtcgtggggccaagggccacgtcaccgtctcctcacgcctacaaccgaacgggccccagtccggtccttcccccgtcggccaccctccctaccaacgacgccacctcgtcggggccaccgacggccggccccgtcgggcctcggcccgtcgggtccgaacgggtaccttaccgtttcccgtaccgtactaccggtccgttccgtcggacggccggggtcgtcgggccgaacgggccggcgacgtagcgcngnnnnn

SEQ ID NO: 2095 - DNA, 533 bp, Homo sapiens
  misc_feature: GYAE6OF01CMTFR.45.75.G09.1.454.CMB.1.raw
  modified_base (252)..(252): a, c, t, g, unknown or other
  misc_feature (252)..(252): n is a, c, g, or t
  modified_base (507)..(507): a, c, t, g, unknown or other
  misc_feature (507)..(507): n is a, c, g, or t
  modified_base (523)..(524): a, c, t, g, unknown or other
  misc_feature (523)..(524): n is a, c, g, or t
  modified_base (528)..(533): a, c, t, g, unknown or other
  misc_feature (528)..(533): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagtacaggcacagcgtactacgcagattccgttaagggccgattcaccatctccagagacaattccaggaacacggtgtttcttgaaatgaacnccctgagacccgaggacacggctctatattactgtgcgagagatcgaacccagacccggaagaaattcaacaactactacggtatggacgtctggggccaagggccaccgtcaccgtctcctcagcctccaccaagggccccagtccggtaccttcccccgtcggccacccctcctccaacgacgcacctcgtcggggcacgagccgcccgtcgggctgccgtggtcaacggtactacttcctcgactcgcgtcngagcggctggcaggcnntagnnnnnn

SEQ ID NO: 2096 - DNA, 672 bp, Homo sapiens
  misc_feature: GYAE6OF01A2UQW.45.75.G09.1.454.CMB.1.raw
  modified_base (289)..(289): a, c, t, g, unknown or other
  misc_feature (289)..(289): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggagcgttggtccgaggccggggggtccctcgagactctcgtgtgcagcctctggattcaccgtcagtgcagcttccngagcgtgggtcccgccaggcctccgaggggaacggcctgggaggtgggtctacgtagttaattttagacaggcacagcgtactacgctagtacgtttaccggtaaggccgtattccaacctacttccgtaccaaggaacgtaactaaacgttcccgaaaggtaacctacggttcttttaccgtaagaaactgaaccctaccgtagaacgtacccgaaggaccgacggtactacgttaacttacgttacgtggttacgacggtaaggtaacgtacgtaaccggaaaccccgtacggaaaccccgggtaaaagttaaaccttacccgtaaaccgtaaaccgttaaccgttaaccgggtaacttaccggggtaaccgttaccgggg

SEQ ID NO: 2097 - DNA, 685 bp, Homo sapiens
  misc_feature: GYAE6OF01CPGOY.45.75.G09.1.454.CMB.1.raw
  modified_base (278)..(278): a, c, t, g, unknown or other
  misc_feature (278)..(278): n is a, c, g, or t
  modified_base (307)..(307): a, c, t, g, unknown or other
  misc_feature (307)..(307): n is a, c, g, or t
tcagacgcgatcgacacgaccggtgctcgatttagtatagacatcaggggctgggagaggagcccagcactgggattccgaggtgtttccattcagtgatctgcactgaacacagaggactcgccatggagtttgggctgagctgggttttccttgttgctaattttaaaaggtgtccagtctgaggagcagctggtggagtcgtgggggaggcgttggtccgagggccgggggggtccctcgagactctcgtgtgcagcctctggacttcgaccgtnagtggcagtcttcctgagcgtcgggtccnccgaggcctccgaggggaacggccgtaggaggtgggtctcgtaagtttaagtttttacgaacgacgggacaacgtaaggtccgttaacgtacgaccaaggtacgtttacccgggttaaagggcccgtaaacttcccaaaccgtactcctacccgaagaacgaactaacttacccgaaggtaacctacggttgtttactagaaattcgaaacctaccgtagaacgaccgacggacacggtactactagttacttactgtagacgaagagtacgtacccgaaacccgtaagggaaccccggtaaaagtaaactttccaaaaccgtaaaccttaccgtaaacggtagtacgggtaaccgttcgggtacggggaaaccccgg

SEQ ID NO: 2098 - DNA, 555 bp, Homo sapiens
  misc_feature: GYAE6OF01BIHVQ.45.75.G09.1.454.CMB.1.raw
  modified_base (284)..(284): a, c, t, g, unknown or other
  misc_feature (284)..(284): n is a, c, g, or t
  modified_base (344)..(344): a, c, t, g, unknown or other
  misc_feature (344)..(344): n is a, c, g, or t
  modified_base (549)..(549): a, c, t, g, unknown or other
  misc_feature (549)..(549): n is a, c, g, or t
  modified_base (551)..(555): a, c, t, g, unknown or other
  misc_feature (551)..(555): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagacaggcacagcgtactacgcagattccgttaagggccgattcaccatctccagagacaattccaggaacacggtgtttctgaaatgaacacctgacgacccgaggacacggctctatattacngtgcgagagatcgaacccaggacccggaagaaattcaacaactactacggtatggacgtntggggaccaaggggaccacgtcaccgtctcctcagcctccaccgaaggcccaatccggtccttcccctggccaccctcctccaagacgccacctccgtcggggccacacggccggcccgtgggctcgccgtgggtccaacggtacctacgttccctacgtcgacgtacgtctgacgtcgggcgtcggcgtaagggcgcagtgatngnnnnn

SEQ ID NO: 2099 - DNA, 605 bp, Homo sapiens
  misc_feature: GYAE6OF01EFOR4.45.75.G09.1.454.CMB.1.raw
  modified_base (222)..(222): a, c, t, g, unknown or other
  misc_feature (222)..(222): n is a, c, g, or t
tcagacgcgatcgacacgaccggtgctcgatttagtatagacatcagggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactgaaccngcagtgatgttgggattataaccttgtctctggtaccacagcaccaggcaaacgcccccaaatcatgatttatgaggcagtaacgcgtcctgtagggtttcaatcgtcttctcgtggctaccaagtcgtcggacaacgaccggcctcccgtagacaactcgtcgtcggcctccgaggtacctaggacggacgtaggtccgttagtaactttacttacgtcgccgttgtcctacaattagtcgacgttaagggttagttacgtttaccgtttgggtacggttcgggacgggtaacggtaccgaagtccgtacggtacccgttaccgtaggtacctaccgtacccggtaacggtcccttaccgtccccccgtggtcccttacccg

SEQ ID NO: 2100 - DNA, 768 bp, Homo sapiens
  misc_feature: GYAE6OF01B0MV8.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaggtgtccagtctgaggagcagctggtggagtcgtgggggaggcgttggtccgagggccgggggggtccctcgacgactcgtcggtgtcgcgacgtcctcgtaggtacttccgaccgtcgtacggtcggcacgtccttccgtggacgtcggtcgggtcccgccgtacggtccgtaccgggaaggggacgggtccggtagggtacggttcgggtctacgtaaggttttaagttttacggacgtacggtactaacgacgtaccgtacgtacgtacgtaacgttaccgttaccggtaacggcctacgtaccacgtacgtcctaccgagtacgtaactaacgttacgaacggtaacgtacggtttactttacgtaacgtaaacgtacgtaaccctacgttaggaacccgtaacccggaacggtacccgtaaccggtccttaacgttaagttaccgttacgtgggtaacgacggtaagtaaccgtaaccgtaacccggaaacccgtaacggaaccccgggtaaaagttaaacccgttacccgaaacgttaaacccgttaacggttaaccggttaggtacccgggtacccggttaaccgggg

SEQ ID NO: 2101 - DNA, 597 bp, Homo sapiens
  misc_feature: GYAE6OF01DYVC5.45.75.G09.1.454.CMB.1.raw
  modified_base (319)..(319): a, c, t, g, unknown or other
  misc_feature (319)..(319): n is a, c, g, or t
  modified_base (591)..(592): a, c, t, g, unknown or other
  misc_feature (591)..(592): n is a, c, g, or t
  modified_base (594)..(597): a, c, t, g, unknown or other
  misc_feature (594)..(597): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagtacaggcacagcgtactacgcagattccgttaagggccgattcaccatctccagagacaattccaggaacacggtgtttcttgaaatgaacacctgacgacccgaggacacggctctatattactgtgcgagagactacgaacccaggaacccggaaanaaacttcaacaactactacggtatggacgtcgtcggggacaaaggggaccaccgtcgaccgtctcctcacgcctaccaccgaacgggccctagtcccggttccttccccgtcggccctacccctcctaccaacgacgcctaccgtcgtcgggcacgacggccgcccgtgggcctcggccgtcggtaccgtaacggtaccttaccgttccgtacgtacgtccgtccgttcgcggacggtccgggcgtcgggaccgaagggcgacgagtagctnnannnn

SEQ ID NO: 2102 - DNA, 693 bp, Homo sapiens
  misc_feature: GYAE6OF01CYCC4.45.75.G09.1.454.CMB.1.raw
  modified_base (309)..(309): a, c, t, g, unknown or other
  misc_feature (309)..(309): n is a, c, g, or t
tcagacgcgatcgacacgaccggtgctcgatttagtatagacatcagggggctggggtctcaggaggcagcgctctcgggacgtctccaccatggcctgggctctgctattcctcaccctcctcactcagggcacgagggtcctgggcccagtctgccctgactcagcctgcctcctgtctgggtctcctggacagtcgatcaccactcccctgcactggactccgaggtcggtgtacgttgttaattataactatgtctctcggtaaccaacaacaccgaggacaaacgccccaaatcatgtatttangtatgtactaagtacgtccgcctaggtacgggtttctagtacgtcgtcctttctcgtcggcctacgtaacgtcgtacggacctaaccgtaccgtccctacccgtcgtaacctcgttcctcggtacggtcctacccggaagggtcgtacggacgggtaacggtacggtacttagttaacgtttacgtacgtcgtacgacgttactacgtaagttagtaccggtacgaccgtacgaactccgtagtacgtacgttacgttaacgggttaccggttaccggggaaccgggtaaccgggaaccgtaacgggtccgttaacccgggtaccggtttacccggtacggttaccgaacccgggtacccgaacgggtcccccgttaccccggg

SEQ ID NO: 2103 - DNA, 818 bp, Homo sapiens
  misc_feature: GYAE6OF01DHBG7.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggagcttggtccaggccgggggggtccctcgagactctcgtgtgcagcctctggacttcaccgtcagtcggcagtcttcctgacgtcgtcgggtcccgccgaggcctccgagggaggccgtggaggtgggtctctaggttaattttacgactaggctacgagtacgtaactaccggataacgtacgtttacccgggttaaagggcccgtaattcccgaacctactccctaccgaacgtaacgtaacctaaacgttacccgaagggtaaccgttaaccgggtttacgttttaccgttaaggaaaaccgtttacggtaaaacccttaccccggttaagaaccgggaaaccccccgggtaaggtaaccccggtaaccgggttcccttaaccgtttaaacgttaacgttttaacccggttcgggttaaccggtaaccggggtaaagtaaccgggttaaaccgttaaccccgggtaaaacccccgaaacccggggttaaaccccgggtaaaaacgtaaaacccgttttacccgttaaaaacccgtaaaacccgtttaaacggttaacccggggttaactttaacccgggggtaacccggtttaacccggggg

SEQ ID NO: 2104 - DNA, 769 bp, Homo sapiens
  misc_feature: GYAE6OF01DI874.45.75.G09.1.454.CMB.1.raw
tcagacgcgatcgacacgaccggtgctcgatttagtatagacatcagggggggagaggagcccagcactgggattccgaggtgtttccattcagtgatctgcactgaacacagaggactcgccatggagtttgggctgagcttgggttttccttgttgcttattttaaaaggtgtccagtctgaggagcagcgtggtggagtcgtgggggaggcgttggtccgaggccgggggggtccctcagactcgtcgtgtgcagcctcgtggattcaccgtcaggtgcagtcttccgtgacgtcgtcggggtcccgccgaggccgtccggaggggtaacggtccgtgggaggttcgggtctacgtagtttaaagtttttacggacacggacacgagtccgtaactacgacaggtaacgtttccggtaacgggtaccgtacgttacccaaccgtacgttccgtacccgaaggacgtaacctaacgtttacccgaagggtaaacccgtacgggtttacgttttacgttaaggtaaaacttaccggaaacctaacccccggttaggaaacccggtaaccccggaacgggaacccgtaaccgggtactttaccgttaaagttaaccgtttaccgtggttacggacgtaagacgtaacgtacccgtaaaccccgaacggtaaacccggtaaaagttaaaccttaccttaaaccgtaaccgttaacgtaacggtaagtacgggtaacgtcggtacgggggaaccctaacggggtaaccccg

SEQ ID NO: 2105 - DNA, 736 bp, Homo sapiens
  misc_feature: GYAE6OF01D0SJF.45.75.G09.1.454.CMB.1.raw
  modified_base (284)..(284): a, c, t, g, unknown or other
  misc_feature (284)..(284): n is a, c, g, or t
  modified_base (732)..(732): a, c, t, g, unknown or other
  misc_feature (732)..(732): n is a, c, g, or t
  modified_base (734)..(734): a, c, t, g, unknown or other
  misc_feature (734)..(734): n is a, c, g, or t
  modified_base (736)..(736): a, c, t, g, unknown or other
  misc_feature (736)..(736): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccgagggaagggcctggagtgggtctcagttaatttttagacaggcacagcgtactacgcagattccgttaagggccattcaccatctccagagacaattccaggaacacggttgttcttgaaatgaacacctgacgaccgaggacacggctctatattacngtgcgagagactacgaaacccaggaacccggaaataaacttccaactaacctaacgttaacggtagtcgggaacgttcggtacggggaccaaacggggaccctaccgtccacccgtcctccgtacgacgccctacccgaaccgaacgggcccctaagttcccggtacccctttccccccgtcggtaccccgtacccccttacccgtaccgtaaacggtaccgacccgtaacccgttccgggttccgggggaccctaaccggacccgggtcccgggacccggttcggggacccgttccgggtacccgttcggggttaaccgtaaccgggtaccccgttaccgtttaccccgtaccggttacgttcccggtccggtaccggttacgggaccggtccggggtaccgttacgggaccggtaacgggccggtacgagttacgcgcgtcagcgngngn

SEQ ID NO: 2106 - DNA, 565 bp, Homo sapiens
  misc_feature: GYAE6OF01DLQCL.45.75.G09.1.454.CMB.1.raw
  modified_base (290)..(290): a, c, t, g, unknown or other
  misc_feature (290)..(290): n is a, c, g, or t
  modified_base (310)..(310): a, c, t, g, unknown or other
  misc_feature (310)..(310): n is a, c, g, or t
  modified_base (474)..(474): a, c, t, g, unknown or other
  misc_feature (474)..(474): n is a, c, g, or t
  modified_base (558)..(558): a, c, t, g, unknown or other
  misc_feature (558)..(558): n is a, c, g, or t
  modified_base (560)..(565): a, c, t, g, unknown or other
  misc_feature (560)..(565): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagtacaggcacagcgtactacgcagattccgttaaggccgattcaccatctccagagacaattccaggaacacggtgtttctgaaatgaacacctgagaccgaggacacggctctatattactgtgcgagngatcgaaccagacccggaanaattcacaactactacggtatggactcgtggggccaagggaccacgtcaccgtctccctcacgcctccaccgaacgggcccatccggtccttccccgtcggccaccctccctaccgaacgacgcacccgtcgtcggggccacgcggaccggccccgtcgggccncggtcccgtcggtaccaacggtacctaccttcctcgtatccgtcgtcgtcggacggccgggtcgcggcgaacgggcgacagagncnnnnnn

SEQ ID NO: 2107 - DNA, 826 bp, Homo sapiens
  misc_feature: GYAE6OF01ELGBZ.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggatccagcggtgtacgttactgtttttaagatgtctctggtatcagcaacaccaggacaaacgcccccaaactcatctatttatgatgtactaataacgtccggtcccttacgtacggggtttctacgtactccgtcctttctccgttcggtaccttaccgtaaacggttccgtacgggtaacctaaacgttacccgggtaccccttaccccgtacggtaaaccctacgtttcccgtaccggttccgggggtacccttacccgggtaacgggtacccggtttaaacgggaaaaccgggtaaccggggtaacgggtaccggtttaacgggttaaacttttaaaccggtttaaccgttacggaccctaacgggtacctaaacggtaatttaacgtttaacgttttaacgggtttaccgttttacccgtaaccgggtttaccggggtttaacggttacccgggggaccggggtaacggggttaaacccgtaacgggtttaccggtaacccggttacccggtaacgggttaccgaaccgggtacccgtaaacgggtcccttacccgggccccgttaccggtacccttaccgttccgttcccggttaccccccg

SEQ ID NO: 2108 - DNA, 699 bp, Homo sapiens
  misc_feature: GYAE6OF01BIEB9.45.75.G09.1.454.CMB.1.raw
  modified_base (227)..(227): a, c, t, g, unknown or other
  misc_feature (227)..(227): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtnacgtttactgtttttaagatgtctctggtatcagcaaccaccaggacaaacgccccaaactcatctatttatgatgtactaataactccggtccctagtacgggtttctctactcgtcttcctcgtcggcctaccgaagtctgggacctaacgtacccggccctcccgtacgtaccctacttccgttcgttcgggtaccttaccgacggtacgttaggaaacggacggacgggtacctaggtaactttacgttacgtgaccgtacggacctaactaagtttaagttaacgtttaggttaccgtttacccgtacggttaccgggttacgtttaccggggacgggtaacgggtaaccgttaagggttaccggtacccggttaccgtaacgggttacgacccggtacccgtaaacggtccccgtcccggtaccccccggttcgtacccgtaccttccgttcccgttacccccccg

SEQ ID NO: 2109 - DNA, 575 bp, Homo sapiens
  misc_feature: GYAE6OF01DUO96.45.75.G09.1.454.CMB.1.raw
  modified_base (353)..(353): a, c, t, g, unknown or other
  misc_feature (353)..(353): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactccagcggtgacgttactgtttttaagatgtctctggtatcagcaacaccaggcaaacgcccccaaatcatcatttatgatgtacaatatccggcctacgtagggtttctcgatcgcttctctggctacaacgtntgacagtaccgcctcctgacctatctcgtcggcctccgaggtctagaagacgtaggctgtattagttactgcagcaactagtaattatttagtcgtttacctacggttcggttagttcggggcggtaagggacctaaggtcgaccgtccgtaggtacacgacccgaacggtccctaccggtccccccttacgggtaccctacgttccgtcccgttccccccg

SEQ ID NO: 2110 - DNA, 616 bp, Homo sapiens
  misc_feature: GYAE6OF01BFYF3.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttcctgttgctattttaaaaggtgtccagtctgaggagcagctggtggagtcgtgggggaggcgttggtccgaggcccgggggggtccctcgagacctctcgtgtgcagcctctggattcaccgtcagtggcagcttccgtgagcgtgggtccgccgaggctccgagggacgggcctgggagtcgggtctcgagtaattttgacaggcacgagcgtacacgcagtacttacggtaaggccattccactacttccagacactaacttccgaaggtaactacggttcgtttacgttagtaaacgtcgaaacctacccgtagaacgacccggaggaccgacggtactactacgttattacgtgtacgtacgaggacgactacccggaaacccgacggtaacccggaaagtaaacttaccaaactaaccgtaacgtaacggtagtacggaacggtcggtaaccgggg

SEQ ID NO: 2111 - DNA, 618 bp, Homo sapiens
  misc_feature: GYAE6OF01BEV7O.45.75.G09.1.454.CMB.1.raw
  modified_base (472)..(472): a, c, t, g, unknown or other
  misc_feature (472)..(472): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttggtccgaggccgggggggtccctcgagactctcgtgtgcagcctctggattcaccgtcgagtgcagtcttccgtgacgtcgtcgggtccgccgaggcctccgaggggaacggccgtggagtgggtctcgtagttaacttttagacgtaggcacgagtcgtactacgcgaagtactttaccggtaagggccgtattaccacctacttcctaccgagaacgtaactaacgttaccgaaggtaaccgtacggttnttttacgtagaaagtcgaaacctacccgtagaaccgacccgaaggaccaacggtctactattacttagtcgtagcgagacgacgtaccgaacccgaggaacccggaataaacttccaacgtaactacgtagtctaggtcgtacggg

SEQ ID NO: 2112 - DNA, 712 bp, Homo sapiens
  misc_feature: GYAE6OF01A6IJX.45.75.G09.1.454.CMB.1.raw
  modified_base (709)..(710): a, c, t, g, unknown or other
  misc_feature (709)..(710): n is a, c, g, or t
tcagacgcgatcgacacgaccggtgctcgatttagtatagacatcagggtccctcagactctcgtgtgcagcctctggattcaccgtcagtggcagcttcctgagctgggtccgccaggctccgagggaagggcctggagtgggtctcgagtaatttttagacaggcacagcgtactacgcagattccgttaagggccattccaccatctccagagacaattccgaggaaacctacggtgtttacttagaaatcgaacaccctaggacgacccgtaggaccacggactcgtaatatttactgtcgacgaagagtaactacgaacccaaggtaccccggaaaagtaaacttcctaaacaaacgttaccgtacggtaatacgggtaaccgttcgtacggggacctaaggggaacccctaacggtccgaaaccgtccttaccgtacaaggtcccctacggaccaaacggggtccccaagttccccgggttcttaccccccgtcggtacccgtaccccgtcccttaacccgaaacgtccggtaccaacccgttccggacgggtacccgacgtaacggcccggtacccgcgggtccgtacgcccgttgggtaccaacgggtacctacgttcccgtcggtacctcggacgtccgttcggaggtccgggacgttcggaccgacggtacggacctacgtacggacgtcgacatcggnngc

SEQ ID NO: 2113 - DNA, 801 bp, Homo sapiens
  misc_feature: GYAE6OF01DKEIC.45.75.G09.1.454.CMB.1.raw
  modified_base (229)..(229): a, c, t, g, unknown or other
  misc_feature (229)..(229): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtcctcctggacagtcgatcaccatcccctgcactggactccagcggtntacgttacttgtttttaagtatgttcctccttggtatcagtcaacaccctaggacctaaacgcccccaaatcactctatttatgtatcgtacaataacgtccggcccttcgtaacggggtttcctacgtacgttcccgtctttccgttcgttcgaccgttaccgtaaacggttcgtacgggtacctaaacgttacccggggtacccctttccccgtacggtaaccccttaacgttcccgtttaaccggttccgggggtaccccttacccggtaacggggtcccgtttaaacgggaaaccgggtaccgggtaacgggttaccgttaaggttaaccgttttaagtttaacccgttaggtaccctacggtacctaacgtaattttaacgttaaacgttttacggttccgtttaccgttaccggtttaccggggttaacgttaccggggacgggtaacggtacccgtaaggttacccggtacccgttaccggtacgggttacaccgggtacccgaacggtcccgtaccggtcccccgttacggtaccctaccgtttccgtccccgtttaccccccg

SEQ ID NO: 2114 - DNA, 599 bp, Homo sapiens
  misc_feature: GYAE6OF01AN0EX.45.75.G09.1.454.CMB.1.raw
tcagacgcgatcgacacgaccggtgctcgatttagtatagacatcaggggctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccgaggccgggggggtcctcgagactctcgtgtgcagcctcgtggacttcaccgtcagtggcagcttcctgagcgtgggtcccgccgaggcctaccgaggggaacggccgtgggacggtgggtctcgtaagttaattttaggacaggcacgagcgtactacgcagacgttccggtaaggccgtattccacctatcctacacgagactaacttaccgaagaacgtacggttcgtttactagaaatcgaacctaccgtagaacgacccgaggacacggactactaatctacgtgtcgacgagagactaccgaacccgaggaacccgtaagaacgttcaacgtaactaactacgggtactaggtaccgtcgtcggggaaacccg

SEQ ID NO: 2115 - DNA, 702 bp, Homo sapiens
  misc_feature: GYAE6OF01CEZ3U.45.75.G09.1.454.CMB.1.raw
  modified_base (312)..(312): a, c, t, g, unknown or other
  misc_feature (312)..(312): n is a, c, g, or t
  modified_base (696)..(696): a, c, t, g, unknown or other
  misc_feature (696)..(696): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccgagggaggcctggagtgggtctcagttaattttagacaggcacagcgtactacgcagacttccgttaagggccgtattcaccatcctaccaggacgactaattccgaaggaacctacgggttgttttccgttagaaacttcgaaacctacccgtggaacgacccgaggaccacggctctatattacgngtgcgagagctaccgaaccgaggacccgaataacttcaacactacgtacggtatcggacgtcgtacggggaccaacggggccacggtcacccgtctcctacgacgtcctaccgaccgaacgggtccccagttcccggtcccttcccccgtacggtccctaccccgttacccgtacccgaacgtaccgtaccgtacccgtcggtacggggaccaccggacggtcccggtacccgtcggggtccgtcggtaccccgttagggtaccgaacgggttaccttaacccgttccgtaccggtacgttcccggtccggttaccgtacggaccgggtccgggtaccgtacgggaccgtaacgggcccgacgtacgtacgcgacgtcacgcgngcgtcg

SEQ ID NO: 2116 - DNA, 641 bp, Homo sapiens
  misc_feature: GYAE6OF01C2C0Q.45.75.G09.1.454.CMB.1.raw
  modified_base (270)..(270): a, c, t, g, unknown or other
  misc_feature (270)..(270): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccgaggccggggggtccctcagactctcgtgtgcagcctcgtggattcaccgtnagtggcagcttcctgagcgtgggtcccgcgaggcctccgaggggacgggccgtgggaggtgggtctcgtagttaattttagacaggcacagcgtactacgcagtacttaccggtaaggccgtattcacctatcctccagacgtactaacttaccgaaggaactacggttcgtttacgtagaactcgaacctaccctagacgacccgaggaccacggactacgtaattacgttactgtacgacgaagagtacgtacccgaacccgaacggaaccccggtaaagtaaacttacctaaaccgtaaccgttaaccgttaacgggtacgttacgggtaccggttacggacgggggacccgaaaggggtaacccccg

SEQ ID NO: 2117 - DNA, 756 bp, Homo sapiens
  misc_feature: GYAE6OF01CAZIJ.45.75.G09.1.454.CMB.1.raw
  modified_base (223)..(223): a, c, t, g, unknown or other
  misc_feature (223)..(223): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatcctcctgcacgtggaaccngcagtgagttggttagggatttactaaccgttgtcctccgtacggtaaccaacgacgaccaacccgaacggaccaaaaccgaccccccaaaactccaagttacgtaatttagacggacggacgaaggtaacggccggtacccgttacggttacgggtttactaacgttccgtacttcgtcgtcggtcctacgtaacgtcgtacggaccaaccgtaccggtccctccgtacgaactaacgtccgtacgtcgggtacctaccggaggtaccgtagggaacggtacggtaggttacgtaacggttaatttaaccgttacgtcgtccgtcgtacgtactagttacgtacggtaccggttaagggttacggtttaacgggtttacggtttcgggttacgggttaccggggaccggggtaaccgggtaaccgtaacggtccggttaccggtacccgttaaccggtacggtaccgaccggacccggtaacggtccccgtcccgtaccccgttacggccttacccggttcccgttaccccg

SEQ ID NO: 2118 - DNA, 702 bp, Homo sapiens
  misc_feature: GYAE6OF01D82QK.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtcgtgggtctcctggacagtcgatcaccatcccctgcactggactccagcggtgtacgttacttgtttttaagtatcgtctcgttggtatcagcaacaccaggacaaacgccccaaactcatctatttatgatgtacaataatccggcctcgtcgggtttctctatcgtcttctcgtggactcaagtctacgactaacgtcggccctcccgtcgacctactccgttcgtacgggtcctaccgaggtccgtagggaaacggtacggaacggtcgttagtaacttttacgttactcgtacgaaccgtactaactaattaagtttaagtttaagtttaccgttttaccgtacggtttacggggttacgttacggggaccgggtaacgggtaaccgttacggttacggtaacccggttaccggttaacgggttaccgaaccgggtaccccgtaaacggggtcccgttaccccggttcccccggttacccgggttaccctaacccgtttcccgttccccggtttaccccccc

SEQ ID NO: 2119 - DNA, 594 bp, Homo sapiens
  misc_feature: GYAE6OF01AW6GN.45.75.G09.1.454.CMB.1.raw
  modified_base (293)..(293): a, c, t, g, unknown or other
  misc_feature (293)..(293): n is a, c, g, or t
  modified_base (442)..(442): a, c, t, g, unknown or other
  misc_feature (442)..(442): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccagccgggggggtccctcagactctcgtgtgcagcctctggattcaccgtcagtggcagcttcctgagctgggtccnccaggctccgagggaacggcctggagtgggtctcgagttattttagacaggcacgagcgtactacgcagacttccgtaagggccgtattccaccatcctaccagagaccaattccgaaggaacctacggttgtttctagaaatgaaccncctagacgtacccgaggacacggctactactattacgtgtagacgagacgactaccgaacccaggaacccggaaagtaaacttcgaaactaacttaaccgtacggttagtacgggtaccgttacggacggggaccgaacggggtaacccccg

SEQ ID NO: 2120 - DNA, 682 bp, Homo sapiens
  misc_feature: GYAE6OF01AK5WB.45.75.G09.1.454.CMB.1.raw
tcagacgcgatcgacacgaccggtgctcgatttagtatagacatcagggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggactcccgaggcggtgtacgtttacgtttgtttttaagtattcgtccttccgtggtatcgagccaaaccacccgaggacaaaccgaccccccaaactcatcctaatttatgatgtacaataacgtccggccctcgtagggtttctcatcgcttctcgtcggcctacgaagtctggactagtaccggcccttcccgtgaccctattcgtccgtcgggcctaccgaggtctaggaagaccggagtccgttagtactttagttacgtcgtacacgcactattaagtttagttacgtttcgtttaccctaccggttcgggttacgttccgggaccgggtaacgggtaccgtaacggttccggaacccggttaccgtacgggtaccgaacccggccccggtaacgggtccccgttcccggtacccccccggttacggttaccctacccgttcccgttcccggttcccccccgg

SEQ ID NO: 2121 - DNA, 552 bp, Homo sapiens
  misc_feature: GYAE6OF01A5UTD.45.75.G09.1.454.CMB.1.raw
  modified_base (296)..(296): a, c, t, g, unknown or other
  misc_feature (296)..(296): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctctggtatcagcaacacccaggcaaacgcccccaaactcatcatttangatgtacaataatccggccctcgtaggggtttctcatcgtcttctctggctcaagtctggcaagtaccggcctccctgacctatctcgtcggctccgaggctagaagacgagctagattattactgcagcactatatattagttcgtttacctacgttcggttagttcgggacggtacggacctaagttcgaccgttcgtacggtcacggcccaacggtcctccgtccccgttcgacctactccgtcgttaccccc

SEQ ID NO: 2122 - DNA, 778 bp, Homo sapiens
  misc_feature: GYAE6OF01CMNAJ.45.75.G09.1.454.CMB.1.raw
  modified_base (265)..(265): a, c, t, g, unknown or other
  misc_feature (265)..(265): n is a, c, g, or t
  modified_base (309)..(309): a, c, t, g, unknown or other
  misc_feature (309)..(309): n is a, c, g, or t
tcagacgcgatcgacacgaccggtgctcgatttagtatagacatcaggggctgggagaggagcccagcactgggattccgaggtgtttccattcagtgatctgcactgaacacagaggactcgccatggagtttggctgagcttgggttttccttgttgtcttaattttaaaaggtcgtccagtctggaggagcagcgtgggtggagtcgtgggggaggtcgttggccgacgggccggggggtccctcgagactcgtcgtgtgcngcctcgtggacttcaccgtcaggtcggcacgtccttccgtaggngtcgtcggtcggtccccgccgacggtcctaccggagggtaacgggccgtgggacggttgggtctacgtagtttaagttttacgacgaggtacaacgtacgacgttactacgcgtagtaaccgtttacggtaacgggacctacgttaccacctacgtccctacgaaggtaccgtaactaacggttacccgaaaggtaccgttaacgggtttcgttttacgaacgttaaacgtcgaaacccttacccgtacggaaccggaaccccggtaggtaacccgaaccggttccttaacgttaacttaaccgtttacgtcggtacgaaccggaggtaacgacccgtaacccggaaaccccggtaaacggggaaacccccggttaaaattaacccgtttaacccgaaaccttaaaaccggttaacccggttaacgggttaagttaccggggaaccgggttcgggtaaaccccgggggg

SEQ ID NO: 2123 - DNA, 594 bp, Homo sapiens
  misc_feature: GYAE6OF01BZTH9.45.75.G09.1.454.CMB.1.raw
  modified_base (265)..(265): a, c, t, g, unknown or other
  misc_feature (265)..(265): n is a, c, g, or t
  modified_base (443)..(443): a, c, t, g, unknown or other
  misc_feature (443)..(443): n is a, c, g, or t
  modified_base (576)..(576): a, c, t, g, unknown or other
  misc_feature (576)..(576): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagatgtctcctggtatcagcaacncccagcaagccccaatcatcatttatgatgtactaataactcggccctgtacgggtttctcatcgtcttctctggctccaagtctggacaacgtaccggcctccctgacctagtcctcgtcgggtccttcccgaggtacctaggaacgtacggtaggtcttaggtatttacgttaccngtaccaggcctaactataattagtttagtcgtttacccgtacgtttcggttacgttccgggacggtagggtaacctaggttcgaacccgtccgtaggtccacgcccgaagtccctccgtccccgtcggtaccncgttcctcggttcccccg

SEQ ID NO: 2124 - DNA, 600 bp, Homo sapiens
  misc_feature: GYAE6OF01EDWML.45.75.G09.1.454.CMB.1.raw
  modified_base (525)..(525): a, c, t, g, unknown or other
  misc_feature (525)..(525): n is a, c, g, or t
  modified_base (528)..(528): a, c, t, g, unknown or other
  misc_feature (528)..(528): n is a, c, g, or t
  modified_base (533)..(533): a, c, t, g, unknown or other
  misc_feature (533)..(533): n is a, c, g, or t
  modified_base (536)..(536): a, c, t, g, unknown or other
  misc_feature (536)..(536): n is a, c, g, or t
  modified_base (542)..(542): a, c, t, g, unknown or other
  misc_feature (542)..(542): n is a, c, g, or t
  modified_base (544)..(544): a, c, t, g, unknown or other
  misc_feature (544)..(544): n is a, c, g, or t
  modified_base (549)..(549): a, c, t, g, unknown or other
  misc_feature (549)..(549): n is a, c, g, or t
  modified_base (552)..(552): a, c, t, g, unknown or other
  misc_feature (552)..(552): n is a, c, g, or t
  modified_base (556)..(556): a, c, t, g, unknown or other
  misc_feature (556)..(556): n is a, c, g, or t
  modified_base (561)..(561): a, c, t, g, unknown or other
  misc_feature (561)..(561): n is a, c, g, or t
  modified_base (565)..(566): a, c, t, g, unknown or other
  misc_feature (565)..(566): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (576)..(577): a, c, t, g, unknown or other
  misc_feature (576)..(577): n is a, c, g, or t
  modified_base (581)..(581): a, c, t, g, unknown or other
  misc_feature (581)..(581): n is a, c, g, or t
  modified_base (584)..(584): a, c, t, g, unknown or other
  misc_feature (584)..(584): n is a, c, g, or t
  modified_base (594)..(595): a, c, t, g, unknown or other
  misc_feature (594)..(595): n is a, c, g, or t
  modified_base (597)..(597): a, c, t, g, unknown or other
  misc_feature (597)..(597): n is a, c, g, or t
tcagacgcgatcgacacgaccggtgctcgatttagtatagacatcagggggaagaccgaagggcctggagtgggtctcagtaatttttagtacaggcacagcgtactacgcagattccgttaagggccgattcaccatctccagagacaattccaggaacacggtgtttctgaaatgaacaccctgagacccgaggacacggctctatacttactgtgcgagagatccgaacccaggacccggaagaacttcaacaactactacggtatggacgtcgtggggccgaacggaccaccgtacgaccgtctcctcgacgcctaccaccgaacggcctacgtccggttcccttcccgtcggcccacccgtcctaccgaacgacgcctaccgtcggtacggggacacgacggacggccgtcgggctcggccgtcggtacgaacggtacctaccgttccgtacgtacgtccgtcgttacgtacggacgggtccgggtaccgtacggaccggaacggcgacgtaacgtacgngcngcgcncgntcgacngntacgncgntcgngactnacgnngtcncgcncnncgancgnacgcgacagnngngcg

SEQ ID NO: 2125 - DNA, 760 bp, Homo sapiens
  misc_feature: GYAE6OF01BJU29.45.75.G09.1.454.CMB.1.raw
  modified_base (323)..(323): a, c, t, g, unknown or other
  misc_feature (323)..(323): n is a, c, g, or t
tcagacgcgatcgacacgaccggtgctcgatttagtatagacatcaggggctgggagaggagcccagcactgggattccgaggtgtttccattcagtgatctgcactgaacacagaggactcgccatggagtttgggctgagctgggttttccttgttgcttattttaaaaggtgtccagtctgaggagcagcgtggtggagtcggtgggggaggtcgttgggtccgacggggcccgggggggttcccctcgacggtacctccgtcgtggtcgcgacgtccgtcgtggtacttccaccgtcgaggtggccacgtcctttccgnggacggtcgtcgggtcccgccgacggccgtccggaaggggtacggccgtgggacggtggtctacgtaagtttaagttttacgtacgtaggactacgacgtccgtaactacgactaacgtacgttaccggttaacgggaccgtaacttaccgactactccgtaccaaggaacgaactaacgttacccgaaggtaaccgtacggttacgtttacgtacgtaaagtccgtaaacccgtacccgtacgaaccgggaaccccggtaacgaacgtaccggtacttacgtaacgttaaccgttacttcgggagtacgaacggtacgaaaccgtaacccggaaacccggtacggaaacccgggtaaagtaaaccttaaccgtaaacccgtaaagtacgttaaccgggttacaacgggttaaccgtcgggtaccggggaaacccgg

SEQ ID NO: 2126 - DNA, 688 bp, Homo sapiens
  misc_feature: GYAE6OF01BIAOE.45.75.G09.1.454.CMB.1.raw
  modified_base (588)..(588): a, c, t, g, unknown or other
  misc_feature (588)..(588): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggtagtttgggctgagtcttgggttttccttgttgtcttaagttttaaaaggtgtccagtctgaggagcagcgtggtggagtcggtgggggagtcgttggtccgagggcccggggggtcctcgagactcgtcgtgtgcacgcctcgtggacttcgaccgtcgaggtggctacgtcttaccgtgacggccggtcgggtccccgccgtacggccgtaccggaagggggacggccgtagggaggtcgggtacctacgttaagtttaagttttacgacgtagacgaacgtagtacgtactacgacagtacgttaccggtaaggtctacgttaccacgtactcgtacgagactaactaacgtaccgaaggtacgttacggttcgtttaacgtagaaacttcggaaccctaccgtacggaaccggtaaccgaggtaccgaccgttctactacgttagttacgtggacgngatacgtacgaccgaaacccgtacggaaccggtaataaccttacgtaacctaacgtacgtacgttacgacggtaccgtgaccgggaccgaacggtacccg

SEQ ID NO: 2127 - DNA, 623 bp, Homo sapiens
  misc_feature: GYAE6OF01BDYE0.45.75.G09.1.454.CMB.1.raw
  modified_base (237)..(237): a, c, t, g, unknown or other
  misc_feature (237)..(237): n is a, c, g, or t
  modified_base (315)..(315): a, c, t, g, unknown or other
  misc_feature (315)..(315): n is a, c, g, or t
  modified_base (614)..(614): a, c, t, g, unknown or other
  misc_feature (614)..(614): n is a, c, g, or t
  modified_base (616)..(616): a, c, t, g, unknown or other
  misc_feature (616)..(616): n is a, c, g, or t
  modified_base (618)..(620): a, c, t, g, unknown or other
  misc_feature (618)..(620): n is a, c, g, or t
  modified_base (622)..(623): a, c, t, g, unknown or other
  misc_feature (622)..(623): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagtacaggcacagcgtactacgcagattccgttaagggccgattcaccatctccagagacaattccaggaacacggtntttcttgaaatgaacacctgacgacccgaggacacggctctatattactgtgcgagagatccgaaccagacccggaanaaattcaacaactactacggtatggacgtcgtggggccaaggggacccaccgtcaccgtctcctcgacgcctaccgaaccgaacgggcccctagtccggttccctttcccccgtcggccctacccctcctacccgaacgacgcctacccgtcggtcggggaccacgacggcccggtcccgtggggcctcggcccgtcgggtaccgaaggtaccttacccgtttcccgtccgtacgttccggccgttcgtcggacggtccggggtcgtcgggccgtaaggggcccgtacgaacgtacggncngnnngnn

SEQ ID NO: 2128 - DNA, 662 bp, Homo sapiens
  misc_feature: GYAE6OF01AYRH0.45.75.G09.1.454.CMB.1.raw
  modified_base (291)..(291): a, c, t, g, unknown or other
  misc_feature (291)..(291): n is a, c, g, or t
  modified_base (301)..(301): a, c, t, g, unknown or other
  misc_feature (301)..(301): n is a, c, g, or t
  modified_base (333)..(333): a, c, t, g, unknown or other
  misc_feature (333)..(333): n is a, c, g, or t
  modified_base (445)..(445): a, c, t, g, unknown or other
  misc_feature (445)..(445): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtggggggaggcttgggtccaggccgggggggtccctcagactctcgtgtgcagcctctggattcaccgtcagtgcagcttctgngctgggtccncgaggctccgagggacggcctggagtgggtcnctagttaattttagacaggcacagtcgtactacgcagtacttccggttaaaggccgtaattccaacctatacctccgaagagaacctaacttccgaaggtaactacgggttntttacgttagaaattcgaactaaccctaggaccgaacccggtaacggaaccaccgggtaccttaccgttaacgttaactttaccgtaggtcgaccgggaagtacggtaacgttacccggaaacccgaacggaaacccccgggtaaaagtaaacccgtttaactaaaccgtaaccgttaaccgttaacgggtactaaccggggtcggttaacccgggg

SEQ ID NO: 2129 - DNA, 665 bp, Homo sapiens
  misc_feature: GYAE6OF01AJJ4V.45.75.G09.1.454.CMB.1.raw
  modified_base (192)..(192): a, c, t, g, unknown or other
  misc_feature (192)..(192): n is a, c, g, or t
  modified_base (223)..(223): a, c, t, g, unknown or other
  misc_feature (223)..(223): n is a, c, g, or t
  modified_base (247)..(247): a, c, t, g, unknown or other
  misc_feature (247)..(247): n is a, c, g, or t
  modified_base (299)..(299): a, c, t, g, unknown or other
  misc_feature (299)..(299): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacnggcgatcaccatcctcctgccactggaaccngtcagtgtacgttgtattatactntgtctcctgtaccaacaacaccagacaaacgccccaaactcatgtatttagnatgtacagttaacgtccggtccctcgtaggggtttctaggtacttcgtcttctcgtcggccttacgaacgtcgtacggaccaaccgtaccggtccctacccgtcgaccctacttccgtcgtcgggtccttccgacgggtccgtagggaacggtaccggaagggtccttaggtaactttaacgttaccgttcgaccacggtctaccgtattacggtcgacctacggactaacgctaagttcgacgttacgttacgttacgggttccgggaccgggaacgggaacccgtagggtacctccgggtaccccgttacggttacggtacccgaacggaccccgtaacggtccccgtacccggtcccccccgg

SEQ ID NO: 2130 - DNA, 717 bp, Homo sapiens
  misc_feature: GYAE6OF01D15A7.45.75.G09.1.454.CMB.1.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactccctgcactggactccagcggtgtacgttacttgtttttaagatgtctctggtactcagcaacaccaggacaaacgccccaaactcatcatttatgatgtactaataactccggcccttacgtacgggtttctactactcgtccttctcgtcggcctacaacgttcgtacggtacctaacgtacccggccccttacccgtaccggaccctacgttccgtccggttcgggtcctacccgacggcgttacggaaacgacggaggtacttacggtacttttaacgttacgtacgtacgtaacgtaccgtaactaattaacgttaagtttacggtttaccgttttacccgtacggtttaccgggttacgttacggggtaccgggtaacgggttaacccgtaaaggtttccgtacccgttaccggtacggttaccgaaccgggtcccgaaacgggtcccgtacccggtccccccgttaccggttaccctcccgttccccgttcccggttaccccccc

SEQ ID NO: 2131 - DNA, 677 bp, Homo sapiens
  misc_feature: GYAE6OF01BD8H8.45.75.G09.1.454.CMB.1.raw
  modified_base (267)..(267): a, c, t, g, unknown or other
  misc_feature (267)..(267): n is a, c, g, or t
  modified_base (333)..(333): a, c, t, g, unknown or other
  misc_feature (333)..(333): n is a, c, g, or t
  modified_base (462)..(462): a, c, t, g, unknown or other
  misc_feature (462)..(462): n is a, c, g, or t
tcagacgcgatcgacacgaccggtgctcgatttagtatagacatcgagggggctggggtctcaggaggcagcgctcgtcgggacgtctccaccatggcctgggctctgctattcctcaccctcctcactcgagggcacacgggtcctgggcccagtctcgccctgactcacgcctgccctccctgtcgtcggtctccgtggactagtcgactcaccactccccgtgcacgtgactccgagcggtagtacgtttattagttttaagtntcgtctcgtgtactcgagacaaccaccgaggaaccaaaccgaccccaaatctactctaagtttagntatctaactaaacgtccgtccggtccgttacggttacggttcacgtactccgtcttcctcggtcgtctacgacgttcgtaggtacctaacgtccgtaccctacgtcacctagtcctggtccgcctacgngtacgaggaactcggtaaggtcttaggtacttacgtacgactagacgtacctaagttagttaacgtttacttacgggtttaccttaccggtacgggtttaccgttgggtacccgggagggtaaccgtaaccggttacgtaccggtaccgttaccggaggttaccaccgggacccgtacgtcccgacccggttacctcgttacgtcccgttccccg

SEQ ID NO: 2132 - DNA, 810 bp, Homo sapiens
  misc_feature: GYAE6OF01CHYE7.45.75.G09.1.454.CMB.1.raw
  modified_base (228)..(228): a, c, t, g, unknown or other
  misc_feature (228)..(228): n is a, c, g, or t
  modified_base (298)..(298): a, c, t, g, unknown or other
  misc_feature (298)..(298): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccactcccctgcactggatccagcggtnacgttacttgttttaagatgtctctggtatcagcaacaccaggaccaaacgaccccaatcatctatttangatcgactaactacgtccggtccttacggtaacgggtttctacgtacgttccgtctttccgtcgtcggtcctaccgtaagttcgtacggactaaaccgttcccggtccctacccgtacgtaccctattccgtacgttccggtcctaccgacggacgttacggaacggtaccggacgttacgtacggttaactttaacgttaccgttacgacgacgtacgtaactaactttaagttacgtttaacggtttccgtttaacccggttaccggtttaccggggtttaacggtttacccggggtacgggtaaccgggtaaacccgggttaaccggtttacccgggttaaacccgggttacccgggtttaaccgggttacccggttaaaccccgggtacccccgggttaaaccgggtccccggttacccccgggttacccccccgggtttacccgggtttaccccgttaaaccccggtttccccgggttttaacccccgggttttacccccccccggg

SEQ ID NO: 2133 - DNA, 634 bp, Homo sapiens
  misc_feature: GYAE6OF01ECG8W.45.75.G09.1.454.CMB.1.raw
  modified_base (300)..(300): a, c, t, g, unknown or other
  misc_feature (300)..(300): n is a, c, g, or t
  modified_base (488)..(488): a, c, t, g, unknown or other
  misc_feature (488)..(488): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccgtgtcgtgggtcctccgtggacaggcgatcaccatcctcctgcactggaaccagcagtgacgttgttattataactatgtctctgtaaccaacaacaccagacaaacgccccaaatcatgtatttanagtatgtacaagtaacgtccggtccctgtagggtttctgtactcgtcttctcgtcggtcctacgtaacgtcgtacgaccaaccgtacccggtcccttacccgtagaacctaacttccgtacggtcggtaccctccgaagggtctagggacgggacgaggtctagtactttagtactcgtctagtctanatagtcgacgtaggtagttagttacgtttgggtacggttcggggacggtaacgggacctacggccgttacggtaccgttacggtacggtacgaccggtacccgaacggtccgtaccccggaccccggttcggtcctccgttacccg

SEQ ID NO: 2134 - DNA, 650 bp, Homo sapiens
  misc_feature: GYAE6OF01BA62C.45.75.G09.1.454.CMB.1.raw
  modified_base (190)..(190): a, c, t, g, unknown or other
  misc_feature (190)..(190): n is a, c, g, or t
  modified_base (304)..(304): a, c, t, g, unknown or other
  misc_feature (304)..(304): n is a, c, g, or t
  modified_base (336)..(336): a, c, t, g, unknown or other
  misc_feature (336)..(336): n is a, c, g, or t
  modified_base (411)..(411): a, c, t, g, unknown or other
  misc_feature (411)..(411): n is a, c, g, or t
  modified_base (446)..(446): a, c, t, g, unknown or other
  misc_feature (446)..(446): n is a, c, g, or t
  modified_base (565)..(565): a, c, t, g, unknown or other
  misc_feature (565)..(565): n is a, c, g, or t
  modified_base (573)..(573): a, c, t, g, unknown or other
  misc_feature (573)..(573): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttggctgagctggttttccttgttgctattttaaaaggtgtccagtctgaggancagctggtggagtcgtgggggaggtcgttggtccagggcccggggggtccctcgacgtacgtctcggtgtgcagcctcgtggtacttccgaccgtcagtcggccagtcttccgngacgtcggtcggtcccgccgaggcctaccggnggggaacgggccgtgggagtcggggttctacgtaggttaatttttaggacgaggcaacgtacgacgttacaacgntaacgtacgttaccggtaacggccgtatccaaccnctccgtacaagacgaataactaccgaaggtaaccgtacggttctttacgtacgtaaagtacgtaaccctaccgttacgaacgacccgaacgacaccggctacgtattattacgagtagngtaagtanaacgaccgaaccgaacgaacccggaaagttaaacctacgtaaaccctagtaaccgtacgtacgtggtccgttacggg

SEQ ID NO: 2135 - DNA, 742 bp, Homo sapiens
  misc_feature: GYAE6OF01C61NG.45.75.G09.1.454.CMB.1.raw
  modified_base (348)..(348): a, c, t, g, unknown or other
  misc_feature (348)..(348): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctcgccctgactcacgcctcgcctcctgtctcgggtcctcctggacagtcgactccacactccctgccacgtgactccgaggcggtacgtacgtttacttaggttttaacgacgttcgttccttccgtaggtactcgacgtaccaaaccgtaccgacgaacctaaaccgacccctaaaactcctaacttctaatttanagtactacgtaacaagttaccgtccggtccgttacggtacgggtttcctactacgtccgtacttcgttacgtcggtacctacgacgttacgcggtacctaaccgtacccggtcccttaccgacgtaaccttcgtaccgttcgggtcgaccgtcggacgtacgacggtaacggtacggtacgtaccgttaagttacgtttacttaccgcgtacaacggtcctaactactttaacgtttaacgtttcggttaacctttcggtaaccggttaggttacggtaccgggggtagtaaccggtacgttacggttaccgtacgtaccggtacgcggtaccgaccggtacgtcccgtacccgtcccggttacgtaccttaccgtccgttaccggttcccccg

SEQ ID NO: 2136 - DNA, 745 bp, Homo sapiens
  misc_feature: GYAE6OF01DP4AQ.45.75.G09.1.454.CMB.1.raw
  modified_base (252)..(252): a, c, t, g, unknown or other
  misc_feature (252)..(252): n is a, c, g, or t
  modified_base (737)..(737): a, c, t, g, unknown or other
  misc_feature (737)..(737): n is a, c, g, or t
  modified_base (739)..(745): a, c, t, g, unknown or other
  misc_feature (739)..(745): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccgagggagggcctggagtgggtctcagttaatttttagacaggcacagcgtactacgcagattccgttaagggccattcaccatctccagagacaattccaggaacacggttgtttctagaaatgaacnccctgacgacccgaggaccacggctactatattactgtcgcgagagactaccgaaacccaggaacccggaataaacttctaacaactacgtacggtagtacgggtaccgtcgtacggggacccaaacgggggtaccccaaccggttcctaaccccggttccttaccccgtacaaccggccccttacccgaacccggtaaaccggggccccctaagtttccccggggtttcccctttaccccccgtaccgggtaccccctaccccccgttaccccgttaccccgaaaccggtaccgtaccctaacccggtccgggtaccgggggacccaacccggaccgggccccgggtaccccggttcggggtcccgttaccggtcccggttacgggtaaccgtaaccgggtacctttacccgttacccgtccgtacgttccggtccgtcgtcggacggtccgggtcgtcgggacgtacgggcgtacgagtacgngnnnnnnn

SEQ ID NO: 2137 - DNA, 685 bp, Homo sapiens
  misc_feature: GYAE6OF01BXVJ8.45.75.G09.1.454.CMB.1.raw
  modified_base (309)..(309): a, c, t, g, unknown or other
  misc_feature (309)..(309): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctctggacagtcgatcaccatcccctgcactggactccagcggtgtacgtttacttgtttttaagtatgtctccgtggtatcagaccaacacccaggacaaacgacccccaaactcatctatttangtatgtacaataacgtcggccctggtacgggtttctcacgtcgtcttcgtcgtcggctaccgaagtcgtacggactaacgtcccgtcctcccgtacgaccctatccgtacggtacggtcctaccgaacggtcgtaacgggaaacggtacggacggtacgttattaacgtttaacgttaccgtacgtacgtaacgtactaactaacttaattacgttttacgttacgtttaccgtacggttagggttacggtacgggtacggaacggtaccgtaggttaccgtaccggttaccgtacgggtaccaacggtcccggtaacggtcccgtacccggtccccgttacggtacccgtacccttccgttccccgttacccccg

SEQ ID NO: 2138 - DNA, 699 bp, Homo sapiens
  misc_feature: GYAE6OF01DLJ19.45.75.G09.1.454.CMB.1.raw
  modified_base (260)..(260): a, c, t, g, unknown or other
  misc_feature (260)..(260): n is a, c, g, or t
  modified_base (273)..(273): a, c, t, g, unknown or other
  misc_feature (273)..(273): n is a, c, g, or t
tcagacgcgatcgacacgaccggtgctcgatttagtatagacatcagggggctgggggtctcaggaggcagcgctctcgggacgtctccaccatggcctgggctctgctattcctcaccctcctcactcagggcacgagggtcctgggcccagtctgccctgactcagcctgcctcctgtctgggtctccgtggacagtcgatcaccactccctgcactggactccgaggcggtgtacgtttacttagttttaagtagtntcttcgtggtacncacgcaacaccgagaccaacgaccccaactcatctatttactgtatcgtacaagtactcggtcctacggttagggttctagtacttcgtcttcgtgtcgactacgtaacgtcgtacggaccaaaccgtcccggtacccttcccgtacggaacccttcgtccgttaccggtcgggtacctaccggtaaggtccggtaacggaacgggtaacggacggttcgttacggttaactttacgttaccgtcgtacgtactcgttactaactacggtacgaccgtaccgacgacggactacggtacgttaccgttaacggtacggttcgggtaccggggacgggtaacgggtaacccgttacggacccgttcccgtaacccgggttaccggtaacccggttacccgaacccggtaccgtcccgggtaccccgg

SEQ ID NO: 2139 - DNA, 695 bp, Homo sapiens
  misc_feature: GYAE6OF01EQZZI.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggtcgttggtccgagggcccgggggggtccctcgacgactcgtcgtgtgcacgcctctggacttccaccgtcaggtggcagtccgttcctgacggtcgtcggggtcccgccgaggccgtaccggaggggaacgggtccgtggagtcgggtctacgtagttaagttttagacgacggacaacgacggtacgtacgtacgactagtaccgtttaccggttaacgggacctacgttaccacctactcctaccgagacgtaacctaacgttaccgaacggtaacgttaccggttgtttacgttaacgaagttacgaaccctaccgtagaaccggaccgacggaccgaccggctaacgttattacgttacgtgtacgcggtaacgtacgaaccgtaccgaaaccccgtaacggaacccggtaaaagtaaacttacccgtaaaccgtaaccgttaacgtaacggttagtcggtaaccggtaccgggg

SEQ ID NO: 2140 - DNA, 617 bp, Homo sapiens
  misc_feature: GYAE6OF01AHWJ2.45.75.G09.1.454.CMB.1.raw
  modified_base (394)..(394): a, c, t, g, unknown or other
  misc_feature (394)..(394): n is a, c, g, or t
  modified_base (608)..(608): a, c, t, g, unknown or other
  misc_feature (608)..(608): n is a, c, g, or t
  modified_base (615)..(615): a, c, t, g, unknown or other
  misc_feature (615)..(615): n is a, c, g, or t
  modified_base (617)..(617): a, c, t, g, unknown or other
  misc_feature (617)..(617): n is a, c, g, or t
tcagacgcgatcgacacgaccggtgctcgatttagtatagacatcaggggtccctcagactctcgtgtgcagcctctggattcaccgtcagtggcagcttcctgagctggggtccgccaggctccgagggagggcctggagtgggtctcagttaatttttagtacaggcacagcgtactacgcaagattccggttaagggccgtattcaccatctccagacgacaattccaggaactacggtgtttcttagaatcgaacacctggacgaccgaggacacggctcgtatacttactgtgcgagagtctaccgaaccgaggacccggaaagtaattcaacaactacgtacggtagtcggacgtcgtgggaccaaggacctacgcaccgtctcctcncgcctaccacgaacgggcctacgtccggtcccttccccgcggcccaccctccgtaccaacgcgcctaccgtacggtcggggaccacggcggcccggccgtcgggtcctcgccgtacggtcgaacgccgttactccgtacgagttcccgtcgttaccgtggacggtccgggacggtcgggtaccggacgggacggtccacggtagcgagccgtanaccgtgngn

SEQ ID NO: 2141 - DNA, 785 bp, Homo sapiens
  misc_feature: GYAE6OF01DHINZ.45.75.G09.1.454.CMB.1.raw
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctgggtctccgtggacagtcgatccaccactcccctgcacgtggactccgagcggtgtacgtttactttagtttttaagtatcgttccttccgttaggtactcacgactaaaccacccgaacggaccaaaccgaccccctaaactactactacttaagtttatagtatacgtaactaaacgttaaccggttacccggtacccgttaccggtttaacggggttttccttaccgtaaccgtttcccgttacctttccgttacggttcggtacccttaacccgtaacgttcgtacggtaacctaaaccgtacccgtccccttacccgtacgtaccctacttccgttcggtccggtcctaccggtacgtcgtaacggaacggtacggtacgtacgttagttaactttacgttacgtcgacacgtactaacttattacttaagtttcgtttaccgtttacgttacggttcgggttacgttaccggggacgggtaacggtaaccgttaggttacccgttccggttaccggtaacggtaccggaccggacccggtacggtaccgtccccgttacccgttccgtacccttaccgttcccgttacccgttaccccccg

SEQ ID NO: 2142 - DNA, 821 bp, Homo sapiens
  misc_feature: GYAE6OF01CKYFP.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgcttattttaaaaggtgtccagtctgaggagcagctggtggagtcgtgggggagcgttggtccgaggcccgggggggtccctcgagactcgtcgtgtgcagcctcgtggacttccaccgtcaggtcggcagtccttcctggacgtcgtcgggtacccgccgaggtccgtaccggaggggtaacgggcccgtagggacggttcggggtacctacgtaagttttaaacgttttttaacggaacgtaaggtacctaacgaacggtccgttaaccgtacggacgtaacgtacgtttacccgggttaaacgggtcccgttaacgtttacccgacctaacgttcccgttaacccgaagtaaccgtaaacctaaacgtttccgaaacgggtaaaccgttaccgggtttagttttaccgttaaggtaaaaccttcggaaaacccctaaccccgtaggaaacccggaaccccggaacggaacccgtacggtccctttaaccgttaaacgtttaacgtttaacgtcggttaacggaccggtaacgtaacggaaccgttacccgaaaaccccggtaacggaaaccccgggtaaaagtaaacctttaccgtaaacccgtaaaccgttaccggttaaacggttaacggttacgggtaaccggtaacccgggg

SEQ ID NO: 2143 - DNA, 795 bp, Homo sapiens
  misc_feature: GYAE6OF01ERE6A.45.75.G09.1.454.CMB.1.raw
  modified_base (206)..(206): a, c, t, g, unknown or other
  misc_feature (206)..(206): n is a, c, g, or t
tcagacgcgatcgacacgaccggtgctcgatttagtatagacatcgagggggggggtctcaggaggcagcgctctcgggacgtctccaccatggcctgggctctgctattcctccaccctcctcactcgagggcacgagggtcctgggcccagtctcgccctgacctcacgcctcgccctccctgtcgtcgggtcctccgtggacngtcgactccaccactcccctgcacgtggactccgaggtcggtagtacgtttacttagtttttaagtattcgttccttcgtaggtactcgaacgacccaaaccacccgaacggaaccaaaacccgaccccctaaaacttctaacttacttaagttttacgtagtaacgttcgtaaacgtaaacttaaccggtcccggtacccgttacgggttaacgggtttccacgtacgtttcccgtacttccgtcgttcggtaccttaccgtaacgtcggtacgtaacgtaaccgtacccggtcccctacccgtaacgtaacccttacgttcccggttcggtacgggacccttaccggggaacgttacggtaaacgggaaacggtaccgggtacggttacgttacgtttaaactttaccggtaccgcgtaacgacgtacctaaattactttaagttacgttttacggttccgtttaccggtacggttcggggttacgtcggggacggtacgtaccgtaggtccgtaccgtcggtacggcctacggcccgcggtcccgtccccgtacccgtacgtaccctcgttcccgtccccgtcccg

SEQ ID NO: 2144 - DNA, 734 bp, Homo sapiens
  misc_feature: GYAE6OF01AGUXG.45.75.G09.1.454.CMB.1.raw
  modified_base (265)..(265): a, c, t, g, unknown or other
  misc_feature (265)..(265): n is a, c, g, or t
  modified_base (308)..(308): a, c, t, g, unknown or other
  misc_feature (308)..(308): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgcttattttaaaaggtgtccagtctgaggagcagctgggtggagtcgtgggggaggcttgggtccgaggccggggggtccctcagactctcgtgtgcagcctntggacttcaccgtcagtgcagtcttcctgagcgtcgggtcccnccgacggccgtaccgaggggaacggccgtgggtacggtcgggttctaccgtaagtttaactttttacggacgacggacacgacgacgttactacgcagtacgtttaccggtaacggcctacgttcaacccgtatccgtaccaacgacgaactaacgttaccgaacggtaaccgtacggttacgttttacctaaggtaaactaccggtaaccgtaccccgtaacggaacccgtaacccgggaaccggaaccgtacccgggtaccttaccgttaacgtttacttaaccgttacggtacggtaccggtaggaaacgtaccgtaacccggaaaccccgaacgggtaaaccccggtaaacgttaaaaccttacctaaaccgtaaaccgttaacggttaaaccggtaacgttaccgggtacggttaccgggg

SEQ ID NO: 2145 - DNA, 638 bp, Homo sapiens
  misc_feature: GYAE6OF01EE52V.45.75.G09.1.454.CMB.1.raw
  modified_base (76)..(76): a, c, t, g, unknown or other
  misc_feature (76)..(76): n is a, c, g, or t
  modified_base (115)..(115): a, c, t, g, unknown or other
  misc_feature (115)..(115): n is a, c, g, or t
  modified_base (150)..(150): a, c, t, g, unknown or other
  misc_feature (150)..(150): n is a, c, g, or t
  modified_base (224)..(224): a, c, t, g, unknown or other
  misc_feature (224)..(224): n is a, c, g, or t
  modified_base (246)..(246): a, c, t, g, unknown or other
  misc_feature (246)..(246): n is a, c, g, or t
  modified_base (444)..(444): a, c, t, g, unknown or other
  misc_feature (444)..(444): n is a, c, g, or t
  modified_base (514)..(514): a, c, t, g, unknown or other
  misc_feature (514)..(514): n is a, c, g, or t
  modified_base (548)..(548): a, c, t, g, unknown or other
  misc_feature (548)..(548): n is a, c, g, or t
  modified_base (625)..(625): a, c, t, g, unknown or other
  misc_feature (625)..(625): n is a, c, g, or t
  modified_base (631)..(638): a, c, t, g, unknown or other
  misc_feature (631)..(638): n is a, c, g, or t
tcagacgcgatcgacacgaccggtgctcgatttagtatagacatcaggggtccctcagactctcgtgtgcagcctntggattcaccgtcagtggcagcttcctgagctgggtccnccaggcctccgagggaacggcctggagtgggtctnagttaatttttagacaggcacagcgtactcgcagacgtttaccggtaagggcctattccacatcctaccgaganactacgtccaaggaactcgttnttttctaagaaatcgaacctcccgtaggaccgaacccgaggtaccacggtcctactatattactgtacggtacgagacggactaccgaaacccgaggaaacccggaaagtaaacttactaaccaaccgttacgttaaacggtgacgggtaccgtaggtccgggaaccgaacggggtaccctaccgtaccgaccgttcnccgtcaacgccttacccgaaccgtaacgccacgttccgtaccctccccgcgccctaccctcctacgaacncgactcgtacggtcgggacacgacgccggtccgngggcctccgcgtacgtccgacgtaaccttccgttacctcgtactccgcgtatcggacggtcggcgtcgaggacgcgnagtacnnnnnnnn

SEQ ID NO: 2146 - DNA, 876 bp, Homo sapiens
  misc_feature: GYAE6OF01B0P2V.45.75.G09.1.454.CMB.1.raw
  modified_base (121)..(121): a, c, t, g, unknown or other
  misc_feature (121)..(121): n is a, c, g, or t
  modified_base (123)..(123): a, c, t, g, unknown or other
  misc_feature (123)..(123): n is a, c, g, or t
  modified_base (378)..(378): a, c, t, g, unknown or other
  misc_feature (378)..(378): n is a, c, g, or t
tcagacgcgatcgacacgaccggtgctcgatttagtatagacatcagggggggggtctcaggaggcagcgctctcgggacgtctccaccatggcctgggctctgctattcctcaccctccncnctgacggcacgacggtcgtcggcctagtctcgcctgtactcgcgtcctcgtccctccgtgtcgtcggtcctcggtacgactcgtacgactaccaacctcccgtccgtgacctacgtcggtaacctccggagggtcggttcgttaacgttttacgttttaaggtttttaactgttccgttccttacggttagtacaccaacgaaccaacccgacgacgtaaaccaacccgtaccccaaatcgtatacttattacgngttataccgttaaataacgttaccgtccggtaccgtttacgggttaacggttactacgttccgtctttacgccggttcgaaccttaacggacggttcgtaaccgtaaccgtaccggtacccgtaccgtttacgactaaccgtcgttacccggtgggttaacccggtcctacgggtaaccgttacgaacggtaccgggtaacgggtcttacgttaacgttttaagtttccggtttacggttacgttccgttacgtaacgttaacgttaggtaccggtaaccgggttaaccgtaaacggttcccggtagggtttaccggggtttcgggggtttccggaccggggtacggggttaacccggtcggggttaaaccggttacccgttaccgggtaccggttacggtacccggtaacccgggaccggttacccgggttaccccgttccccgtaacccgggttcgttacccggttaccccgtttccgtttcccccgttaaccccg

SEQ ID NO: 2147 - DNA, 872 bp, Homo sapiens
  misc_feature: GYAE6OF01CKCB7.45.75.G09.1.454.CMB.1.raw
tcagacgcgatcgacacgaccggtgctcgatttagtatagacatcaggggggggagaggagcccagcactgggattccgaggtgtttccattcagtgatctgcactgaacacagaggactcgccatgggagtttgggctgagcttgggttttccttgttgcttattttaaaaggtgtccagtctgaggagcagcgtggtggagtcggtgggggaggtcgttcgggtccgacgggtcccgggggggtccctcgacgactctcgtgtcgcgacgcctcgtggtacttccgtacccgtcgaggtcggaccgtacgtcccttaccgtggacggtccggtccgggtaccccgcccgaccgggtccgtacccgggaacgggggaaccggggtcccggtaggggtacggtcggggttaccttacgttaaaggttttaacgtttttaaggaccggtacggtaccgaaccgtaacggtaccggttaactacccggtacgtaacgttaccgtttaccgggtaaccgggtaccgtacttacccgaccttaccgtacctaccgaagtaccaaactacgttaccgaacgtaacgtacggtttcttacgtaagtaactaccgtaaaccaccggtacgaacccggtaacccggaggtaacccgtaccgtacttaccgttacttaaccgttacggttaggtaccggaacgtaaacggacgaacccgttaccccggaaaaccccggtacgggtaaaaccccggtaaagtttaaaccccgtaacccgttaacccgtaaaaccggtttaacggtaacccgggtttaagtaaccgggttcccggttaaccgggttacccggggggaaaccctaaaccggggttaaccccccg

SEQ ID NO: 2148 - DNA, 791 bp, Homo sapiens
  misc_feature: GYAE6OF01AW97F.45.75.G09.1.454.CMB.1.raw
  modified_base (134)..(134): a, c, t, g, unknown or other
  misc_feature (134)..(134): n is a, c, g, or t
  modified_base (515)..(515): a, c, t, g, unknown or other
  misc_feature (515)..(515): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggngtttggctgagcgttgggttttccttgttgcttaaagttttaaaaggtgtccagtctaggaggagcagcgttgggtgggaggttcgggtagggggggacggtcggtttcgggtcccggacgggggtccccggggggggttcccctagacgtaccgttccgtcggttggtcgaccaccggtccgttcgtggtacttcccgaccgtcgaggttggccacggtccttcgtggacgtcggtcgggtccgccgacgccgtacggaaggggacgggccgtgggtggtggtcgtacgttagttttaagtttacgacgacggtaccagacggtacgtaacctacgacgtagtaccgtttacgggtaaccggtcttaacgtccactaccnccgtaccagacgtaactacttaccgaaggtaaccgttcggttatttcgtaagtaaacgtagaacccgtaccgagaccgaacccggaagacccgtacggtccttacgttacttacgttaacgtggttacggtacgtaaggtacgtaacccggtaaccggaaacccccgtaaaccgggaaacccggtaaaacgtttaaacccgttaacccttaaaccctaaaaccggttaaccgtttaaaccgggtattaacccggggttccgggttaaacccggggg

SEQ ID NO: 2149 - DNA, 590 bp, Homo sapiens
  misc_feature: GYAE6OF01DP0MY.45.75.G09.1.454.CMB.1.raw
  modified_base (231)..(231): a, c, t, g, unknown or other
  misc_feature (231)..(231): n is a, c, g, or t
  modified_base (248)..(248): a, c, t, g, unknown or other
  misc_feature (248)..(248): n is a, c, g, or t
  modified_base (303)..(303): a, c, t, g, unknown or other
  misc_feature (303)..(303): n is a, c, g, or t
  modified_base (308)..(308): a, c, t, g, unknown or other
  misc_feature (308)..(308): n is a, c, g, or t
  modified_base (335)..(335): a, c, t, g, unknown or other
  misc_feature (335)..(335): n is a, c, g, or t
  modified_base (345)..(345): a, c, t, g, unknown or other
  misc_feature (345)..(345): n is a, c, g, or t
  modified_base (573)..(573): a, c, t, g, unknown or other
  misc_feature (573)..(573): n is a, c, g, or t
tcagacgcgatcgacacgaccggtgctcgatttagtatagacatcgaggggggggtctcaggaggccagcgctctccgggacgtctccaccatggcctgggctctgctattcctcaccctcctcactcgagggcacagggtcctgggcccagtctgccctgactcagcctgcctcctgtctgggtctcctggacagtcgatccaccatcccctgcactggatccagcggtnacgttactgtttttaantgtctcttggtatcagctaacacccaggcaaacgcccccaaatcactcactttancgatntacaataactcggcctcgagggtttcncatcgcttcncgtggctacagtctaggcaactcgcctccgtgacctagtcgtcgtggcctcgaggtctagaacgacgacgtctaggtaactttacgttaactcggactacgtcgtattaacgtattagttaacgttgtttaccctacgttcgggttagtacggtcgggaacggtccgtaagtaccgtaccggttacgtacggtctacgacccgacgtccgtccgtccccgtcgtaccnccgttcgtccgtccccg

SEQ ID NO: 2150 - DNA, 711 bp, Homo sapiens
  misc_feature: GYAE6OF01CRYPD.45.75.G09.1.454.CMB.1.raw
  modified_base (241)..(241): a, c, t, g, unknown or other
  misc_feature (241)..(241): n is a, c, g, or t
  modified_base (258)..(258): a, c, t, g, unknown or other
  misc_feature (258)..(258): n is a, c, g, or t
  modified_base (702)..(702): a, c, t, g, unknown or other
  misc_feature (702)..(702): n is a, c, g, or t
  modified_base (705)..(705): a, c, t, g, unknown or other
  misc_feature (705)..(705): n is a, c, g, or t
  modified_base (707)..(707): a, c, t, g, unknown or other
  misc_feature (707)..(707): n is a, c, g, or t
  modified_base (709)..(710): a, c, t, g, unknown or other
  misc_feature (709)..(710): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccgagggagggcctggagtgggtctcagttaatttttagacaggcacagcgtactacgcagatttccggttaagggccattccaccatcctccagagacaattccaaggaacacggttntttcttagaaatgaacnccctgacgaccgagacacggctctatacttactgtgcgagacgactaccggaaacccctaggaaccccggtaaagaaactttcctaaccgtaaacttaaccgtacgggttatacgggaaccggttcggtacggggaccaaacggggaccctacccggtcctaacccggttcctcccgtaccgacggcccttacccgaacccggaacgggccccctagttccccgggttcccctttcccccgtacggtcccctaccccgttaccctacccgaacgtacggaccctaacccggtccggtaccggggccaaccggaccggtcccggacccggtcgggtccgtcggcccgttggtaccgaacggtacccttacccgttccgtcgtacttaccggccgttcgtcgggaccggccggtcgtacgggacgtagggaccgcgtacgtagcgncgncngnng

SEQ ID NO: 2151 - DNA, 651 bp, Homo sapiens
  misc_feature: GYAE6OF01AFVTE.45.75.G09.1.454.CMB.1.raw
tcagacgcgatcgacacgaccggtgctcgatttagtatagacatcagggggggtctcaggaggcagcgctctcgggacgtctccaccatggcctgggctctgctattcctcaccctcctcactcaggcacagggtcctgggcccagtctgccctgactcagcctgcctcctgtctgggtctcctggacagtcgatcaccatcccctgcactggatccagcgtgacgttactgttttatatgtctcctgtatcagtcaacaccagcaaacgccccaatcatcatttatgatgtacaataacgtcggtccctcgtagggtttactcgataccgtcttctcgtcgtctacgagtcgtggcaactacggcccttcccgacgtaccactccgtccgtcggtcctccgaaggtcgtacgaaggtacggaggtacgtagtagtttaattacgtacgactagaccacgtaattacgttatttacggtacgttttccgtaccggtttacggtagttccgggacggtaccgggaccgtaggttacccgtacccggttaccgttacgggtacccgaacccggtcccgtaaacggtcccgttacccggtaccccccgttacggttaccccttaacccgttccggttcccggtttaccccccgg

SEQ ID NO: 2152 - DNA, 585 bp, Homo sapiens
  misc_feature: GYAE6OF01AIINK.45.75.G09.1.454.CMB.1.raw
  modified_base (542)..(542): a, c, t, g, unknown or other
  misc_feature (542)..(542): n is a, c, g, or t
  modified_base (551)..(558): a, c, t, g, unknown or other
  misc_feature (551)..(558): n is a, c, g, or t
  modified_base (560)..(562): a, c, t, g, unknown or other
  misc_feature (560)..(562): n is a, c, g, or t
  modified_base (564)..(570): a, c, t, g, unknown or other
  misc_feature (564)..(570): n is a, c, g, or t
  modified_base (572)..(585): a, c, t, g, unknown or other
  misc_feature (572)..(585): n is a, c, g, or t
tcagacgcgatcgacacgaccggtgctcgatttagtatagacatcagggggaagaccgaagggcctggagtgggtctcagtaatttttagtacaggcacagcgtactacgcagattccgttaagggccgattcaccatctccagagacaattccaggaacacggtgtttcttgaaatgaacaccctgagacccgaggacacggctctatattactgtgcgagagatcgaacccagacccggaagaattctacaactactacggtatggacgtctgggccaagggaccaccgtcaccgtctcctcagcctccacccaacgggcccacgtccggtccttcccccctcggccaccccgttccctcccaaacgacgccacccgttctcggggggtccaacgacggccggaccccgtggggtcctcggtcccgtggttccgaaagggtaccgttaacctttcccgttaccgtacgttccggtccggttccgtcggacggccggggtcgtcgggtccgaaacgggccgaccggaagttaacggacgtncgcagtcgnnnnnnnntnnntnnnnnnngnnnnnnnnnnnnnn

SEQ ID NO: 2153 - DNA, 965 bp, Homo sapiens
  misc_feature: GYAE6OF01A06ZX.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccagtggtagtttgggctgagcgttgggttttccttgttgtacttaattttaaaaggtgtacctagtcgtggaggtagcgagtcgtgggtggagtcggtgggggagtcgttcggtccggacggggtcccggggggtccctacgacgtaccgtcgtcggtgtcgacgcgtcctcgtggtacgttccgaccgtgacgtcgggactacgttccgttcgtaggacggtccggttaccggggtcccgacggtaccgggtacccgtaccggggaaaggggtaaccggggccggttagggggtacgggttacgggttaccgttaaacggtttaacggtttttaaaacggtttttaccggaaaccggtacggtaacccgtacggtaaccggttaaccggttaaccggtaccgggtaacgttaacgggtttaccggtttaaacccggggtttaaacggtacccgttaacggtttaacccaaccgtttaaccgtcccggtaaaccggttaaaggaaccggtaaaccttaaacccggttaacccggaaagggttaaaccccgtttccgggtttattttaaccggttaaagtaaaccgtaccgtaaccccgtaccgtacgggtaaaccccgggaccggtaacggtaacccggtaccggttaacgttaccttaaggtttaacccgtttgtacgggtaccggaacggtaaaggttccgtaaacccggtaacccgtaaaacccggaaccgggttaaaacccgggtaaaacttaaaccgtttacccgtaaaaaccgttacccggtttaaacggtaaagggttcccgtaacggggttaccggtaaccccgggggg

SEQ ID NO: 2154 - DNA, 869 bp, Homo sapiens
  misc_feature: GYAE6OF01EY8GR.45.75.G09.1.454.CMB.1.raw
  modified_base (697)..(697): a, c, t, g, unknown or other
  misc_feature (697)..(697): n is a, c, g, or t
  modified_base (761)..(761): a, c, t, g, unknown or other
  misc_feature (761)..(761): n is a, c, g, or t
tcagacgcgatcgacacgaccggtgctcgatttagtatagacatcgaggggagctctgggagaggagcccagcactgggattccgaggtgtttccattcagtgatctgcactgaacacagaggactcgccagtggtagtttgggctagagtcgtttcgggttttccttggtttgtacgttaagtttttaaaaggtcgttaccgtagttcgttaggaagggtacgcgtaaggtccgtggggtaggtacggttacggtggggggtacggttcgtttcgggtacccggtaacggggtccccgggggggttccctccggtaacgtaccgttccgttcggttggtcggaccgtacgtcccgtacgtacggtacctttccgaccggttacgtaggtcggactacgtcgttccgtaggaccgtcggtacggtcccgaccggtacggccgtaccgggaggggttaccggcgtacggggttacggtacgggttaccgttagttaacggtttttaaactttacggaacgtaggacctaaccggacgtaccgttaacgtaccgacgttaacgttaccggttaacgggttaaccggctaacgttcgaccttgtaccgacgaagtacgactaactacgagtaacgtgtttacgttacgtacacgtacgaaccctacggtacgaaccgacccggttagacccggttacgtntttaccgtaacgtttactaacggtcggtacgacgtaaggtaccctacggtaacccccgggtaanaacccggggttaaaacccgaagtttaaacccgtttaaccggaaaaccggttaccccggtttacggttaaaacccgtgggttacccggggtacgtttaaccccgggggg

SEQ ID NO: 2155 - DNA, 707 bp, Homo sapiens
  misc_feature: GYAE6OF01DJO9F.45.75.G09.1.454.CMB.1.raw
  modified_base (334)..(334): a, c, t, g, unknown or other
  misc_feature (334)..(334): n is a, c, g, or t
  modified_base (549)..(549): a, c, t, g, unknown or other
  misc_feature (549)..(549): n is a, c, g, or t
  modified_base (579)..(579): a, c, t, g, unknown or other
  misc_feature (579)..(579): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccgtgtctgggtctccgtggacagtcgatcaccatcctcctgcacgtcggaaccagcgagtgagttggttagggaagtttactaaccgttgtccttccgtacggtaacccaacacgaccaacccgaggaccaaaccggacccccaaatcctatgtaatttagnggaacgggcaaggtacgccggtacctggtacgggtttactaagtccgtacttcgtacgtcgtcctacctaacggtcgtacgggaaccctaaccgacccggtaccctacccgtacgaaccctaatttcccgtcgggtaccgggtccctaccggtaacggtccgtacgaacgggtacggtacggtacgtagttacttttactttggtttcggttacncgttaactgtaagtcgaaccggtacggacncgttacggtacggttggggtacgttcgggacgggacgtaccgttcggtcgacccggttcgtacggtacgaccggtaccaccgggccttacccggtcccgttaggaccctcgttccgcccgttcccccg

SEQ ID NO: 2156 - DNA, 354 bp, Homo sapiens
  misc_feature: GYAE6OF01E4K3K.45.75.G09.1.454.CMB.1.raw
  modified_base (304)..(354): a, c, t, g, unknown or other
  misc_feature (304)..(354): n is a, c, g, or t
tcagacgcgatcgacacgaccggtgctcgatttagtatagacatcagggtcttcgtggctcacgtccaccaccacgcatgtgacctcagggggtccgggagatcagtgagggtgttccgtttgggggttttagggggggaagaggaagacgtcggaccggtcccccccgagggagttcgaggtgcgtgggcacgaggccgggccccgtggggctcggccgttacgggtacgaacggtacctttaccttccgtcgtagtccggtcgttcgtggacggccggggcgtacggacgaacggcgcgatnnnnnnnnnnnnnnnnnnnnnnnnnnnnnnnnnnnnnnnnnnnnnnnnnnn

SEQ ID NO: 2157 - DNA, 741 bp, Homo sapiens
  misc_feature: GYAE6OF01CJR1H.45.75.G09.1.454.CMB.1.raw
  modified_base (637)..(637): a, c, t, g, unknown or other
  misc_feature (637)..(637): n is a, c, g, or t
  modified_base (667)..(667): a, c, t, g, unknown or other
  misc_feature (667)..(667): n is a, c, g, or t
tcagacgcgatcgacacgaccggtgctcgatttagtatagacatcagggggagctcgtgggagaggagcccagcactgggattccgaggtgtttccattcagtgatctgcactgaacacagaggactcgccagtggagtttgggctgagtcttgggttttccttggttgtactttaagttttaaaaaggtcgtccaagttctaggaggagcgagtcgtggtggaggtcggtgggggaggtcgttcgggtaccgtaggggtccccgggggggttcctacgacggtaccttcgtccggtggtacgcctaacggtcctacgtcggtacttccgtaccgtgtaaggtgacacgtcttcgtaggagtcgtacgggtcccacgaggtcctacggagggtacggcgtggtacggtcggtctactaagtttaatttcggacacgcacgtacgtcgtaactacgacagtacttacggtaacggcctatacaccgtattacacgtaagacgtaactaaaccgtccgaaacggtaaccttcgggtttatttaccgtaaagaacgtttaacgaaacccttccgtagggaaacccgtacccggaacggtaccgacggttaacctacgttaattacgtaacgtgttaccgnggtaacgacgtaccgaaccgtaaaacccgnggaaaaccggttaaaagtaaccttaactaaccgtaaacgttaacggacggttactacggggtaccgtaacgggg

SEQ ID NO: 2158 - DNA, 630 bp, Homo sapiens
  misc_feature: GYAE6OF01EF9Y4.45.75.G09.1.454.CMB.1.raw
  modified_base (223)..(223): a, c, t, g, unknown or other
  misc_feature (223)..(223): n is a, c, g, or t
  modified_base (276)..(276): a, c, t, g, unknown or other
  misc_feature (276)..(276): n is a, c, g, or t
  modified_base (299)..(299): a, c, t, g, unknown or other
  misc_feature (299)..(299): n is a, c, g, or t
  modified_base (351)..(351): a, c, t, g, unknown or other
  misc_feature (351)..(351): n is a, c, g, or t
  modified_base (398)..(398): a, c, t, g, unknown or other
  misc_feature (398)..(398): n is a, c, g, or t
tcagacgcgatcgacacgaccggtgctcgatttagtatagacatcagggggctggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatctcctgcactgaaccngcagtgatggttggtagtttttagtttgtctcctggtaccaacacaccccggnaacgcccccaaatatctatttanaggacactagccggtcccgtggggttcaagtcgcttctctggctcgagtccnggacacgacggtcctcccagtactaactcgtacgtcgggccttacgnggtacctcgaacgggacgagtcttagtaactttagtacctggtcctagtctacgtatagtcggacgtaggttagtcgttagtttgggcgtacggggtacggtcggaaccgaggtccgtacgggtacctaccggtcgtaccgtaccgtacccggacggtccgtacccggttcccccgtccgggttaccctaccgttcccgttccccgtaccccgttccccgtccccgttaccg

SEQ ID NO: 2159 - DNA, 673 bp, Homo sapiens
  misc_feature: GYAE6OF01BBHGI.45.75.G09.1.454.CMB.1.raw
tcagacgcgatcgacacgaccggtgctcgatttagtatagacatcaggggggggtctcaggaggcagcgctctcgggacgtctccaccatggcctgggctctgctgctcctcactctcctcactcaggacacagggtcctgggcccagtctgccctgactcagcctgcctccgtgtctggtctcctggacagtcatcaccatctcctgcactggaaccagcagtgatggtgggattataacttgtctctgtaccacagcaccgagacaaacgacccccaactcatgtattagtggaggcaggtacgccggtccgtcgtaaggtttctaagtcgtcttctcgtcgtctaccgtaagtcgtcgactaaccgaccgtccctcctagactaacttcgtcgtcggtcctccgaggtcgtcggaaggaacggacggtacgttagtaacgtttaacttaccgttcgtcgttcgtacctacgttaagttacgtacggtacggtaagggtttaacgtttaaggtttacggttttacgggttacgggttacgggtaaccggggtaaccgggtaaacggtaacgtacgttaccggtaacccggttcggtaaccggtaccggtaaccgaaccccggtacgggtccccttaccccgggtcccccgttcggttcccgttacccccgg

SEQ ID NO: 2160 - DNA, 746 bp, Homo sapiens
  misc_feature: GYAE6OF01CZYGE.45.75.G09.1.454.CMB.1.raw
tcagacgcgatcgacacgaccggtgctcgatttagtatagacatcgagggggggggtctcaggaggcagcgctcgtcgggacgtctccacatggcctgggctctgctgctcctcactctcctcactcgaggacacgagggtcctgggcccagtctgccctgactcagcctgcctcgtgtcgtgggtctccgtaggacaggtcgactcacctatccgtcctgactacgtacggaaccagctagtcgagtggttgggtattactaaccttgtcctccgtagtaacccaacgacgaccaaccgacgtaacaacccgaccccctaaagtccattagtagtttagtaggacgggtactaaggtaccggccggtccgtacggttacgggttactacgtcgtcctttacgtcgcggtacctacgtaactcggacggtaccaacccgtcccggtactaccccgtagtaactacctcggtaccgtgggaccctcggacggtacgtaggacggaacggtacgtgttagttaacgtttacgtacgcgttctacggtcctaagtagtacgttacggtacggttaacgggttagtttacgggttttacggtttcggggtacgggttaccgggggaaccgggtaacggaaccggtacggtccgggttaacgtaccccggttaacgggtctaacccgggtaaccggacccgtaaccggtcccgttcccccggtaaccggttcccggtaccttacccccggg

SEQ ID NO: 2161 - DNA, 765 bp, Homo sapiens
  misc_feature: GYAE6OF01CIGKC.45.75.G09.1.454.CMB.1.raw
  modified_base (286)..(286): a, c, t, g, unknown or other
  misc_feature (286)..(286): n is a, c, g, or t
  modified_base (596)..(596): a, c, t, g, unknown or other
  misc_feature (596)..(596): n is a, c, g, or t
tcagacgcgatcgacacgaccggtgctcgatttagtatagacatcgagggggggggtctcaggaggcagcgctctcgggacgtctccaccatggcctgggctctgctattcctccaccctcctcactcgaacgggcaacgaggggtcctcgggcccagttctcgcccctgacctcgagccctgccctcctgtcgtcgggtctccgtggacaggtcactaccaccacgtccctgaccactggacttaccgagggtcggttacgtaccgttatttaagttttaaagtntcgttcgtaccgttaggactacagaccaaaccgacccgaaggaccaaaacccacccctaaaactactaattacctaagtttatagactagtacaaagttaaccgtccgtcccgtacgttagggttcctacgtaacttccgtcttaccgttcgtacggtcctaacgtaacggtcgtaacggtacgtaacttaacccggtcctacccgtaacaccgtacttacccgtcgtacggtcgaccgtacggtacgacggaaacggacgtacgtacgttaagttactttaacgtactacgtacggacgaacccttaanaaccgtttaaagtttaacgtttaacggttttacccgttaaaccggttaccggttacggttacgggttaacggccggtaacggtaacgtacggttaacgccgttaacgtacgtacgaccgtacggaccgtcctacccggtcccgtactcctacgttcggcccttccccgg

SEQ ID NO: 2162 - DNA, 749 bp, Homo sapiens
  misc_feature: GYAE6OF01DLTCM.45.75.G09.1.454.CMB.1.raw
tcagacgcgatcgacacgaccggtgctcgatttagtatagacatcagggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttggtccgaggccgggggggtccctcagactcgtcgtgtgcagcctctggattcaccgtcagtggcagcttcctgagcgtcgggtccgccgaggcctaccgaggggaagggcccgtggaggtgggtctcgtagttaattttagacaggcacgagcgtactacgctagtacgttaccggtaaaggcccgtaatttacaacccgtattacccgtaccccgaaagaacggtaacctaaacgtttacccgaaacgggtaaaccgtacggggtttcgtttttaaccgttaacggtaaaattccggaaaaccctaccccggttaggtaaacccgggtaacccccggaagggtaacccgaaaccgggtccttaaccgttagtttaactttaccgtggtacgtaccggaaggtaaccgtacgtaaccccgggaaaccctaaccggtaaaccccgggaaaataaaacccgtttcgtaaaccccgtaaacgtttaaccccgttaaacgggttaacgtacggggtaacccggttaacccgggg

SEQ ID NO: 2163 - DNA, 786 bp, Homo sapiens
  misc_feature: GYAE6OF01BY4XU.45.75.G09.1.454.CMB.1.raw
  modified_base (292)..(292): a, c, t, g, unknown or other
  misc_feature (292)..(292): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggtagttgggctgagtcgttgggttttccttggttgacttaattttaaaaggtgtcctagtctggaggagcgagcgtgggtggaggtcggtgggggaggtcgttcgggtccgacggggtcccgggggggtccctcgacggtcctcgtcggtagtcgaccgngtcccgtgtcggtactccgacgtcgtaggtcggctacgtcgttcgtaggtcgtcggtcgggtcccgaccgtacgggtccgtacgggaaggggtaaccgggtccggtagggtacggttcgggttacctacggtttaaggttttaacgttttaacggaacgtaggtaccacgacggtaccgtaaccgtacggacgtaacgttacgttaccgggtaacgacccgttactaccgaaccgtcgtacctacgacgtacgtaactacgtaaccggaaggtacccgttagttacgtttacgtaaagtaaaccgtacgaaccccgtcgtaacggaacccggaccggtaacggaacccgtaccggttacttaacgttaaacttacgtttccggagtacggaacggtagaccgttaacaacccggaacccgtaaacggaaccgtaaacggtaacttaacccggtaataacccggtacggttagacggtacgggtacgtaccgggg

SEQ ID NO: 2164 - DNA, 682 bp, Homo sapiens
  misc_feature: GYAE6OF01CCZJK.45.75.G09.1.454.CMB.1.raw
  modified_base (252)..(252): a, c, t, g, unknown or other
  misc_feature (252)..(252): n is a, c, g, or t
  modified_base (299)..(299): a, c, t, g, unknown or other
  misc_feature (299)..(299): n is a, c, g, or t
  modified_base (458)..(458): a, c, t, g, unknown or other
  misc_feature (458)..(458): n is a, c, g, or t
  modified_base (486)..(486): a, c, t, g, unknown or other
  misc_feature (486)..(486): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacaggcgatcaccatctcctgctacgtggaaccagcagtgtacgtttgttattataactatntctctaggtaccaacaaccaccaggaccaaacgcccccaaactcatntatttatgatgtacgagtaactcggcccttggtagggtttctagtactcgtctcgtcgtcgtctaccgtaacgtcgacggaccaacgtcccgggtccctacccgtacgaccctagttccgtacggtcggtcccttcgacgggtcgtacgggaggtacgnggtacgtagttaacgttcgtacgctacncgtctactatcgtcgtacgacgtacgtacgaacgtacttacggtacctttacgtagggttacccgttccgggggaacggggtaaccggtaacccgtaagggtccccgtttaacgggacccccgtttacgggttaccgggtaccaaaccccgggtaccggtacccgggttcccccgtaaccccgggttccccccggg

SEQ ID NO: 2165 - DNA, 702 bp, Homo sapiens
  misc_feature: GYAE6OF01DMCAI.45.75.G09.1.454.CMB.1.raw
  modified_base (196)..(196): a, c, t, g, unknown or other
  misc_feature (196)..(196): n is a, c, g, or t
  modified_base (527)..(527): a, c, t, g, unknown or other
  misc_feature (527)..(527): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacgacgggtcctgggcccagtctcgccctgactcagcctcgcctcctgtctggtcctccgtggacncgtcgatccaccactcccctgctaccgtcggtactccgaggtcgggttacgttaaccgttttactttaggtttttaagacttcgtctacgtaggttactacgacgacctaaaccgacccgaacggaaccaaacccggaaccccctaaactctaacttcttaatttacgtagtacttgtaactaaacgtacgtccggtaccttaccggttaacgggtttctacctacgttccgtcctttctcgtcggtacctaccgtaacgtcgtacgacctaacgtcccgtcctccgtacacctctcgtcggtcggcctacgacggtcgaacggtaacggnggtacgtacttacgttacttactacgtcgactacactactaagttagtttgtacgttacgttacgttacggtcggttaacggttcggcgggtaacgtaccgtagtaccgtacgtacgtacgtacgaccgacgtccgtccgtacccgtccgttacgacttccgttcctccgtaccc

SEQ ID NO: 2166 - DNA, 768 bp, Homo sapiens
  misc_feature: GYAE6OF01AMTTT.45.75.G09.1.454.CMB.1.raw
  modified_base (756)..(756): a, c, t, g, unknown or other
  misc_feature (756)..(756): n is a, c, g, or t
  modified_base (765)..(765): a, c, t, g, unknown or other
  misc_feature (765)..(765): n is a, c, g, or t
tcagacgcgatcgacacgaccggtgctcgatttagtatagacatcagggatccctcagactctcgtgtgcagcctctggattcaccgtcagtggcagcttcctgagcgtgggtccgccaggctccgagggaggcctggagtggtctcgagttaatttttagacaggcacagcgtactacgcagtacgtttccgtaagggcctattccacctatcctaccgagacgactaacttccgaaggaactacggttgttttacgtagaaaactcgaaaccacccgtagacgaacccgaggaccgacggtctctaacgttacttactggtcgacgagacggtactaccgaacccacggaaacccggaaattaaacgttcctaaccaaaccgttacgtaacggtagtacggaccgttcggacggggtaccaaacgggtaccctaaccgtcccgaacccggttctacccgttccgaccgacccctttaaccccgaaccggtaacgggtcccctaacggttcccggtaaccccgtttcccccgtcgggtacccctacccccgttacccgacccgtaaaccggtaaccgaccgtaccccggttacgggtccggggaacctaccggaaccggcccgggacccgtcgggccgtccggtccggtcggtaccgtaacggtaccttacccgttccgtacgtacgtacccggcgttcggacggtaccggtaccgggtccggtcgggaccggtaacgggtccgacgtagtacgngctgctagnacg

SEQ ID NO: 2167 - DNA, 775 bp, Homo sapiens
  misc_feature: GYAE6OF01DMRX4.45.75.G09.1.454.CMB.1.raw
  modified_base (773)..(773): a, c, t, g, unknown or other
  misc_feature (773)..(773): n is a, c, g, or t
tcagacgcgatcgacacgaccggtgctcgatttagtatagacatcaagggtccctcagactctcgtgtgcagcctctggattcaccgtcagtggcagcttcctgagctgggtccgccaggctccgagggagggcctggagtgggtctcagttaattttagacaggcacagcgtactacgcagtagttccggttaagggccgattccacctatcctaccagagactaattccgaaggaactacggttcgtttcttagaaatcgaacacctgaacgacccgaggaccacggctactattattctggtcgcgaagagactaccggaaacccgaggaaccccggaaagtaaacttacctaaccgtaacttaacgtacgggtatacgggacgtcggtacggggaccgaaacgggaccctaccggtacctacccggtctacccgcacgtccctacccgaccgaacgggcccctacggttcccggttaccccttcccccggtcggtacccctacccccgttaccctaccgaaacgggtacccgtacccgtaacccggttccgggtacggggacccaacgggtacccgggacccgggtccccggttccggggaccgttcccgggtacccggttacgggtaacccggtaacgggttacccctttcccgtttacccgaccggttacggttacccggtcggttaccgtacggggtccgggtacccggggttaccggacgggtaccggaacggggtaccgacgtaacgttgacgctacgcgctgngc

SEQ ID NO: 2168 - DNA, 698 bp, Homo sapiens
  misc_feature: GYAE6OF01E3GS1.45.75.G09.1.454.CMB.1.raw
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggtcttggtcccgaggcccggggggtccctcgagactcgtcggtgtgcagcctcgtggacttcaccgtcaggtggcacgccttccgtgagccgtgggtcccgcgaggcctccgagggaacggccgtgggagtcgggtctctaagttaatttttagacgaggcacgagtcgtactacgcagtacgttacggtaacggccgtaattccgaaccgtattccgtacccgaagaccgaactaaacgttcccgaagggtaaccgtacgggttacttttacgttaacgtaaagtcgaaacccaacccggttagaacccggaacccggaacggtaaccgaccgggtacttaccgttaagtacgtttacgtgtacggacgagtacgacgtaccgaaacccgtaggaaccccggaaagtaaccgttacaaacgtaacgttaaccgtacgggttacgtacgggaacgttaccggtcggggtaacccgaacgggtaaccccg

SEQ ID NO: 2169 - DNA, 1003 bp, Homo sapiens
  misc_feature: GYAE6OF01AYX5D.45.75.G09.1.454.CMB.1.raw
tcagacgcgatcgacacgaccggtgctcgatttagtatagacatcgagggggggggtctcaggaggcagcgctctcgggacgtctccaccatggcctgggctctgctattcctcaccctcctcactcagggcacgagggtcctgggcccagtctgccctgactcagcctgcctcgtgtctgggtctcctggacagtcgatccacatcggcctgcactggaaaccacgagtgagttcggttaggggtagtttttacgttttcgttaccttcccgttacggtaacccaaacctaaaccgacccccggaccggaaccggaaccccccctaaaaccgtaacttacctaaacgtttttacggtaaacgggtaacctaaccgttaaacggcccgggtaccccggttacggggggtttttaccaaacggttccgggtccttttcccgtcgttcgggtaccgttaccccgaaaggtttccgtacgggtaccgaaaccgtaccgggggcccccttaccccggttacggtaaccctaaaacgtttcccgttaccgttcgggggtccgttaccccggtaacgggcccgttacgaacccgggggttaaccggacgggtacccgttacggttaacgttttaccgtttttacggttcgttttcggtaccgttacccggtaaagtttagttacggttaccggaaaccggggtaaacccgtacggtacccgttaacgggtttcgggggtttacgggttaccgggggttaaccgggggacgggttaaacccgggtaacggggttttaccgggtaccccggtttaacccggggttaccgggttaccggtaaccgggacccggtaaaaccgggtcccggttaaaccccggtccccccgggttacccgggtttaccccgtaaaccgttttcccccggtttcccggtttaaaccccccccgtcccccggttttaccccccgtaccccggttttcccggtccctttcccggggtttacccccggg

SEQ ID NO: 2170 - DNA, 640 bp, Homo sapiens
  misc_feature: GYAE6OF01EWP2V.45.75.G09.1.454.CMB.1.raw
  modified_base (240)..(240): a, c, t, g, unknown or other
  misc_feature (240)..(240): n is a, c, g, or t
  modified_base (410)..(410): a, c, t, g, unknown or other
  misc_feature (410)..(410): n is a, c, g, or t
  modified_base (633)..(633): a, c, t, g, unknown or other
  misc_feature (633)..(633): n is a, c, g, or t
  modified_base (635)..(635): a, c, t, g, unknown or other
  misc_feature (635)..(635): n is a, c, g, or t
  modified_base (637)..(640): a, c, t, g, unknown or other
  misc_feature (637)..(640): n is a, c, g, or t
tcagacgcgatcgacacgaccggtgctcgattttagtatagacatcaggggtccctcagactctcgtgtgcagcctctggattcaccgtcagtggcagcttcctgagctgggtccgccaggctccgagggaaggcctgggagtgggtctcagttaatttttagacaggcacagcgtactacgcagattccgttaagggccgattcaccatctccagagacaattccaggaactacggttntttctagaaatgaacaccgtgacgacccgagacacggctactatattactgtgacgtagagactccgaaacccgaggaaccccggaaataaaactttctaacaaacttaactacggtatcgggaccgtcgtacggggacccaaacggggacccaccgtacaccggttccnccgtacacgccctaccaaccgaacgggccacgtccggtcccttcccccgtgcccacccctcctacccgaacgtacgacctaccgtcgtacggggcctacgacggtccgggacccgttcggggaccgttcggcccgttacggtaccgtaacgggtaccttacgtttcccgtacgtacgttccgacgtcgtggacggcgggctacggtcgacggcgtcgatacgncnannnn

SEQ ID NO: 2171 - DNA, 874 bp, Homo sapiens
  misc_feature: GYAE6OF01CBR62.45.75.G09.1.454.CMB.1.raw
tcagacgcgatcgacacgaccggtgctcgatttagtatagacatcagggggagctctgggagaggagcccagcacgtgggattccggaggtgtttccattcagtgatctgcactgaacacaggaggactcgcatggaggttgggctgagtcgtttcgggttttccttgttgtacttaagttttaaaggtcgttacctagtgtaggaggagacgtggcggtgggtcgggtaggtcgggttggggggaggttccgttcgggtaccgggaccgggggtcccgggggggttacccctaccgtaacggtaccttccggtcggtcggtacgtccgacgtcccgttacgttacgggtacttacccgtacgtcgtacgggtcggctagttccctacggtaggcggtccggtaccgggcccggtaccggtacggccgtaccggggaggggaaccgggtccggtggtacgggttcgggttaccgttagtttaaaggttttacgttttacggaacgtacgaacgtacggtaaccgtcggtttaaaccgacgtaaccggtaacgggttacgttttaacccgggaaacgggttacccgttaaccgttaccgtacctaacctttacccgtaccgaaaccgggtaacgtaacccgttaaacctaaccggtaaacgggttaacgttacgggtttacctttaggtaactaaaaccgtcgaaacccgttacccgacggtaaacccgacccgggaaggaaccccacggtttaacgtaaccttaaggttacttacggtgtacggaagtacggaccttaccggaaccgtaaaccccggaagtaacgtaacgaccttaaccaactaacgtaacctaggacgtacgggtcgtacggg

SEQ ID NO: 2172 - DNA, 758 bp, Homo sapiens
  misc_feature: GYAE6OF01BIIMC.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggactccgaggtcggtgtacgtttacttagtttttaagtattcgtctccgtggtatcagaccaaccacccgaggaccaaacgacccccaaactctactactatttactgtatcgtactaataacgtccggtaccctacggtacggggtttctcgtactcgtaccttcgtcgtcggtacctaccgtaacgtcgtacggacctaacgttaacccgggcccttacccgtacgaaccctacttccgttacgtcgggtacctaccgtacgggtacgttacggaaaggtaaccggacggtacgttacgttaactttaactttacgtacgtacgacggtactaacttaagttaacgttaagtttacggtttaccgtttacccggttaacggtttacgggttaccggttcggggtaccgggtaacgggttaccggtaacggttaccggacccggttacgtaacgggttaccaccgggtacccgtaaccggtccgtacccgggtccccgttacgggtaccctacccgttcccgttccccgtttaccccccg

SEQ ID NO: 2173 - DNA, 804 bp, Homo sapiens
  misc_feature: GYAE6OF01CVB1F.45.75.G09.1.454.CMB.1.raw
tcagacgcgatcgacacgaccggtgctcgatttagtatagacatcgagggggggggtctcaggaggcagcgctctcgggacgtctccaccatggcctgggctctgctattcctcaccctcctcactcgagggcacgacgggtcctgggcccagtctcgccctgactcacgcctcgcctcccgtgtcgtcgggtcctccgtggacacggtcactccaccacctcccctgccacgtggactccgaggcggttagtacgtttactttgtttttaaagcttcgtccttccgtaggtactcgaacgacctaaccaacccgaacggaaccaaacccggaacccccaaacgtctacgtagttactttagagggtacggacgtaacgtaacccggtccggtacccggttacgggttacgggtttaacctacggttcccgtccgtttacgtcggttaccggtcctaaccgttacgtccgtacggaaccgtaccgtacccggtccctactaccgtaactacgtccgtaccggtcggtctaccggtacgtcgtaacgggacggtacgggtacgtcggttaacgtaactttacgtcgttacgcgttacgtactacttagtacgtaggtaacggtcggtttagtaacggttttcggttagggtccggttaggggtaccgggacggtacgtaccggtcccggtaccgttaacccggtccggtaaccgttaccgaacccggtacccggaccggttaccccgttccccgggtacccttaccccggtacttacccgttcccggttaaccccgttcccccgg

SEQ ID NO: 2174 - DNA, 696 bp, Homo sapiens
  misc_feature: GYAE6OF01EOH6V.45.75.G09.1.454.CMB.1.raw
  modified_base (193)..(193): a, c, t, g, unknown or other
  misc_feature (193)..(193): n is a, c, g, or t
  modified_base (197)..(197): a, c, t, g, unknown or other
  misc_feature (197)..(197): n is a, c, g, or t
  modified_base (214)..(214): a, c, t, g, unknown or other
  misc_feature (214)..(214): n is a, c, g, or t
  modified_base (524)..(524): a, c, t, g, unknown or other
  misc_feature (524)..(524): n is a, c, g, or t
  modified_base (664)..(664): a, c, t, g, unknown or other
  misc_feature (664)..(664): n is a, c, g, or t
tcagacgcgatcgacacgaccggtgctcgatttagtatagacatcgagggggggggtctcaggaggcagcgctctcgggacgtctccaccatggcctgggctctgctattcctcaccctcctcactcgagggcacgagggtcctgggcccagtctcgccctgactcagtcctgcctcctgtcgtcggtctcgngacngtcgatcactctccctncacgtgactcaggtcggtgtacgtttacgttagttttaagacttcgtaccttcgtagtatacgtacgaccaacctaccgacgaaccaaaccgacccctaaacgtactacttactaactttagtacgtagtacgtaactaacttacgtaccggtaccgttacggttaacggtttctacgtacgtccgttccttacgtcgtacgtacctacgtacgtcgtacgtacgtaccgtcccgtacctaccgtacgtactacgtccggtcgtacggtccctaccggacggtacgttaacggaacggtacggaacgttnttaaacgtttactttacgtacggtcaccgtaagtactaacgttagtttagttacgtttacgttaccgttccgttacggttacggtacgtacgggacgtacgtagtaccgttcgtacgtacgtcgaccacgacgtccgtcncccgtaccgtctacctcttccgtcctaccccg

SEQ ID NO: 2175 - DNA, 1026 bp, Homo sapiens
  misc_feature: GYAE6OF01B9AWO.45.75.G09.1.454.CMB.1.raw
tcagacgcgatcgacacgaccggtgctcgatttagtatagacatcagggggctgggggtctcaggaggcagcgctctcgggacgtctccaccatggcctgggctctgctattcctcaccctcctcactcagggcacagggtcctgggcccagtctgccctgactcagcctcgcctccctgtcgtggtctccgtggacagtcgatccacctactcccctgacctacgtcggactacccgaagggtccgggttaggtaaccgttttaacctttaggttttttaaacggtaattcggttccttacccgttaggggtttaacttccgaacgacccgtaaaaccgaaccccgaacggtacccgaaaaacccggacccccccctaaaaacctcctaaactttccgttaaattttacttaggtaactttacggttaacctaaaacgtttaaaccgtccccgggttacccccgtttaccgggttaccgggggttttacccttacggtaacttcccgtttccgtttcccgttccgggttaccggtaccccgttacccgtaaacggtttcccggtaacgggtaacccgttaaaacggttaccccgggtccccgtttacccccgtaccgtaacccgttaacgtttcccgtttcccgggttaccgggtaccgttaccccgggtaagggttaacccgtaaacggggtaaccgggtaaaccggggtaccgggttacccgtttaacgttaaacgttttaacctttacggttacggaccgtaaccgtacggtaaaacttagtttaaacttttacggttttaacggttttccgggttttaaccccgttaccgggttaccgggggtttacggttacccgggggtaacggggtaccgggttaaacccggtttaaacggttaccggggtttaaccccgttacccgggtttaccgggtacccgtacccgggaacccgttaaacccggggccccggttaccccgttacccccccgggtccggttaaccccttcccgggtttacccccg

SEQ ID NO: 2176 - DNA, 696 bp, Homo sapiens
  misc_feature: GYAE6OF01A2P3S.45.75.G09.1.454.CMB.1.raw
  modified_base (300)..(300): a, c, t, g, unknown or other
  misc_feature (300)..(300): n is a, c, g, or t
  modified_base (689)..(689): a, c, t, g, unknown or other
  misc_feature (689)..(689): n is a, c, g, or t
  modified_base (692)..(692): a, c, t, g, unknown or other
  misc_feature (692)..(692): n is a, c, g, or t
  modified_base (694)..(694): a, c, t, g, unknown or other
  misc_feature (694)..(694): n is a, c, g, or t
  modified_base (696)..(696): a, c, t, g, unknown or other
  misc_feature (696)..(696): n is a, c, g, or t
tcagacgcgatcgacacgaccggtgctcgatttagtatagacatcaggggtccctcagactctcgtgtgcagcctctggattcaccgtcagtggcagcttcctgagctgggtcccgccaggctccagggaagggcctggagtgggtctcagttaatttttagtacaggcacagcgtactacgcagacttccgttaagggccgattcaccatctccagagacaattccaggacacggttgtttcttagaaatgaaccaccctgacgacccgaggacacggctctatattactgtgcgaganactccgaaccagaacccggaagaacttctaccaactactacggtatggacgtcgtcggggaccaacggggacccaccgtccaccgttcctcctcacgtccctacccgacccgaacggggccccacgttcccgggttaccctttccccccgtccggacccctaccccctaccctacccgtaaaccgaccgaccgtaccccgtccggtacgggggaccgaccggaccggacccgggtccccggtcgggcccggtcgtcccggtcgggtaccgaaccggtaccgttacccgtttcccgtaccgtaacgttccggtccgttccggtggaccgggtaccggggccggttacgggacccgggaacgggcccggtccgaacgtaacgcgtacgcancgngngn

SEQ ID NO: 2177 - DNA, 805 bp, Homo sapiens
  misc_feature: GYAE6OF01EIYSS.45.75.G09.1.454.CMB.1.raw
  modified_base (146)..(146): a, c, t, g, unknown or other
  misc_feature (146)..(146): n is a, c, g, or t
  modified_base (590)..(590): a, c, t, g, unknown or other
  misc_feature (590)..(590): n is a, c, g, or t
  modified_base (603)..(603): a, c, t, g, unknown or other
  misc_feature (603)..(603): n is a, c, g, or t
tcagacgcgatcgacacgaccggtgctcgatttagtatagacatcgagggggggggtctcaggaggcagcgctcgtcgggacgtcctaccaccatcggccgtgggctctgctacttccctcctaccctcctcactcgacggcacgngggtcctcgggccctagtccgtcgccctacgactacgcgcccgttcgcccttcccgttggtcgttcggtcctccgtaggccacggtacgtactcccacctccctcccgtagacgtacgtggacctcggacggtcggtagttacgtttactttagttttagtactcgtcctcgtagtcgtacacgactaaccgaccgacgaaaccctaacccgaaccccatacctatttacgttattacgtacgttactactaaccgttaaaccgttacgggtccctccggtttacgggtttaacgggtcttaccttcggtcctttccgttaccgtacggtccgtacctaccgttacggtcgtaacgaccggttaaccgttccgtacccctcgtaaccgtacgtacccgttcgtaccggtaccgtcgtaccggcggtacgtacggagcggtagtnttacgtattcgtntcggttcacttcgtagtgacggtacggttcgttaaggttggtttagggtcccggtttagggtaccgggttacggacgggtaccggtaacgggttccggaaccggtacggttacccgggttaggaccggttaccggaacccgccggtttacccgtccccgttcccgggttaacctccccgggttacgtcccgggtttaccccg

SEQ ID NO: 2178 - DNA, 714 bp, Homo sapiens
  misc_feature: GYAE6OF01AKJOA.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgcttattttaaaaggtgtccagtctgaggagcagctgggtggaggtcgtgggggagtcgttggtccgagggcccgggggggttccctcgacgtaccttcgtcggtggtcgcacgtccttcgtgggtactttccgaccgtacgaggtcggccaggtccttccgtaggacggtcggtcggggtcccgccgacggcctccgggaaggggaacgggtccgtgggacggtgggttcctcgtaacggttttaagtttttacggaacgtacgggtacaacgtacggtaccgtacgtacgacgtagtaccgtttaccggttaacgggcctacgttaccaacctagtcctaccgaagacgtaaccgtaaacgttacccgaacgggtaaccgttacggtttacgtttaccgttaagaaacgttcgaaaccctacccgtaggaccgtaacccggacggtaccgacgtccgtactattacgtacgtgacgcgagtacgacaaccggaacccaggtaaccgaataacgtactaaccgaactacgtacggagtacggcgtaccggg

SEQ ID NO: 2179 - DNA, 757 bp, Homo sapiens
  misc_feature: GYAE6OF01BO4MM.45.75.G09.1.454.CMB.1.raw
  modified_base (324)..(324): a, c, t, g, unknown or other
  misc_feature (324)..(324): n is a, c, g, or t
tcagacgcgatcgacacgaccggtgctcgatttagtatagacatcgaggggggggtctcaggaggcagcgctcgtcgggacgtctccaccatggcctgggctctgctattcctcaccctcctcactcagggcacagggtcctgggcccagtctgccctgactcagcctgcctccctgtcgtgggtcctcgtggacagtccgatcaccactcccctgcactggactccgaggcggtagtacgtttacttagtttttaagattgtcctcgtggttagtcagaccaacgaccaggaccaaacgacccccaaactctatactatttanacgtatctactaaacgtaacgtccggaccttacggtacggggtttctacgacgttcgtactttcgtcgtcgctaccgagtcgcgtaacctacgtaccggtaccctccgacgtacctacgttccgtacgtacggtcctcgtaacgggtacgttagaaacggaacggtggtaaccgttagttaacgtttaagttaccgtacggactaccggactaaccggtaatttaagtttaccgtttaacgtttaccgttttacccggtaaccggtttcgggttaacggttacccgggtacggggtaaccggtacggtaaccggtttaccgggtaaccccgttacgtaccgggtttaacgaacccggtacccgttaaacgggtccctccccgggtaccccgttacggtacccgttaaccttcccccggttccgttaccccccg

SEQ ID NO: 2180 - DNA, 722 bp, Homo sapiens
  misc_feature: GYAE6OF01CGUJ2.45.75.G09.1.454.CMB.1.raw
  modified_base (222)..(222): a, c, t, g, unknown or other
  misc_feature (222)..(222): n is a, c, g, or t
  modified_base (240)..(240): a, c, t, g, unknown or other
  misc_feature (240)..(240): n is a, c, g, or t
  modified_base (416)..(416): a, c, t, g, unknown or other
  misc_feature (416)..(416): n is a, c, g, or t
tcagacgcgatcgacacgaccggtgctcgatttagtatagacatcagggggggggtctcaggaggcagcgctctcgggacgtctccaccatggcctgggctctgctattcctccaccctcctcactcgacgggcacgacggggtcctcgggccctagtctcgccctgactcagcctcgccctcctgtcgtggtcctcgtggacagtcgactcaccactcccngctgtgactcgagcagtnagttggtaggtaacttataccgttgtctccgtacggtaaccaacgacgacctaccgacggaaccaaccgacccctaaactacattaggttaaactttaggacgggacggtaacgtacggtaacggacccggtaccgttacggttaacggggtttacctaacgttccgtacgtttcnccggttacgcctacgtaagtccgagacctaaccggtccgtcccacgtacacgttactccgtcgacggtctcggacgtacgacgacggcggtacgtcttaacgtagtttacgtcgtctcgtctactactacgtagtcggaagttacggttaacggtttcgtttacgggttacgggttcggtacggggacgggtaaacgccgtaggtaccgtccggttaccggtaccggtacggtacctaccgggtacccgtacccgttccccccgtcggttacccgtacttccccgtcccgtttacccgtccccccg

SEQ ID NO: 2181 - DNA, 828 bp, Homo sapiens
  misc_feature: GYAE6OF01BIHHJ.45.75.G09.1.454.CMB.1.raw
tcagacgcgatcgacacgaccggtgctcgatttagtatagacatcaggggggggtctcaggaggcagcgctctcgggacgtctccaccatggcctgggctctgctattcctcaccctcctcactcacgggcacgagggtcctcgggcccagtctgccctgactcacgcctcgcctcccgtgttcgtcgggtctcctcggacctaggtcgtaactccaccgtacctcccctaggccgtaacgtcggtactccgtacggtccggtacgttaccgttttaagttttaggtttttaagttagttcgttccttaccgtaggttactacgtaaccgaccaaacccgtaaccgaaccggaaaccctaaacccgtaaaccccctaaactacctaaccttaccgttaagttttacgtaacgtaggtttaacctaagttaaaccggttaaccgtcccgggttacccgttacgggtttaaccggggtttcctaacccgtacgttcccgttacttccgtcgtaccggtacgtaccgtaacgtcggttacgaactaccgttcccggtaccctcggtactaccgtcttacgtcggtaccggtacctccggagttaccggtaagtaacccgggagttaccggtacgttagtaactttaccgtacgtacgtaacggacacttacggttaactttagttacttaccgtttaccggttacgtacggttttacggggacgtaccggggtaacgtacggtacgtaccgggttaggtacccgtcggttacggcaacccggtcgaccgtcccggaccctccgtacttactccgttccgccggttcccccg

SEQ ID NO: 2182 - DNA, 893 bp, Homo sapiens
  misc_feature: GYAE6OF01ESAB8.45.75.G09.1.454.CMB.1.raw
  modified_base (205)..(205): a, c, t, g, unknown or other
  misc_feature (205)..(205): n is a, c, g, or t
tcagacgcgatcgacacgaccggtgctcgatttagtatagacatcgagggggggagaggagcccagcactgggattccgaggttgtttccattcagtgatctgcactgaacacagaggactcgcatggagttggctagagtcgttgggttttccttgttcgtacttaattttaaaacggtcgtccaggtctaggaggagtcgagngttggtggtacggtcggtgggggagtccgttcggtaccggacgggtcccggggggtaccctacgaggtaccttcgtccggtggtgccgacgtccgtcgtagtaccgttaccgaacccgtacaggtacggactacgtccgttctaggtacggtccggtccgggtaccgaccgtaacggaccggttacccgggaaaggggggtaaccggacccgttaggggtaaggggtaccgggttacttaagggttaaaagtttttaaaccggtttttaacggaacggaaacggtaacccgaacggtaaccggtacgttaaaccgtaacccggaacgtaaacggtttacgttaacccggttaaacggggtccccttaaaacgtttaccaacccgtagttaccccgtacgaacgttaacccgaacttaaccgtacgaacgggttaaactacgggtttgtaacttaacgaaagttaccgaaccgtaacccgtacggaaccgtaacccggaaaggtacctcgtaacgttaacgttacttaactacggtcgacggtaacgtacggaacctaaccgtaacccgtaaacccgaacgggaaaacccgtaaactaaaccggttaaccctaacgaaacgttaaccgttagggtaacgtaaccgtacggttaacccggacgggtaaacccggaccgggttaacccccg

SEQ ID NO: 2183 - DNA, 248 bp, Homo sapiens
  misc_feature: GYAE6OF02HF2WQ.45.75.G09.1.454.CMB.1.raw
  modified_base (241)..(248): a, c, t, g, unknown or other
  misc_feature (241)..(248): n is a, c, g, or t
tcagacgcgatcgacacgaccggtgctcgatttagtatagacatcagggtcttcgtggctcacgtccaccaccacgcatgtgacctcagggtccgggagatcatgagggtgtccttgggtttggggaagaggaagactgacggtcccccaggagttcaggtgctgggcacagcggccctgggctgcctggtcaaggactacttcctcgatcgcgtctgagcgggctggcaaggcgcatagnnnnnnnn

SEQ ID NO: 2184 - DNA, 203 bp, Homo sapiens
  misc_feature: GYAE6OF02G2TYH.45.75.G09.1.454.CMB.1.raw
  modified_base (201)..(203): a, c, t, g, unknown or other
  misc_feature (201)..(203): n is a, c, g, or t
tcagacgcgatcgacacgaccggtgctcgatttagtatagacatcagggtccgggagatcatgagggtgtccttgggttttgggggaagaggaagactgacggtcccccaggagttcaggtgctgggcacagcggccctgggctgcctggtcaaggactacttcctcgatcgcgtctgagcgggctggcaaggcgcatagnnn

SEQ ID NO: 2185 - DNA, 529 bp, Homo sapiens
  misc_feature: GYAE6OF02I40W9.45.75.G09.1.454.CMB.1.raw
  modified_base (415)..(415): a, c, t, g, unknown or other
  misc_feature (415)..(415): n is a, c, g, or t
  modified_base (493)..(493): a, c, t, g, unknown or other
  misc_feature (493)..(493): n is a, c, g, or t
  modified_base (513)..(513): a, c, t, g, unknown or other
  misc_feature (513)..(513): n is a, c, g, or t
  modified_base (522)..(522): a, c, t, g, unknown or other
  misc_feature (522)..(522): n is a, c, g, or t
tcagacgcgatcgacacgaccggtgctcgatttagtatagacatcaggggctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccagccgggggggtccctcagactctcgtgtgcagcctctggattcaccgtcagtggcagcttcctgagctgggtcccgccaggctccgaggggaagggcctgggagtgggtctcagtaattttagacaggcacagcgtactacgcagattccgtaagggccattcaccatctccagagacaattccaggacacggtntttctgaatgaacaccctgacgacccgaggacacggctactatattactgtgcgagagatcgaacccagacccggaanaacttcacaactacacgtancggactcgngggaccg

SEQ ID NO: 2186 - DNA, 554 bp, Homo sapiens
  misc_feature: GYAE6OF02I9F57.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatctcctgcactggaaccagcagtgatggttgggagttataaccttgtctcctggtaccaacagcaccaggcaaagcccccaaatcatgattatgaggcagtaagcggccctcgaggggtttcaagtcgcttctctggctccaagtctacggcaacacggcctccctagacaactctcgtgggcctccgaggcgtggacgggcgaggctgattacttactgctgcctacattagtcgacgtagggaccaggcctacgtttggggtgttcgggcgggacgggaccgtagggttcgtaccggtccgtaggtcgacgccgaaggcctcggccccgttggcctacgtcttcccgg

SEQ ID NO: 2187 - DNA, 652 bp, Homo sapiens
  misc_feature: GYAE6OF02HCWEH.45.75.G09.1.454.CMB.1.raw
  modified_base (359)..(359): a, c, t, g, unknown or other
  misc_feature (359)..(359): n is a, c, g, or t
tcagacgcgatcgacacgaccggtgctcgatttagtatagacatctagggggggggggtctacaggaggccagccgtcgtctcgggacgtctccacagtggcctgggctctgcttattcctcaccctcctcactcagggcacgtaggggtcctgggcccaggtctgccctgactcagcctgcctcctgtctcgggtcctcctggactcgtccgactccaccatcccctgcactggactccgaggcggtgacgttactgttttaagatgtctctgtatcagcaacaccaggacaaacgaccccaaactcatctatttatgatgtacaaataatcggccctcgtagggtttcccccccctntactcgtcttctctgctcatctgcactacgcctcctcgacctactctcgtcgggtcctccgtacggcgtacgaaggacggagggtcgtagtaatttaacttaactcgtacacgacactattaattaatttaacgttcgtttaccgtacgttacgggttaacgttcggggtacgggtaacgggtaaccgtaacggttacggtaccggttaccggttaacgggttaccgacggtacccgtaacgggtaccgtcccggtccccggttaccggtccgtaccttccgttccgttcccc

SEQ ID NO: 2188 - DNA, 736 bp, Homo sapiens
  misc_feature: GYAE6OF02JK4FP.45.75.G09.1.454.CMB.1.raw
  modified_base (626)..(626): a, c, t, g, unknown or other
  misc_feature (626)..(626): n is a, c, g, or t
tcagacgcgatcgacacgaccggtgctcgatttagtatagacatcagggggagaggagcccagcactggattccgaggtgtttccattcagtgatctgcactgaacacagaggactcgccatggtagtttgggtcgtgagcgttggttttccgttgttgtcttaagtttaaaaggtgtcctagtcgtgaggagcagcgtggtggagtcgtggggaggtcgttcggtccgacggccggggtccgtcgagacgtcgtcgtgtgcgacgccgtcgtggtacgttaccgtaccgtccgtaggtacggaccgtacgtccgttaccgtacggtacggtccgtcgggtcccggtaccgacggtccgtaccggaacgggaacgggtaccgtacggtacggtacgggtaccgtacgtaacgttaaagttttaacgttaacgtaacggtacgtaacgtacgtaccgtaacgtaaccgtacgtaacgtaacgttaccggttaacgggtaccgtaacgttaccgtaaccgtaacgtaccgtaccgtaacgaacgtaacgtaaacgttaaccgtaacggtaacgtaacggttacgtttacgttagtaaacgtaacgtaaccgtaacccgtacgtaacgnaccgacgaccgaccgtaccgtacgtaacgtaacgtaactacgtcggtacgtacgtaacgtaacgtaccgtaaacccgaaccggaacccggtaaaccggtaaacgtaaccg

SEQ ID NO: 2189 - DNA, 563 bp, Homo sapiens
  misc_feature: GYAE6OF02HQ1C1.45.75.G09.1.454.CMB.1.raw
  modified_base (447)..(447): a, c, t, g, unknown or other
  misc_feature (447)..(447): n is a, c, g, or t
tcagacgcgatcgacacgaccggtgctcgatttagtatagacatcaggggggggggtcgtcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaacgacccccaaactcatctatttatgatgtacaataatcggccctcgtagggtttctcatcgtcttctctggctccaagtctggacaacgtacggtccctccctagacctactctcgtcgggcctccgaggctagaacgacgaggctagtattattactgctagacanactattattagttcgtttaccacgttcgggttattcgggacggacgggtacctagtcgtaccgtcgtacggtcacgccgaaggcctcgccccgtcgtccacttccgtcgttccccg

SEQ ID NO: 2190 - DNA, 504 bp, Homo sapiens
  misc_feature: GYAE6OF02H933C.45.75.G09.1.454.CMB.1.raw
  modified_base (293)..(293): a, c, t, g, unknown or other
  misc_feature (293)..(293): n is a, c, g, or t
tcagacgcgatcgacacgaccggtgctcgatttagtatagacatcaggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatccctgcactggatccagcggtgacgttactgtttttaagatgtctcctggtatcagcaacacccaggcaaagccccaaactcatgatttangatgtcagtaatcggccctcaggggtttctggatcgcttctctggctccaagtctggcaacacggcctcctcgaccatctctgggctccaggctgaggacgaggctgatttattactgcagctcatatgcacgcagcatgactctagtagttcggcggagggaaccaagctacgacccgtctaggtcacgccccaaggccctcgtcccccg

SEQ ID NO: 2191 - DNA, 203 bp, Homo sapiens
  misc_feature: GYAE6OF02FHWJJ.45.75.G09.1.454.CMB.1.raw
  modified_base (203)..(203): a, c, t, g, unknown or other
  misc_feature (203)..(203): n is a, c, g, or t
tcagacgcgatcgacacgaccggtgctcgatttagtatagacatcaggggtccgggagatcatgagggtgtccttgggttttgggggaagaggaagactgacggtcccccaggagttcaggtgctgggcacagcggccctgggctgcctggtcaaggactacttcctactgctaggtctgagcgggctggcaaggcgcatagn

SEQ ID NO: 2192 - DNA, 552 bp, Homo sapiens
  misc_feature: GYAE6OF02F6U66.45.75.G09.1.454.CMB.1.raw
  modified_base (298)..(298): a, c, t, g, unknown or other
  misc_feature (298)..(298): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccgtgtctgggtctcctggacagtcgatcaccatctcctgcactggaaccagcagtgatgttgggattataaccttgtctcctggtaccaacagcaccaggcaaacgcccccaaactcatgatttangaggcagtaagcggcctgaggggtttctaatcgcttctctggctccaagtctggcaacacggcctcctgacaatctcgtgggctccgaggctggaggacgaggctgattattactgctgctcatatgctaggtagttagttacgttttgggtgtttcgggacggagggaccaaggtctacggacccggttcgtagggtccacggtacccgaaggtccgtccggccccccttgggtccctaccgttccgttcccg

SEQ ID NO: 2193 - DNA, 514 bp, Homo sapiens
  misc_feature: GYAE6OF02GZ43Q.45.75.G09.1.454.CMB.1.raw
  modified_base (457)..(457): a, c, t, g, unknown or other
  misc_feature (457)..(457): n is a, c, g, or t
tcagacgcgatcgacacgaccggtgctcgatttagtatagacatcagggggctggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacaccccaggcaaagcccccaaactcatcatttatgatgtcaataatcggccctcaggggtttctcatcgcttctctggctccaagtctggcaatacgcctccctgaccatctctgggctccaggctgaagacgaggctgattattactgcagcacatatattagttgtttccacgttcgggtattcggngagggaccaagttcgaccgtcctaggtcacgccaaggctcgcccctcggtcactccg

SEQ ID NO: 2194 - DNA, 627 bp, Homo sapiens
  misc_feature: GYAE6OF02GN58C.45.75.G09.1.454.CMB.1.raw
tcagacgcgatcgacacgaccggtgctcgatttagtatagacatcagggggggggtcgtcaggaggcagcgctctcgggacgtctccaccatggcctgggctctggctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaacgcccccaaactcatcatttatgatgtacaataatccggccctcgtaggggtttctactatcgtcttctctgctcaagtctgcaatacgcctcctgaccatcgtcgtcgggcctccgaggctagaacgacggaggtctagtatttattactgacagacatatattagttagttcgtttacctacggttacgggttacgttcgggcgggtaacgggtaaccgttaaggttaccggtacccggttaccggttaacgggtaccgtaaccggtaccccgaacgggtacccgttacccggtaccccccgttacgggttaccctacccgttccgttacccggtttcccccccg

SEQ ID NO: 2195 - DNA, 516 bp, Homo sapiens
  misc_feature: GYAE6OF02HSX0T.45.75.G09.1.454.CMB.1.raw
  modified_base (236)..(236): a, c, t, g, unknown or other
  misc_feature (236)..(236): n is a, c, g, or t
  modified_base (409)..(409): a, c, t, g, unknown or other
  misc_feature (409)..(409): n is a, c, g, or t
  modified_base (421)..(421): a, c, t, g, unknown or other
  misc_feature (421)..(421): n is a, c, g, or t
  modified_base (429)..(429): a, c, t, g, unknown or other
  misc_feature (429)..(429): n is a, c, g, or t
  modified_base (443)..(443): a, c, t, g, unknown or other
  misc_feature (443)..(443): n is a, c, g, or t
  modified_base (509)..(516): a, c, t, g, unknown or other
  misc_feature (509)..(516): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagtacaggcacagcgtactacgcagattccgttaagggccgattcaccatctccagagacaattccaggaacacggtntttcttgaaatgaacaccctgagacccgaggacacggctctatattactgtgcgagagatcgaacccagacccgggaagaaattctaacaactactacggtatggacgtctggggccaagggaccaccgtcaccgtctctcagcctcaccaaggcccatcggtctcccctgcnccctcctccacngcacctcnggggcacagcgccngggctgcctggtcaagactactctcgatcgcgtctgacgcgggtctgggcaagggcgaccagtagnnnnnnnn

SEQ ID NO: 2196 - DNA, 566 bp, Homo sapiens
  misc_feature: GYAE6OF02I8J3O.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagtatgtctcctggtatcagcaacacccaggcaaacgcccccaaactcatgatttatgaggcagtaagccggccctcacggggtttctaatcgtcttctctggctccgaagtctggcaacacggcctccctgacaatctacgtggctccaggctcacggacgaggctgatttactttcgtgttcgcttcatatcgacgaggaccagctacggtttgggtgttcgggacgggaggaccgtaggttcgaccgttcgtaggtccacgcccgaacgggccttccggacccccttcgggtccctacttcccgttccgttccccgtcccc

SEQ ID NO: 2197 - DNA, 550 bp, Homo sapiens
  misc_feature: GYAE6OF02FP0DV.45.75.G09.1.454.CMB.1.raw
  modified_base (542)..(543): a, c, t, g, unknown or other
  misc_feature (542)..(543): n is a, c, g, or t
  modified_base (545)..(550): a, c, t, g, unknown or other
  misc_feature (545)..(550): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagacaggcacagcgtactacgcagattccgttaagggccgattcaccatctccagagacaattccaggaacacggtgtttcttgaaatgaacaccctgagacccgaggacacggctctatattactgtgcgagagatcgaacccagacccggaagaaattcacaactactacggtatggacgtctggggccaagggaccaccgtcaccgtctcctcagcctccaccaagggcccagtccgtcttccccctcggccacccctcctcccaacgacgccaccctcgtcgggggccacgacgccggcccgtgggcctcggcccgtggtccaacgggaccttaccttcctcgactcgcgtctgagcgggctgggcaaggcgcgataggnngnnnnnn

SEQ ID NO: 2198 - DNA, 548 bp, Homo sapiens
  misc_feature: GYAE6OF02G82QA.45.75.G09.1.454.CMB.1.raw
  modified_base (541)..(544): a, c, t, g, unknown or other
  misc_feature (541)..(544): n is a, c, g, or t
  modified_base (546)..(548): a, c, t, g, unknown or other
  misc_feature (546)..(548): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagtacaggcacagcgtactacgcagattccgttaagggccgattcaccatctccagagacaattccaggaacacggtgtttctgaaatgaacaccctgagacccgaggacacggctctatattactgtgcgagagatcgaacccagacccggaagaaattctacaactactacggtatggacgtctggggccaagggaccaccgtcaccgtctcctcagcctcaccaagggcccatccggtcttccccctggccaccctccctcccaacgacgccacctcgtcggggccacgacgccggcccgtgggcctcggccgtgggtccaagggtacctaccttcctcgacgtcgcgtctgacgcgggcgtggcgaacggcgcagtagnnnncnnn

SEQ ID NO: 2199 - DNA, 546 bp, Homo sapiens
  misc_feature: GYAE6OF02GTK0X.45.75.G09.1.454.CMB.1.raw
tcagacgcgatcgacacgaccggtgctcgatttagtatagacatcagggggctggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgttttaagtatgtctcctggtatcagcaacacccaggcaaagcccccaaactcatcatttatgatgtcaataatcggccctcgaggggtttctcatcgctttctctggctccaagtctgacaatacgccctccctgaccatctactgggcctccaggctagaagacgaggctgaattattactgcagcaacgattaattatttagttgtttccacgttcgggtattccgggcggagggtaccctaaggttcgtacccggtccttagggtccaggtcccaaggcctccggccccctggtaccacttccg

SEQ ID NO: 2200 - DNA, 521 bp, Homo sapiens
  misc_feature: GYAE6OF02HT437.45.75.G09.1.454.CMB.1.raw
  modified_base (329)..(329): a, c, t, g, unknown or other
  misc_feature (329)..(329): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacaggcgatcaccatcctcctgcactggaaccagcagtgacgttggttattataactatgtctctggtaccaacaacacccaggcaaagcccccaaactcatgatttatgatgtcagtaatcggccctcaggggtttcngatcgcttctctgctcaagtctggcaacgcggcctcctgaccatctcgtgggcctcgaggtctgaggacgaggctagtattattactgcagctcatatgacacgcagcatgactcgtagtattcggacggacggacaaggctacggacccgtccgtaggtccaacggccccgaaggtccctacggtcccccg

SEQ ID NO: 2201 - DNA, 555 bp, Homo sapiens
  misc_feature: GYAE6OF02H732Y.45.75.G09.1.454.CMB.1.raw
tcagacgcgatcgacacgaccggtgctcgatttagtatagacatcaggggctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccagccgggggggtccctcagactctcgtgtgcagcctctggattcaccgtcagtggcagcttcctgagctgtgtccgccaggctccgagggaggcctggagtgggtctcagttaattttagacaggcaacagcgtactacgcagattccgtaagggcccgtatccaccagtctccagagacaacttccagaacacggttgtttcttagaaattgaactacccgtgacgaacccgaggacacggctacgtatattactgtagcgagagactccgaacccgaggaacccggaagaaacttcaaccaactaccgtaacggtatacggacgtcgtacgggg

SEQ ID NO: 2202 - DNA, 529 bp, Homo sapiens
  misc_feature: GYAE6OF02F6UMN.45.75.G09.1.454.CMB.1.raw
  modified_base (300)..(300): a, c, t, g, unknown or other
  misc_feature (300)..(300): n is a, c, g, or t
  modified_base (331)..(331): a, c, t, g, unknown or other
  misc_feature (331)..(331): n is a, c, g, or t
  modified_base (369)..(369): a, c, t, g, unknown or other
  misc_feature (369)..(369): n is a, c, g, or t
  modified_base (389)..(389): a, c, t, g, unknown or other
  misc_feature (389)..(389): n is a, c, g, or t
  modified_base (440)..(440): a, c, t, g, unknown or other
  misc_feature (440)..(440): n is a, c, g, or t
  modified_base (462)..(462): a, c, t, g, unknown or other
  misc_feature (462)..(462): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggccaaagcccccaaatcatcaatttangatgtacaataatcggccctgtagggtttcnctatcgcttctctgctcagtctggacatacgcctcccngaccatctctgggtctaccnggcctagaagtcgaggtctagatttatactgcagctacattatagttagtntttccagttcgggttatccggnggacggactagttcgaccgtcgtggtcacgcccaagcctcgcccctaggtcacgttcctcgttcccc

SEQ ID NO: 2203 - DNA, 785 bp, Homo sapiens
  misc_feature: GYAE6OF02IQ4BE.45.75.G09.1.454.CMB.1.raw
tcagacgcgatcgacacgaccggtgctcgatttagtatagacatcaggggctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccaggccgggggggtccctcgagactctcgtgtgcagcctctggattcaccgtcagtggcagcttcctgagctgggtccgccaggcctccgagggaacgggcctgggacgtgggtctcgagttaattttagtacaggcacagcgtactacgctagacttaccggttaacgggccgtaattccgaacctattccctaccgaaggaacggtaacctaaacgtttcccgaaagggtaaaccgtacgggtttacgttttaccgtttaaggaaaacgttacgtaaaccgtaccccgtacggtaaaccggaacccccgggtaagggaaaccgtaacccggggtacccttaacccgttaaacgtttaacgtttaacccgttagggttaccggtaaccggtaaggtaaccggtaaccgttaccccgggaaaacccccggtacggtaaaaccccccggggtaaagttaaaacccgtttacccgtaaaacccgtaaaacccgtttaacgttaaacccgggggttaacttaaccgggggtaacccggttaccgggttacccggggggtaaaaccccggg

SEQ ID NO: 2204 - DNA, 450 bp, Homo sapiens
  misc_feature: GYAE6OF02IEVW3.45.75.G09.1.454.CMB.1.raw
  modified_base (444)..(450): a, c, t, g, unknown or other
  misc_feature (444)..(450): n is a, c, g, or t
tcagacgcgatcgacacgaccggtgctcgatttagtatagacatcagggggaagaccgaagggcctggagtgggtctcagtaatttttagtacaggcacagcgtactacgcagattccgttaagggccgattcaccatctccagagacaattccaggaacacggtgtttcttgaaatgaacaccctgagacccgaggacacggctctatattactgtgcgagagatcgaacccagacccggaagaaattctacaactactacggtatggacgtctggggccaagggaccaccgtcaccgtctcctcagcctccaccaagggcccatcggtcttccccctggccaccctcctccaagacgcacctctgggggcacagcggccctgggctgcctggtcaaggactactcctcgatcgcgtctgagcgggctggcaaggcgcatagnnnnnnn

SEQ ID NO: 2205 - DNA, 755 bp, Homo sapiens
  misc_feature: GYAE6OF02ICFX1.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggtttccttgttgctatttaaaggtgtccagtctgaggagcagctggtggagtcgtgggggaggtcttgggtccgaggccgggggggtcctcgagactcgtcgtgtgcagcctgtggattcacgtcagtggcagtcttctgagtcgtcgggtcccgccgaggccttccggagggaacgggccgtagggaggttcgggttctacgtaagttaacgtttttagacgtaggctacgacgtcgtactacgcgaagtacgtttaccggttaaacgggccgtaacttccgaaccgtactaccgtacccgtaacggaacgtaaaccgtaaactttccgaaacggtaaaccgtaccgggttacgttttaccgttaaggtaaacgtacgtaaaccctaacccgttacggaaccggaacccggaacgggtaaccgtaaccggtaccttaaccgtaacgtttaacttaaccggttaggtaacggtaccggtaagtacgtaaccgttacccggaaaccccgtaacgggtaaccccggtaaaacggttaaaccgttaaccgttaaccgaaaccgttaaccgttaaccgggtaagttaccgggtaaccggttaaccgggg

SEQ ID NO: 2206 - DNA, 544 bp, Homo sapiens
  misc_feature: GYAE6OF02IY0YG.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaacgcccccaaactcatcatttatgatgtcaataatcggcctcgtaggggtttctcatcgcttctctgctcaagtctgcaatacgcctccctgaccatctcgtggcctccgagctgaagacgaggctgattattactgcagcactataattattagtgtttaccacgttcgggttagttcgggcggaacgggtacctaagttcgaccgttcgtacggtcacgcccgaaggcctcgtccccgtcggtcctaccgttcctcgttaccccc

SEQ ID NO: 2207 - DNA, 572 bp, Homo sapiens
  misc_feature: GYAE6OF02F7E3U.45.75.G09.1.454.CMB.1.raw
  modified_base (370)..(370): a, c, t, g, unknown or other
  misc_feature (370)..(370): n is a, c, g, or t
  modified_base (566)..(566): a, c, t, g, unknown or other
  misc_feature (566)..(566): n is a, c, g, or t
  modified_base (568)..(571): a, c, t, g, unknown or other
  misc_feature (568)..(571): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagtacaggcacagcgtactacgcagattccgttaagggccgattcaccatctccagagacaattccaggaacacggtgttcttgaaatgaacaccctgagacccgaggacacggctctatatactgtgcgagagatcgaacccagacccggaagaaattctacaactactacggtatggacgtctggggccaagggaccaccgtcaccgtcncctcagcctccaccaagggcccatccggtcttccccctcggccaccctcctccaacgacgccacctcgtcggggccacgacgccggcccgtcgggctcggccctcgggtccgaacggaccttaccgttcccgttaccgtacgtctacggtctagacgtcgggcgtacgggcgaacggcgaccgacgtacgacgtgnannnnc

SEQ ID NO: 2208 - DNA, 555 bp, Homo sapiens
  misc_feature: GYAE6OF02GJADG.45.75.G09.1.454.CMB.1.raw
  modified_base (542)..(542): a, c, t, g, unknown or other
  misc_feature (542)..(542): n is a, c, g, or t
  modified_base (548)..(555): a, c, t, g, unknown or other
  misc_feature (548)..(555): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagtacaggcacagcgtactacgcagattccgttaagggccgattcaccatctccagagacaattccaggaacacggtgtttcttgaaatgaacaccctgagacccgaggacacggctctatattactgtgcgagagatcgaaccccagaccccggaagaaattctaacaactactacggtatggacgtctggggccaagggaccaccgtcaccgtctcctcagcctccaccaagggcccatccggtccttcccctggccaccctcctcccaacgacgccacccgtcgtcgggggccacgacggccggcccgtcggggcctcggcctgggtcaacggactaccttccctcgactcgcgtcgtgacgcgggcgtggcgaaggccgnagtagnnnnnnnn

SEQ ID NO: 2209 - DNA, 527 bp, Homo sapiens
  misc_feature: GYAE6OF02IUXPP.45.75.G09.1.454.CMB.1.raw
  modified_base (420)..(420): a, c, t, g, unknown or other
  misc_feature (420)..(420): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatccccctgcactggatccagcggtgacgttactgtttttaagatgtctcctggtatcagcaacacccaggcaaagcccccaaactcatcatttatgatgtcagtaatcggccctcaggggtttctgatcgcttctctggctcaagtctggcaacacgctcctgaccatctctgggctccagctgaggacgaggctgatttattactgcagctcatntgacacgcagcatgactagtagttagttcgggcggtaaggggaccaaggtcctacggacccgtttccgtaacggtcacggacccgaaaggcccgtcgtaccccccgg

SEQ ID NO: 2210 - DNA, 587 bp, Homo sapiens
  misc_feature: GYAE6OF02F2TNP.45.75.G09.1.454.CMB.1.raw
  modified_base (293)..(293): a, c, t, g, unknown or other
  misc_feature (293)..(293): n is a, c, g, or t
  modified_base (352)..(352): a, c, t, g, unknown or other
  misc_feature (352)..(352): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccagcagtgatgttgggattataaccttgtctctggtacaacagcaccaggcaaagcccccaaatcatgattangaggcagtaagcggccctgaggggtttctaatcgcttctctggctcaagtctggcaacncggcctcctagacaatctcgtgggctccgaggctgacggacgaggctgtattattactgtctcgctctatagtcgcgacgggaccagtacctacggtttgggttacggttcgggacgggtaacggggtaccgtacggggttacggtaccccggttccggtacgggtacgacccggtcccgtaacggtccgtacccggcccccggttccggtccctaccgttcccgttacccccgg

SEQ ID NO: 2211 - DNA, 537 bp, Homo sapiens
  misc_feature: GYAE6OF02FV69B.45.75.G09.1.454.CMB.1.raw
  modified_base (299)..(299): a, c, t, g, unknown or other
  misc_feature (299)..(299): n is a, c, g, or t
  modified_base (419)..(419): a, c, t, g, unknown or other
  misc_feature (419)..(419): n is a, c, g, or t
  modified_base (441)..(441): a, c, t, g, unknown or other
  misc_feature (441)..(441): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctgggggaggcttggtccagccgggggggtccctcagactctcgtgtgcagcctctggattcaccgtcagtggcagcttcctgagctgggtccnccaggctccagggaagggcctggagtgggtctcagtaatttttagacaggcacagcgtactacgcagattccgttaagggccgattcaccatctccagagacaattccaggaacacggtntttcttgaaatgaaccaccctnacgacccgaggacacggctctatacttactgtgcgagagactcggaacccaggaacccggaagtaaacttcaacaactactacggatggagtccgg

SEQ ID NO: 2212 - DNA, 573 bp, Homo sapiens
  misc_feature: GYAE6OF02HIZ97.45.75.G09.1.454.CMB.1.raw
  modified_base (566)..(573): a, c, t, g, unknown or other
  misc_feature (566)..(573): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagacaggcacagcgtactacgcagattccgttaagggccgattcaccatctccagagacaattccaggaacacggtgtttctgaaatgaacacctgagacccgaggacacggctctatattactgtgcgagagatccgaacccagacccggaaagaaacttcaacaactacgtacggtatggacgtcgtggggccaagggacccaccggtcaccgtctcctcacgccctccaaccgaacgggccccagttccgggttcccttcccccgtcggcccacccctccctacccaacgacgccacccgtcgtcgggggccaccgcggccggcccgtgggctcgccgtggtcgaacggtcctacttccgtcgacgtccgcgtctgcgcgggcgtcggcgaacggcgacacgtgnnnnnnnn

SEQ ID NO: 2213 - DNA, 577 bp, Homo sapiens
  misc_feature: GYAE6OF02IFRH4.45.75.G09.1.454.CMB.1.raw
  modified_base (217)..(217): a, c, t, g, unknown or other
  misc_feature (217)..(217): n is a, c, g, or t
  modified_base (569)..(569): a, c, t, g, unknown or other
  misc_feature (569)..(569): n is a, c, g, or t
  modified_base (572)..(577): a, c, t, g, unknown or other
  misc_feature (572)..(577): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagtacaggcacagcgtactacgcagattccgttaagggccgattcaccatctccaganacaattccaggaacacggtgtttcttgaaatgaacaccctgacgacccgaggacacggctctatattactgtgcgagagatccgaaccagacccggaagaaacttcaacaactactacggtatgggacgtcgtcggggaccaagggaccctaccgtcaccgtcctcctcacgcctaccaaccgaacggcccagtccggtccttcccccgtcgccctacccctcctaccaacgacgccacctcgtcggggcacgacgccggacccgtcgggctcgcctcggtaccaacggtacctaccgttccgtcgtacttcgcgtcgtgacgggcggtcgtcggcgacgggcgacagtagncgnnnnnn

SEQ ID NO: 2214 - DNA, 697 bp, Homo sapiens
  misc_feature: GYAE6OF02IPN6F.45.75.G09.1.454.CMB.1.raw
  modified_base (257)..(257): a, c, t, g, unknown or other
  misc_feature (257)..(257): n is a, c, g, or t
tcagacgcgatcgacacgaccggtgctcgatttagtatagacatcagggggggggagaggagcccagcactgggattccgaggtgtttccattcagtgatctgcactgaacacagaggactcgccatggagtttgggctgagctgggttttcctgttgctatttaaagtgtcagtctgaggagcagctggtggagtctgggggaggcgttggtccagccgggggggtccctcaggactctcgtgtgcagcctctggntttcaccgtcagtggcagcttcctgagctcgggtccgccagggcctccgaggggaacggggcccgtgggaggttcgggtcttcgaaggttaattttttacggacaggtcacgtagcgtactacgcagtacgttaccgttaagggccgtattcgaccagttcccgtccaggaacgtacctaaactttcccgaagggtaaacctacggtttacggtttacttaggtaaaacttcggaaacctaacccctgggaaacgaccccggaagggtaaccgaccgggtccttacgtatttacgtttaacgtgttcgaacgtagaacgtaccgtacgaaccccgacggtaacccgggaaagtaaactttaccgaaccgtaaaccttaccggttaaggttaacgttcgggtaccggttacggtacgggggtaccctaaaggggtaccccg

SEQ ID NO: 2215 - DNA, 566 bp, Homo sapiens
  misc_feature: GYAE6OF02IZR5W.45.75.G09.1.454.CMB.1.raw
  modified_base (235)..(235): a, c, t, g, unknown or other
  misc_feature (235)..(235): n is a, c, g, or t
  modified_base (557)..(557): a, c, t, g, unknown or other
  misc_feature (557)..(557): n is a, c, g, or t
  modified_base (561)..(561): a, c, t, g, unknown or other
  misc_feature (561)..(561): n is a, c, g, or t
  modified_base (563)..(566): a, c, t, g, unknown or other
  misc_feature (563)..(566): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagacaggcacagcgtactacgcagattccgttaagggccgattcaccatctccagagacaattccaggaacacggtntttctgaaatgaacaccctgacgacccgaggacacggctctatattactgtgcgagagatcgaacccagacccggaagaaattctaacaactactacggtatggacgtcgtggggccaagggacccaccgtcaccgtctcctcacgcctccaaccaagggcccatccggtccttcccctcggccaccctcctccgaacgcgccacctcgtcggggccacgacgccggtcccgtgggcctcgccgtcggtaccaacggtacctaccgttcctacgactcggtcgtcgtcggacgcggcgtcggacaacggccgacgacgtagnagcngnnnn

SEQ ID NO: 2216 - DNA, 558 bp, Homo sapiens
  misc_feature: GYAE6OF02HMH5R.45.75.G09.1.454.CMB.1.raw
  modified_base (551)..(557): a, c, t, g, unknown or other
  misc_feature (551)..(557): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctgggagtgggtctcagttaatttttagtacaggcacagcgtactacgcagattccgttaagggccgattcaccatctccagagacaattccaggaacacggtgtttcttgaaatgaacacctgagaccgaggacacggctcatattactgtgcgagagatcgaacccagacccggaagaaattcacaactactacggtatggacgtctggggcaagggaccaccgtcaccgtctcctcacgcctccacacggcccagtccggtccttccccgcggcccaccctccctcccaacgacgccacctcgtcggggccacgacgccggcccgtgggcctggcccgttggtaccgaacggaccttaccgttcccttcgactcgtcgtcgtgacgcgggctcgggcaacgggcgacgagtagnnnnnnnc

SEQ ID NO: 2217 - DNA, 722 bp, Homo sapiens
  misc_feature: GYAE6OF02ISUB3.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatccccctgcactggatccagcggtgacgttactgtttttaagtatgtctcctggtatcagcaaccaccccaggaccaaacgcccccaaaactcatgtaactttatagatgtcaagttaactccggcccttacgtacggggttttctggtattccgtctttcctcgttcggccttaccctaaacggttccgtaggcctaaaccgtaccggtccccttccccgtacgaacccctaacttcccgtccgtcggggtccctcccggacggtccgtgggaacggaccggacgggtcgttaggtaatttacgttaacgtggaccgtaggtccttactaagttaacgtgacccgtcgtaccgaggtacctaaccgtacgttaccttacgttaacggttacggttcccggggaacgggaaccggggtaacccgtaaacgggtcccgttaacgggtaaccccgttcggtaaccgggtaccgtaaccgggtaccccgtaaacgggttcccgtacccggttaccccccgg

SEQ ID NO: 2218 - DNA, 614 bp, Homo sapiens
  misc_feature: GYAE6OF02IC5TB.45.75.G09.1.454.CMB.1.raw
  modified_base (248)..(248): a, c, t, g, unknown or other
  misc_feature (248)..(248): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgccactggactccagcggtgacttacttgtttttaagntgtctctggtatcagcaacaccaggcaaacgcccccaaactcaatcattttatgtatgtacaataatcggcccttcgtaggggtttctcatcgtcttctctcgtctcctaagtctggacaatccggcctccctcgaccattcctcgtaggcctccgaggtctaggaaacgacggaggtcttgtaatttattacgtgctagacactattattaagttaggttacgtttacccacggttcgggttacttcggggacggtacgggtaacctaaggttccgaccggttccgtaaggtcctacggtaccccgttaaggttcccgtacccccggttcggtacctaccgttccttccggttccccctaccccg

SEQ ID NO: 2219 - DNA, 539 bp, Homo sapiens
  misc_feature: GYAE6OF02HCE2V.45.75.G09.1.454.CMB.1.raw
  modified_base (467)..(467): a, c, t, g, unknown or other
  misc_feature (467)..(467): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatctcctgcactggaaccagcagtgatgttgggagttataaccttgtctcctggtaccaacagcacccaggcaaagccccccaaatcaatgatttatgagggcagtaagcggcctcgaggggtttctaatcgcttctctcggctccaagtctggacaacaccggcctcccgtgaccaatcctacgtgggcctccgaggctggaggacgaggctgattattactgctgctcatatgacgaggtagtagtacgtttggtgttcggnggacggaccgagtcgtgaccgtcctaggtcacgcccgaaggcctccgccccgttcggtccaccttcgtcccg

SEQ ID NO: 2220 - DNA, 568 bp, Homo sapiens
  misc_feature: GYAE6OF02HWFTX.45.75.G09.1.454.CMB.1.raw
  modified_base (297)..(297): a, c, t, g, unknown or other
  misc_feature (297)..(297): n is a, c, g, or t
  modified_base (359)..(359): a, c, t, g, unknown or other
  misc_feature (359)..(359): n is a, c, g, or t
  modified_base (411)..(411): a, c, t, g, unknown or other
  misc_feature (411)..(411): n is a, c, g, or t
tcagacgcgatcgacacgaccggtgctcgatttagtatagacatcagggggggggtctcaggagacagcgctctcgggacgtctccaccatggcctgggctctgctattcctcaccctcctcactcagggcacagggtcctgggcccagtctgccctgactcagcctgcctccctgtctgggtctcctggacagtcgatcaccatctcctgcactggaaccagcagtgatgttgggattataaccttgtctcctggtaccaacagcaccaggcaaacgcccccaaactaatcattanagggacactaagccggtaccgtcggggtttcaagtcgcttctcgtgtctcaagtctgcaacncggcctcctgacatctctggctccagctacaggacgaggctgatttattcgngttagctctatatgcgagggaccagactacgttgggtcggttcggcgggagggaaccgtaggttccgaccgttccgtaggtcacggcccgtaaggtcctcccgcccccgtcgggtaccaccgttccttaccggtttcccctaccccgttcctacccg

SEQ ID NO: 2221 - DNA, 779 bp, Homo sapiens
  misc_feature: GYAE6OF02GRA4K.45.75.G09.1.454.CMB.1.raw
  modified_base (294)..(294): a, c, t, g, unknown or other
  misc_feature (294)..(294): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctcgccctgactcagcctgcctccctgtctgggtcctctggacagtcgatccaccactcccctgcacgtggaaccagcagtgatggttgggattactaaccttgtctcctggtaccacagcaccgagacaaacgaccccaaacncatgtaattagtggaggcagtaacgcgtcctcgtagggtttctaagtcgtcttctcgtcggtcctacgaagtctcggacaaccgaccgccctacccgtacgaccctactccgttaccgtcgggaccctccgacggtcgtacggaaacggacggacggtcgttacggtaactttacttaaaccgtgtaaccctacggtacctaaccttaagttaactttaagttttaacgggtttacggttttaacccctaaccgggttttaccggggtttaacggtttacccggggggtaccggggtaaaccggggttaaccgttaaaacggggtttaccggtaacccggtttacccggtttaacgggttacccggtaaacccgggtaacccggtaaaccggggtccccgttaccccggtaccccccggttaccgggttacccgtaaccccgttcggtttcccccggtttaccccccggtccccctttaccccgg

SEQ ID NO: 2222 - DNA, 701 bp, Homo sapiens
  misc_feature: GYAE6OF02I2ROR.45.75.G09.1.454.CMB.1.raw
  modified_base (265)..(265): a, c, t, g, unknown or other
  misc_feature (265)..(265): n is a, c, g, or t
  modified_base (278)..(278): a, c, t, g, unknown or other
  misc_feature (278)..(278): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctcgcctcctgtctggtctcctggacagtcgatcacccatcccctgcactcggatccagcggttgacgtttactgtttttaagatcgtctcctgtatcancacaccagcaaanccccaactcatcatttatgatagttacaataactcggcccgttcacgggtttctcattccgcttctctgcttcctaagtctggactaactaccggtcctaccctgtacccacttctcctacggggtcctacccgtagggtcctacgggaaacggaccggtacgggtacctttaggtaaacttttacgtttaacctcggttaacgtaccgtacgttaactttaaggtttaacgttttaacggttaccggtttttaccctaacggtttacccgggggttaacgttttacggggaccgggtaacgggtaacccgtaagggtttccggaccgttaccggtacggtaccgaacggtaccccgtaacgggtccgtaccggccccgttacggtcccttacccgtcccgttacccggtttccccctccccg

SEQ ID NO: 2223 - DNA, 608 bp, Homo sapiens
  misc_feature: GYAE6OF02I6ULO.45.75.G09.1.454.CMB.1.raw
  modified_base (120)..(120): a, c, t, g, unknown or other
  misc_feature (120)..(120): n is a, c, g, or t
  modified_base (129)..(129): a, c, t, g, unknown or other
  misc_feature (129)..(129): n is a, c, g, or t
  modified_base (137)..(137): a, c, t, g, unknown or other
  misc_feature (137)..(137): n is a, c, g, or t
  modified_base (147)..(147): a, c, t, g, unknown or other
  misc_feature (147)..(147): n is a, c, g, or t
  modified_base (153)..(153): a, c, t, g, unknown or other
  misc_feature (153)..(153): n is a, c, g, or t
  modified_base (603)..(604): a, c, t, g, unknown or other
  misc_feature (603)..(604): n is a, c, g, or t
  modified_base (607)..(608): a, c, t, g, unknown or other
  misc_feature (607)..(608): n is a, c, g, or t
tcagacgcgatcgacacgaccggtgctcgatttagtatagacatcaggggtccctcagactctcgtgtgcagcctctggattcaccgtcagtggcagcttcctgagcgtggtcgcaggcncaggaggcngagtggcnagtatttganagcacngcgtacacgcagatcgtaaggccatcacatctccagagacaattccgaggaacacggtgtttctagaaatgaacaccctgacgaccgaggacacggctactaatattactgtgcgagagatacggaacccaggaacccggaagaaacttccgaacaacttactaacggtatggaccgtcgtacggggaccaacggggtacccacggtccgaacgtctccgtcacgtcctaccgaaccgaacgggcccagttccggtccttccccgtcggtacccacccttacccgtacctaacggacaccaccgtcggcggggccacgacggccggtccctcgggtctcggtccgtacggtacaacgggtacctttaccgttaccgtcgtacgttcggtaccgttacgtacgacggtcgggtcgtacggcggaacgggcgtaccgagtacggcgtacgcnnagnn

SEQ ID NO: 2224 - DNA, 593 bp, Homo sapiens
  misc_feature: GYAE6OF02H8HM4.45.75.G09.1.454.CMB.1.raw
  modified_base (212)..(212): a, c, t, g, unknown or other
  misc_feature (212)..(212): n is a, c, g, or t
  modified_base (222)..(222): a, c, t, g, unknown or other
  misc_feature (222)..(222): n is a, c, g, or t
  modified_base (228)..(228): a, c, t, g, unknown or other
  misc_feature (228)..(228): n is a, c, g, or t
  modified_base (340)..(340): a, c, t, g, unknown or other
  misc_feature (340)..(340): n is a, c, g, or t
  modified_base (587)..(587): a, c, t, g, unknown or other
  misc_feature (587)..(587): n is a, c, g, or t
  modified_base (589)..(590): a, c, t, g, unknown or other
  misc_feature (589)..(590): n is a, c, g, or t
  modified_base (592)..(593): a, c, t, g, unknown or other
  misc_feature (592)..(593): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccgagggaagggcctggagtgggtctcgagttaatttttagacaggcacagcgtactacgcagattccgtaagggcattcacatctcagnacatcagacngtgttntgaaatgaacacctgagacccgaggacacggctctatagtactgtgcgagagatacgaaccagacccgaaagaacttctaaccaataaccgtacggtaatggaccgttacgnggggaccaaggggacccacgtcaccggtctcccgtacacgcctacaacccgtaaggcccagtccgtccttcccccgtcggccaccctcctaccgaacgacgaccaccgtcgcggggaccacgacggtccgcccgtcggactccgcgtacggtcgaacggtacctaccgttcgtccgtacgtccgtcgtaccgttcggaccgtaccgggtcgttacggcggtaaccggcgtacggactacgagcgcgngnngnn

SEQ ID NO: 2225 - DNA, 575 bp, Homo sapiens
  misc_feature: GYAE6OF02HN6AF.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggagcttggtccaggccggggggtccctcgagactctcgtgtgcagcctctggattcaccgtcagtggcagcttcctgagctggtccgcaggctccagggacggcctggagtgggtctcagttaattttagacgaggcacagcgtaactacgcagtacgtttccgttaagggccgtattccaaccatctccaagagactaacttaccaggaactacggttgtttacgttacgtaaatcgaaccacccgtgacgacccgaggaccacggtctactattacttactgtcgacgagagactacgaacccgacgaacccggaagaaacttactaacgaactaacgttacggtattacggacgttacgg

SEQ ID NO: 2226 - DNA, 587 bp, Homo sapiens
  misc_feature: GYAE6OF02IVYAG.45.75.G09.1.454.CMB.1.raw
  modified_base (358)..(358): a, c, t, g, unknown or other
  misc_feature (358)..(358): n is a, c, g, or t
tcagacgcgatcgacacgaccggtgctcgatttagtatagacatcagggggggggtctcaggaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatgttgggattataaccttgtctctggtaccaacagcacccaggcaaagcccccaaactcatgattatgaggcagtaagcggccctgagggtttctaatcgtcttctctggcctccaagtctcggcaacncggcctccctgacatctctggctccgagctgagacgagctgattattacgtgctgctactatagtgacgtagggttagttagttacgttttgggttcggttccgggacgggtacgggaccgtaaggtccgtacgggtaaccccgttccggttaacggtaccgtaaccggtaccccgtaacggggtcccttacccggtacccccccgtttacgggtacccttaaccccgg

SEQ ID NO: 2227 - DNA, 512 bp, Homo sapiens
  misc_feature: GYAE6OF02G4637.45.75.G09.1.454.CMB.1.raw
  modified_base (484)..(512): a, c, t, g, unknown or other
  misc_feature (484)..(512): n is a, c, g, or t
tcagacgcgatcgacacgaccggtgctcgatttagtatagacatcagggggaagaccgaagggcctggagtgggtctcagtaatttttagtacaggcacagcgtactacgcagattccgttaagggccgattcaccatctccagagacaattccaggaacacggtgtttcttgaaatgaacaccctgagacccgaggacacggctctatattactgtgcgagagatcgaacccagacccggaagaaattctaacaactactacggtatggacgtcgtggggccaagggaccaccgtcaccgtctcctcagcctccaccaagggcccatcggtcttcccccctggccacccctcctaccaagacgccacctcgtgggggccacacggacggcccctaggggctcgcctgggtccaaagggactaacttcctcgagtccgcgtcgtcgaggccgggcgtggcaaacgggtcgcgactaggctgcannnnnnnnnnnnnnnnnnnnnnnnnnnnn

SEQ ID NO: 2228 - DNA, 572 bp, Homo sapiens
  misc_feature: GYAE6OF02FJQUD.45.75.G09.1.454.CMB.1.raw
  modified_base (304)..(304): a, c, t, g, unknown or other
  misc_feature (304)..(304): n is a, c, g, or t
  modified_base (410)..(410): a, c, t, g, unknown or other
  misc_feature (410)..(410): n is a, c, g, or t
  modified_base (501)..(501): a, c, t, g, unknown or other
  misc_feature (501)..(501): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctggggggaggcttggtccaggccgggggggtcccctcgagactctcgtgtgcagcctctggattcaccgtcagtggcagcttcctgagctggggtccnccgaggcctccgaggggaacggggcctgggaggtgggtctcgagttaatttttagacagggcacgagcgtactacgcagtattccggtaagggcctatcaccatcnccagacaactaattccgaaggaaccacggtgtttacttagaaattcgaaccaccctagacgacccgaggacgaccgctctaatatacgtgngcgtagagactaccgaaccgacgaaccccggaagtaacttacaacaactactacggtacgtggacgtacgg

SEQ ID NO: 2229 - DNA, 724 bp, Homo sapiens
  misc_feature: GYAE6OF02JDAFI.45.75.G09.1.454.CMB.1.raw
  modified_base (248)..(248): a, c, t, g, unknown or other
  misc_feature (248)..(248): n is a, c, g, or t
  modified_base (304)..(304): a, c, t, g, unknown or other
  misc_feature (304)..(304): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggactccgagcggtgacgttacttgtttttaagntgtctcctggtatcagcaacaccaggacaaaccgcccccaaactcatgtatttagnggaggcaaggtaacgccggtcccttgtagggtttactaagtcgtctttctcgtcggcctacgaagtcgtcggacaacgaccggtccctaccgtagaacctaacgttccgttaccggtcgggtcccgtaccggtacggtccgttaagggaacgggtaacggtacggtacgttagtaaacttttacgttacgttaggtccgttacgttccttaacgtagttacgtaggtaccgttaaagggttaccgtttaacggtttaccggtttttagggtcgggttaccggggtacggggtaaccgggttaaccgaacggttccgtacgggtaacccgttccggtaacgggtaccgtaaccggtacccgtaagggtcccttacccggccccgttacggtaccctaccgttaccgttcccggttcccccg

SEQ ID NO: 2230 - DNA, 719 bp, Homo sapiens
  misc_feature: GYAE6OF02JG6WT.45.75.G09.1.454.CMB.1.raw
  modified_base (393)..(393): a, c, t, g, unknown or other
  misc_feature (393)..(393): n is a, c, g, or t
  modified_base (463)..(463): a, c, t, g, unknown or other
  misc_feature (463)..(463): n is a, c, g, or t
tcagacgcgatcgacacgaccggtgctcgatttagtatagacatcagggggggtcgtcaggaggcagcgctctcgggacgtctccaccatggcctgggctctgctattcctcaccctcctcactcaggcacagggtcctgggcccagtctgccctgactcagcctgcctccctgtctcgggtctccgtggactagtcgactcaccatcccctgcacgtggactccaggcggtagaccgttacttggtttttaacgattcgttacctccgttaggttactcgtacggtaccaacctaccccgtaaggacctaaaccgacccccctaaaagtccaactactaatttactacgtattacgtactaaactaacgtccgccgttacgtacgggtttcncgtatcgtacttctcgtcgtccttacgacgttacgtcgtacgtaacgtccgtacctaccctacggacctntaccgttcgtcgggtccctcggtacggtcgaacggtaacgtacggtacgtcgtacgtattactacgtacgacacggtacactattacttacgtttagttccgtttaccgacggtttcggtaggttccggaaccgggtacgtacttaaccggttcgttaccggtacgttaacgggtacctacggaaccgtacggttaccctccgggtacccccgttaccgaccgtttacccggttaccgttcccgtttacccccggg

SEQ ID NO: 2231 - DNA, 594 bp, Homo sapiens
  misc_feature: GYAE6OF02I03HY.45.75.G09.1.454.CMB.1.raw
  modified_base (176)..(176): a, c, t, g, unknown or other
  misc_feature (176)..(176): n is a, c, g, or t
  modified_base (224)..(224): a, c, t, g, unknown or other
  misc_feature (224)..(224): n is a, c, g, or t
  modified_base (354)..(354): a, c, t, g, unknown or other
  misc_feature (354)..(354): n is a, c, g, or t
  modified_base (415)..(415): a, c, t, g, unknown or other
  misc_feature (415)..(415): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcaggacacaggatcgtgggccctttctgccctgactcagcctgcctccgtntctgggtctcctggacagtcgatcaccatggcctgcactggaaccaanagtcgatgttgggattttagtttgtctcctggtaccaacacacccggcaacgaccccaaatatctattataggacactagcgtccgtcggggttcagtcgcttctctgctcagtctgcaacgcgcctccngactatctcgtggcctcaggctcgaggtacgagtctgtattactttcgtacgttgccttanattactcgtacgtagggaccagcctacgtttgggtcgttcgggaccgggtacgggaccgtaggttcgaccgttccgtaggtaccacggtacccgaaggtccgtaccggtccccgtcggtacctacgttccgttccgttacccccgtacccttcccgtccgtacgtaccgtccgtacccg

SEQ ID NO: 2232 - DNA, 525 bp, Homo sapiens
  misc_feature: GYAE6OF02JPSD9.45.75.G09.1.454.CMB.1.raw
  modified_base (459)..(459): a, c, t, g, unknown or other
  misc_feature (459)..(459): n is a, c, g, or t
  modified_base (492)..(492): a, c, t, g, unknown or other
  misc_feature (492)..(492): n is a, c, g, or t
  modified_base (495)..(497): a, c, t, g, unknown or other
  misc_feature (495)..(497): n is a, c, g, or t
  modified_base (501)..(525): a, c, t, g, unknown or other
  misc_feature (501)..(525): n is a, c, g, or t
tcagacgcgatcgacacgaccggtgctcgatttagtatagacatcagggggaagaccgaagggcctggagtgggtctcagtaatttttagtacaggcacagcgtactacgcagattccgttaagggccgattcaccatctccagagacaattccaggaacacggtgtttcttgaaatgaacaccctgagacccgaggacacggctctatattactgtgcgagagatcgaacccagaccccggaagaaacttctaacaactactacggtatggacgtcgtggggccaagggaccaccgtcaccggtctcctcacgcctccaccaagggcccaatccggtccttcccccctggcccacccgtccctccaagaccgcaccctcctcggggggcctacgacgccggcccgtcggggcctcggccctgggtccaagggtcctacgttccctgactccgcgttcnggacgcgggctgggaccaagggcaccgatacgntannnacgnnnnnnnnnnnnnnnnnnnnnnnnn

SEQ ID NO: 2233 - DNA, 605 bp, Homo sapiens
  misc_feature: GYAE6OF02I5JCU.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggacaaacgcccccaaactcatcatttatgatgtacaataacgtcggcctcgtaggggtttctctatcgtcttctctcggctcctaagtctggacaacgtaccgccctccctacgaccctatcccgtacgtgggcctccgaggccgtaggaacgacggacggtctagtatttactactgacgagcacattattatttagtacgtttcctacggttacgggttattccgggacggtacgggaacctaaggttacgaccggttccgtaacggtactacggacccgtaacgcgttaccggcccccgttaggtccctacgtccgttaccgttcccccg

SEQ ID NO: 2234 - DNA, 582 bp, Homo sapiens
  misc_feature: GYAE6OF02GBTB1.45.75.G09.1.454.CMB.1.raw
  modified_base (303)..(303): a, c, t, g, unknown or other
  misc_feature (303)..(303): n is a, c, g, or t
  modified_base (569)..(569): a, c, t, g, unknown or other
  misc_feature (569)..(569): n is a, c, g, or t
  modified_base (574)..(576): a, c, t, g, unknown or other
  misc_feature (574)..(576): n is a, c, g, or t
  modified_base (580)..(581): a, c, t, g, unknown or other
  misc_feature (580)..(581): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagacaggcacagcgtactacgcagattccgttaagggccgattcaccatctccagagacaattccaggaacacggtgtttcttgaaatgaacaccctgagacccgaggacacggctctatattactgtgcgagagatcgaacccngaacccggaagaaattcaacaactactacggtatggacgtctggggccaagggaccacgtcaccgtctcctcacgcctcaccgaaggcccatccgtccttcccctggcccaccctcctccaacgacgccaccgtcgcggggcacgacggccggcccgtgggctcgccgtcgggtaccgaacggaccttaaccgttcccgtacgtacgtccgccgttcgtacggacgggcgggtcgtcgggaaccggaacgggccgcgtaagtacgngacgnnngtcnnc

SEQ ID NO: 2235 - DNA, 720 bp, Homo sapiens
  misc_feature: GYAE6OF02FVKBJ.45.75.G09.1.454.CMB.1.raw
tcagacgcgatcgacacgaccggtgctcgatttagtatagacatcagggggctggggtctcaggaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgatggttgggagttataaccttgtctccgtaggtaccaacagcaccgaggacaaacgcccccaaatcatgtattatggaggcaggtaacgccggccctcgtaggggtttactaagtcgtacttcttcgtcggctaccgaacgttcgtacggacaaccgacccggtcccttaccctacggaacctaacgttcccgttaccgtcggggtacccttaccggacgggtaccgttcgggaaacggggacggacgggtacttacggtattttaacgttacgttcgccttcggtccttacgtaattacgtacggtacggttaacgggtttaagttaacggtttaccggtttttagggttccgggtttaccggggtacggggaaacggggtacccgtaaagggtcccgttaacgggtaccccggtttaccggtacgggttaccgaacccgggtacccggtaacgggtccccgttacccggtccccccggtttaacccgg

SEQ ID NO: 2236 - DNA, 628 bp, Homo sapiens
  misc_feature: GYAE6OF02F8HHJ.45.75.G09.1.454.CMB.1.raw
  modified_base (235)..(235): a, c, t, g, unknown or other
  misc_feature (235)..(235): n is a, c, g, or t
  modified_base (351)..(351): a, c, t, g, unknown or other
  misc_feature (351)..(351): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagacaggcacagcgtactacgcagattccgttaagggccattcaccatctccagagacaattccaggaacacggtntttcttgaaatgaaccaccctgacgacccgaggacacggctctatattactgtgcgagagatacgaacccgagacccggaagaaacttctaacaactactacggtatggacgtcgnggggaccaacgggaccaccgtccaccgtcctccccacgccctaccaccgaacgggcccacgttccggttcccttcccccgtggccctacccctcccgtacccaacgacgaccaccgtccgtcggggaccacgacggcccggcccgtcgggcctcgtccgtcgggtaccgaacggtaccttaccgttccgtcgtacgtccgccgttacgtcggacggtccgggtcgtacgggaccgtaacgggccgaacgtaacgtacgcacgcgtcgatcgctgacg

SEQ ID NO: 2237 - DNA, 598 bp, Homo sapiens
  misc_feature: GYAE6OF02GIV34.45.75.G09.1.454.CMB.1.raw
  modified_base (277)..(277): a, c, t, g, unknown or other
  misc_feature (277)..(277): n is a, c, g, or t
  modified_base (301)..(301): a, c, t, g, unknown or other
  misc_feature (301)..(301): n is a, c, g, or t
  modified_base (372)..(372): a, c, t, g, unknown or other
  misc_feature (372)..(372): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatggcctgcactggaaccaacagtgatggttgggagtttttagtttgtctcctggtaccaacaacgaccccggngaacgcccccaaataatcatttanaggacactaaggcggccgtcggggttacaagtcgcttctcgtggctcgaagtctggcaacgcgcctcccgngacaatctcgtgggctccgaggctggacggacgaggctgatttattactgctgctcatatgacgtaggtagttacgttacgtttggtcgttcgggacgggtagggtaccaaggtccgttacggaacccgttaccgtaggtccacggtacccgaaggtccgtccggtacccccgtcggtaccctacgttccttccgttcccctacccttcctcgtccgtacgtccgg

SEQ ID NO: 2238 - DNA, 579 bp, Homo sapiens
  misc_feature: GYAE6OF02GY2MS.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttacttgtttttaagatgtctcctggtatcagcaacaccaggcaaagcccccaaactcatcatttatgatgtcaataatcggccctacgtagggtttctcatcgtcttctctggctccgaagtctggacaataccggccctcctcgaccctctactcgtggcctccgaggtctaggaacgacgacggtctacgtattattacgtgacgagctaacgattatattagttcgtttacctacgttcgggttacttcgggacggtaaggaccgtaggttcgtaccggtccgtaggtcctacgacccgaggtcctaccggccccttcggtacctcttccgtccgttacccccg

SEQ ID NO: 2239 - DNA, 555 bp, Homo sapiens
  misc_feature: GYAE6OF02GC6Z5.45.75.G09.1.454.CMB.1.raw
  modified_base (299)..(299): a, c, t, g, unknown or other
  misc_feature (299)..(299): n is a, c, g, or t
  modified_base (430)..(430): a, c, t, g, unknown or other
  misc_feature (430)..(430): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacaccaggcaaacgcccccaaactcatcatttangatgtacaataatccggcctcgagggtttctcatcgtcttctctggctcaagtctggacaagtccggcctccctgaccctattctcgtcgggctccgaggctaggaagacggacgctagatttacttagtntcgaagcactattattaatttagttgtttacccagttcgggtattcgggaggtacgggactagttcgacgtcgtacggtcacgaccgtaaggcctcggtcccctacggtcacttcgtcctccccg

SEQ ID NO: 2240 - DNA, 600 bp, Homo sapiens
  misc_feature: GYAE6OF02IN3W0.45.75.G09.1.454.CMB.1.raw
  modified_base (301)..(301): a, c, t, g, unknown or other
  misc_feature (301)..(301): n is a, c, g, or t
tcagacgcgatcgacacgaccggtgctcgatttagtatagacatcagggggggggtctcaggaggcagcgctctcgggacgtctccaccatggcctgggctctgctaattcctcaccctcctcactcagggcacagggtcctgggcccagtctgccctgactcagcctgcctccctgtctgggtctcctggacagtcgatcaccatcccctgcactggactccagcggtgacgttactgttttaagatgtctcctggtatcagcaacacccaggcaaacgcccccaaactcatctatttangtatgtcaatatccggccctcgtagggtttctcatctcttctctggctcagtctgcaatacgcctcctgaccatctcgtcggcctcgacggtctaggaacgacggacggtctagtactttacgttacgtcgacacgcctaactaattattaagtttacgttaccgttttacctacggttcgggttaacgttcggtaccgggacgggaaccttaacggttcgaaccggttccgtaggttaccacgtacccgaaggtcctccggtccccttgggtacctacgttccttccgtttacccccg

SEQ ID NO: 2241 - DNA, 532 bp, Homo sapiens
  misc_feature: GYAE6OF02JKTJX.45.75.G09.1.454.CMB.1.raw
  modified_base (242)..(242): a, c, t, g, unknown or other
  misc_feature (242)..(242): n is a, c, g, or t
  modified_base (292)..(292): a, c, t, g, unknown or other
  misc_feature (292)..(292): n is a, c, g, or t
  modified_base (310)..(310): a, c, t, g, unknown or other
  misc_feature (310)..(310): n is a, c, g, or t
  modified_base (363)..(363): a, c, t, g, unknown or other
  misc_feature (363)..(363): n is a, c, g, or t
  modified_base (368)..(368): a, c, t, g, unknown or other
  misc_feature (368)..(368): n is a, c, g, or t
  modified_base (371)..(371): a, c, t, g, unknown or other
  misc_feature (371)..(371): n is a, c, g, or t
  modified_base (379)..(379): a, c, t, g, unknown or other
  misc_feature (379)..(379): n is a, c, g, or t
  modified_base (386)..(386): a, c, t, g, unknown or other
  misc_feature (386)..(386): n is a, c, g, or t
  modified_base (390)..(390): a, c, t, g, unknown or other
  misc_feature (390)..(390): n is a, c, g, or t
  modified_base (398)..(398): a, c, t, g, unknown or other
  misc_feature (398)..(398): n is a, c, g, or t
  modified_base (408)..(408): a, c, t, g, unknown or other
  misc_feature (408)..(408): n is a, c, g, or t
  modified_base (411)..(411): a, c, t, g, unknown or other
  misc_feature (411)..(411): n is a, c, g, or t
  modified_base (448)..(448): a, c, t, g, unknown or other
  misc_feature (448)..(448): n is a, c, g, or t
tcagacgcgatcgacacgaccggtgctcgatttagtatagacatcaggggggggtctcaggaggcagcgctctcgggacgtctccaccatggcctgggctctgctattcctcaccctcctcactcagggcacagggtcctgggcccagtctgccctgactcagcctgcctccctgtctggtctcctggacagtcgatcaccatcccctgcactggatccagcggtgacgttactgttttaanatgtctcctgtatcagcaacaccaggcaaagcccccaaatcatcatttangatgtcaatatccgcctnagggttctctatcgcttctctcggctcctaatctggacaagtccgccttcccngaccntcnctggctcnggctganacgngctgattntctgttgctnatngcagggaccagcctacgttggtcgtcggcgtaggacngggtttccgaccgttccgtaggtaccacggtacccgtaaggcccgttaccgtccccccggttagtccgaccttccgttccccgg

SEQ ID NO: 2242 - DNA, 529 bp, Homo sapiens
  misc_feature: GYAE6OF02G98PD.45.75.G09.1.454.CMB.1.raw
  modified_base (318)..(318): a, c, t, g, unknown or other
  misc_feature (318)..(318): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagtatgtctcctggtatcagcaacacccaggcaaagcccccaaatcatcatttatgatgtcaataatcggccctnaggggtttctcatcgcttctctggctccaagtctggcaatacggcctccctgaccatctcgtgggcctccaggctagaacgacgaggctgattattactgacagcacattataattagtgtttccacgttcgggttattcgggcggagggaccaagttcgaccgtcgtaggtcacgcctagctcgcccctcggtcacttctcgttcccccg

SEQ ID NO: 2243 - DNA, 643 bp, Homo sapiens
  misc_feature: GYAE6OF02JGNHD.45.75.G09.1.454.CMB.1.raw
  modified_base (216)..(216): a, c, t, g, unknown or other
  misc_feature (216)..(216): n is a, c, g, or t
  modified_base (231)..(231): a, c, t, g, unknown or other
  misc_feature (231)..(231): n is a, c, g, or t
  modified_base (427)..(427): a, c, t, g, unknown or other
  misc_feature (427)..(427): n is a, c, g, or t
  modified_base (643)..(643): a, c, t, g, unknown or other
  misc_feature (643)..(643): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagtacaggcacagcgtactacgcagattccgtaaagggccattcaccatctccaganacaattccaggaacncggtatttctgaaatgaactacctgacgaccgagacacggctctatactactgtgcgagagatcgaaccagaaccgaagaaactcacaactacgtacgtagtcggacgtcgtgggaccaaacggtccaaccgtcgaccgtcctacctacacgccctaccaaccgaacgggccccagttccggtcctttacccccgnggacccaccctcctaccaacgacgtaccaccgtccgcggggtccaaccgacggccggtcccgtgggcctacggcccgtcggtaccgaaacggcccttaacgttcccgtaccgtagttacccggtcggttaccgtcgggtacgggcccggggttaccgttcggggaacccggtaacgggtccggaccgtaacggtacggcgtacggctcgcgcgcgn

SEQ ID NO: 2244 - DNA, 578 bp, Homo sapiens
  misc_feature: GYAE6OF02HGHY4.45.75.G09.1.454.CMB.1.raw
  modified_base (285)..(285): a, c, t, g, unknown or other
  misc_feature (285)..(285): n is a, c, g, or t
  modified_base (381)..(381): a, c, t, g, unknown or other
  misc_feature (381)..(381): n is a, c, g, or t
  modified_base (566)..(566): a, c, t, g, unknown or other
  misc_feature (566)..(566): n is a, c, g, or t
  modified_base (572)..(572): a, c, t, g, unknown or other
  misc_feature (572)..(572): n is a, c, g, or t
  modified_base (575)..(577): a, c, t, g, unknown or other
  misc_feature (575)..(577): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagtaatttttagtacaggcacagcgtactacgcagattccgttaagggccgattcaccatctccagagacaattccaggaacacggtgtttctgaatgaacacctgagacccgaggacacggctctatattactgtncgagagatcgaacccagaacccggaagaaacttcacaactactacggtatcggacgtcgtggggaccaaggggaccaccgcaccgtcctcctcacncctccaaccaacgggcccagtccggtccttcccccgtcggccaccctccctcccaagacgcaccgtcgtacgggggccaccgacggccggacccgtgggccgtcgcccgtggtaccgaaggtaccttaccgttcctaccgtacgtccgtcgtcgtgacggccgggcgtcggcgaacggcgacganagctgntgnnnc

SEQ ID NO: 2245 - DNA, 675 bp, Homo sapiens
  misc_feature: GYAE6OF02GAJZ1.45.75.G09.1.454.CMB.1.raw
  modified_base (340)..(340): a, c, t, g, unknown or other
  misc_feature (340)..(340): n is a, c, g, or t
tcagacgcgatcgacacgaccggtgctcgatttagtatagacatcagggggctggggtctcaggaggcagcgctctcgggacgtctccaccatggcctgggctctgctattcctcaccctcctcactcagggcacagggtcctgggcccagtctgccctgactcagcctgcctcctgtctgggtctcctggacagtcgatcaccatcccctgcactggatccagcggtgacgttacttgttttaagatgtctcctggtatcagcaacacccaggacaaacgcccccaaatcatctatttatgatgtacaataacgtccggacccttcgtagggttttccnctactcgtctttctcgtgtcctaccaagtcgtacggacaacgtaccggtcccttacccgtcgaaccctacttcttccggtcggggtcctcccgtaacgggtcctaacgggaaacggtaacggaacggtccgttaaggttaacttttaacttacggttcgaaccgtagacctaacgtaatttaacgttaagttttacgttcgtttacccgtaggtttaccgggtaacggtttccggggacggggaacggtaccgtaagggttcgtaaccggtaccgttaagggtccaacggtacccgaggtcccttcccgcccccgttggtaccctacgttccccg

SEQ ID NO: 2246 - DNA, 683 bp, Homo sapiens
  misc_feature: GYAE6OF02F14YN.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttggtccaggcccggggggtccctcgagactctcgtgtgcagcctctggattcaccgtcagtggcagcttcctgagcgtcggggtcccgccgaggcctccgaggggaacgggcccgtgggaggttgggtcctcgtaaggttaatttttagaacgtaggactacgacgcgtaactacggctagtactttcccgtaaagggccgtacgtccaacctactccgtaccgaacgacgtaacctaaacgttccgaaagggtaaaccgtaccgggttagttttaccgttaggaaacttcggaaacctacccgtaggaaccggacccggaacgggaacccgacgggtaccttaccgtaattacgttacgtgttacgacgagtacgacgtaccgaacccctaacggaacccggtaaagtaacgttacctaacgaaccgttaaccgttaacggtaacgtacggacgttaaccggg

SEQ ID NO: 2247 - DNA, 621 bp, Homo sapiens
  misc_feature: GYAE6OF02GMYEK.45.75.G09.1.454.CMB.1.raw
  modified_base (612)..(612): a, c, t, g, unknown or other
  misc_feature (612)..(612): n is a, c, g, or t
  modified_base (615)..(615): a, c, t, g, unknown or other
  misc_feature (615)..(615): n is a, c, g, or t
  modified_base (618)..(618): a, c, t, g, unknown or other
  misc_feature (618)..(618): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctgggagtgggtctcagtaatttttagtacaggcacagcgtactacgcagattccgttaagggccgattcaccatctccagagacaattccaggaacacggtgtttcttgaaatgaacaccctgacgacccgaggacacggctctatacttactgtgcgagagactcgaacccaggaaccccggaagaaacttcctaacaactactacggtatcggacgtcgtggggaccaaggggaccaccgtcaccgtctcctcacgtcctccaaccgaacgggccccagtcccgggttccttcccccgtcggcccacccctccctaccgaacgacgccacctcggtacggggccacgacggcccggacccgtcgggccgtcgcccgttcggtaccgaacggtacctaccgttccgtaccggtacgttccgccgtcgtacgacggtccgggcgtcgggccgtacggccgacgtacgtagcgcgtcngcncgntcg

SEQ ID NO: 2248 - DNA, 726 bp, Homo sapiens
  misc_feature: GYAE6OF02I8I5E.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcgttggtccgagggcccgggggggtccctcgagacctctcgtgtgcagcctctggattcaccgtcagtggcagtcttcctgagcgtcgggtccgccgaggcctccgaggggaacgggccgtgggaggttcgggtctcgtagtttaagttttagacgaggtcacgacggtcgtaacgtacgcgaagtacgtttaccggtaagggccgtattccgacctactccctaccgaagacgtaactaacttacccgaaacgggtaacctacgggtttacgttttaccgttaaggaaacgttacgaaaccctacccgtaggaaccggtaaccccggaaggtaacccgtaccgggacctttaaccgtaacgtttaactttaaccgtggttacgacggtaagtacgaaccgttaacccggaaaccccgtaacgggaaaccccgggtaaagtaaaccgtttacccgtaaaccgtaaccgttaaccgttaacgggttaacgttacggggaccgttaccgggg

SEQ ID NO: 2249 - DNA, 900 bp, Homo sapiens
  misc_feature: GYAE6OF02HDZFK.45.75.G09.1.454.CMB.1.raw
tcagacgcgatcgacacgaccggtgctcgatttagtatagacatcagggggggggctcaggaggcagcgctctcgggacgtctccaccatggcctgggctctgctattcctcaccctcctcactcagggcacgagggtcctgggcccagtctgccctgactcagcctgcctccctgtctgggtctccgtggacagtcatcaccatcggcctgcacgtacggaaccaacgagtcgagttggttagggttacgttttttaggtttcgtccgttccgtaggttaacccaaacctaacccgacccccgggtacgaaaccgacccccctaaaactaaactctaaagtttacgtaacgggaacctaacgtaacggcccgggtaccccggtttacgggggggttttaccaaacggttcccggtcttttccgttaccgtcggtacccttaccgtaaggtccgtcggaaccaaaccgtaccgggtacccctaccgtcgaacctaacttccgttacgtcggggtaccctaccggacggtccgttacggacgggtaaccggacgggtacttaggttaaacttttaacttaccgttacgtccgttacgtccgttacgtaacttacgtacggtacgttaaacggggttagttttaacggtttacggtttttaggggttcgggttaaccgggggtaccgggtaacggggaacccttaagggtccgtttaacccggggtaacccgttaccgggttaaccgggtcccgtaacccgggtaaccccgggaacgggttccccggttaaccccggttaccccccgggtttccggtaacccttaccccgggtttacctttcccccgggtttacccccgtacccctttccccgttaccggttaccgttacccgttccccggg

SEQ ID NO: 2250 - DNA, 551 bp, Homo sapiens
  misc_feature: GYAE6OF02FG2XT.45.75.G09.1.454.CMB.1.raw
  modified_base (272)..(272): a, c, t, g, unknown or other
  misc_feature (272)..(272): n is a, c, g, or t
  modified_base (286)..(286): a, c, t, g, unknown or other
  misc_feature (286)..(286): n is a, c, g, or t
  modified_base (296)..(296): a, c, t, g, unknown or other
  misc_feature (296)..(296): n is a, c, g, or t
  modified_base (392)..(392): a, c, t, g, unknown or other
  misc_feature (392)..(392): n is a, c, g, or t
  modified_base (440)..(440): a, c, t, g, unknown or other
  misc_feature (440)..(440): n is a, c, g, or t
tcagacgcgatcgacacgaccggtgctcgatttagtatagacatcaggggagctctgggagaggagcccagcactgggattccgaggtgtttccattcagtgatctgcactgacacagaggactcgccatggagtttgggctgagctgggttttcctgttgctattttaaaaggtgtccagtctgaggagcagctggtggagtcgtgggggagcttggtccagcccggggggtccctcagactctcgtgtgcagccctctggattcaccgtnagtggcagctcctnagctggtccncaggctccgagggaggcctggagtgggtctcgtagtagtttttagacaggcacacgcgtactacgcagtacttccgtaaggccgattccaccatcnccagacgactaacttccaaggaacacggtgtttacttagaatgaaccnccgtagacgacccgaggaccacggactcgtattagtactgtgcgagagacgaccgaacccaggaacccggaagaacttacaacaacctacgtaacggatcggtacgtacgg

SEQ ID NO: 2251 - DNA, 765 bp, Homo sapiens
  misc_feature: GYAE6OF02HNK53.45.75.G09.1.454.CMB.1.raw
  modified_base (663)..(663): a, c, t, g, unknown or other
  misc_feature (663)..(663): n is a, c, g, or t
tcagacgcgatcgacacgaccggtgctcgatttagtatagacatcagggggctggggtctcaggaggcagcgctctcgggacgtctccaccatggcctgggctctgctattcctcaccctcctcactcagggcacagggtcctgggcccagtctgccctgactcagcctcgccctcctgtctcgggtctccgtggacagtcgactcaccactcccctgccacgtggactccaggccggtagtacgtttactttaggtttttaaagtacttcgttccttccgttgggtaactccgagacctaaaccacccccgtaaggaccaaaaccgacccccctaaaactccgaatcctaacttttacgtcgattacgtacctaaattaaaccgtccccgggaccgttaccggtaaccggggttttcctaccgtacgttccgtcctttccgtccgttcggtaccttccgtaaagttccgtaggactaaacgtcccggtacccttcccctacgaccctacgtccttcggtcgggtaccttacccggacggtacgtacgtaaacggaccggagttccgtagttaacgttactttacggttcgtcttcgtacttactacgttagcgtaccggtaacgaccgtacgtacgttccgggttgggttcggtacccgggngggtaccgggaccgtaacgggttccggaacccggtttccgtaacgggtaccgtacggtacccgtacgggtcccgttcccggtcccggttacccggtccccgg

SEQ ID NO: 2252 - DNA, 694 bp, Homo sapiens
  misc_feature: GYAE6OF02HUOEA.45.75.G09.1.454.CMB.1.raw
  modified_base (259)..(259): a, c, t, g, unknown or other
  misc_feature (259)..(259): n is a, c, g, or t
  modified_base (321)..(321): a, c, t, g, unknown or other
  misc_feature (321)..(321): n is a, c, g, or t
  modified_base (413)..(413): a, c, t, g, unknown or other
  misc_feature (413)..(413): n is a, c, g, or t
  modified_base (690)..(690): a, c, t, g, unknown or other
  misc_feature (690)..(690): n is a, c, g, or t
  modified_base (693)..(693): a, c, t, g, unknown or other
  misc_feature (693)..(693): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagtacaggcacagcgtactacgcagattccgttaaggccgattcacatctccagagacaattccaaggaacacggtgtttcttgaaatgaacacctaganacccgaggacacggctctagtattactgtgcgtagagatccgaacccaggaccccgggaaanaaacgtttcctaactaaacctaacgttaccggtaagtcggaaccgttcgtacggggaccaaaggggaccccaccggttaccaacccggttcnccccttacacggtccccttaccaaacccaacggggccctaacgttccgggttccctttacccccgttacggacccctacccctccccgttacccaacgacgacctacccgtcgtcgggggtaccacgtacgccggtacccgtcgggacctcggtccgtgtaccgtaacggtaccttaaccgttcccgtacgtacgttccggtccgtaccttggaccggtccggggacgttaccgggcgtaacgggccgtacccgaagttacggccgtgacgtcgcgngcnc

SEQ ID NO: 2253 - DNA, 537 bp, Homo sapiens
  misc_feature: GYAE6OF02HIDMZ.45.75.G09.1.454.CMB.1.raw
  modified_base (431)..(431): a, c, t, g, unknown or other
  misc_feature (431)..(431): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcggtgacgttactgtttttaagatgtctcctggtatcagcaacacccaggcaaacgcccccaaactcatcatttatgatgtacaataactcggccctcgacggggtttctcgatcgcttctctggctccaagtctggctaatacggcctccctgaccatcctctgggctccaggctgaacgacgagctagattagttactgacagcanatatattagtgtttccacgtcggtagttcgggacggaggaacctaggttcgaccgttcgtacggtcacgccgaagcctcggtcccctcggtcacttctccgtcccc

SEQ ID NO: 2254 - DNA, 621 bp, Homo sapiens
  misc_feature: GYAE6OF02HS1PG.45.75.G09.1.454.CMB.1.raw
  modified_base (288)..(288): a, c, t, g, unknown or other
  misc_feature (288)..(288): n is a, c, g, or t
  modified_base (326)..(326): a, c, t, g, unknown or other
  misc_feature (326)..(326): n is a, c, g, or t
  modified_base (522)..(522): a, c, t, g, unknown or other
  misc_feature (522)..(522): n is a, c, g, or t
  modified_base (530)..(530): a, c, t, g, unknown or other
  misc_feature (530)..(530): n is a, c, g, or t
tcagacgcgatcgacacgaccggtgctcgatttagtatagacatcaggggctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggaggcttggtccgaggccgggggggtccctcgagactctcgtgtgcagcctctggacttcaccgtcagtggcagcttccnggagctgtcgtccgccgaggctccgaggaggccgtggngtggtctcagttaattttagacgtaggcacgagtgtacgtacgcgagtacgttaccgttaacgggccgtattccacctactctaccaagacgtaacaacgttacaaggaactacggttgtttacttagaaatacggaacctaccgtgaaccgacccgtaaggaccgaaccggtctacttacgtaacgttactggtntacgaagngtaactaccgtaacccgaacggaacccggtaaagaaacgttacctaacgaaccgtacgtaacggtacgtaggtaccgttcggtaaccgggg

SEQ ID NO: 2255 - DNA, 607 bp, Homo sapiens
  misc_feature: GYAE6OF02IP0ZD.45.75.G09.1.454.CMB.1.raw
  modified_base (246)..(246): a, c, t, g, unknown or other
  misc_feature (246)..(246): n is a, c, g, or t
  modified_base (463)..(463): a, c, t, g, unknown or other
  misc_feature (463)..(463): n is a, c, g, or t
tcagacgcgatcgacacgaccggtgctcgatttagtatagacatcagggggctggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcactggatccagcgtgacgttactgttttaagntgtctcctggtatcagcaacacccaggcaaacgacccccaaactcactctatttatgatgtacaataactccggtccctcgtacgggtttctactactcgtcttctctggcctaccaagtctggctaacgtccgcctcccgtcgaccactcctcgtacgggctccgacggtctacgaacggacggacggtcttagtaactttacgttaacgtgtacncgacacgtaattacgttatttacgttagttccgtaacgttcgggtacttcgggacggtacggacctaaggttaccggaccgttacgtacggttcccgacgtacccgaacggtccctccgcccccgttacggtcctacgttcccg

SEQ ID NO: 2256 - DNA, 637 bp, Homo sapiens
  misc_feature: GYAE6OF02HC1H3.45.75.G09.1.454.CMB.1.raw
  modified_base (223)..(223): a, c, t, g, unknown or other
  misc_feature (223)..(223): n is a, c, g, or t
  modified_base (262)..(262): a, c, t, g, unknown or other
  misc_feature (262)..(262): n is a, c, g, or t
  modified_base (299)..(299): a, c, t, g, unknown or other
  misc_feature (299)..(299): n is a, c, g, or t
  modified_base (431)..(431): a, c, t, g, unknown or other
  misc_feature (431)..(431): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcaggacacagggtcctgggcccagtctgccctgactcagcctgcctccgtgtctgggtctcctggacagtcgatcaccatcctcctgcactggaaccngcagtgatgttgggattataaccttgtctctgtaccaanagcaccaggacaaacgcccccaaatcatagtatttanggaggctaagtacggccggccctggtagggtttctaatccgtcttctcgtcggcctacaagtcgtaggccaacgaccggtcctcccgtagaacctagtcctcggtcggcctccgaggtctagggacggacgnggtactaggtaatttagtctgtctcgccttcaattacgtgaccgtagggttaacgttacgtttacggttttgggtcgggtttacgggaccgggtaacgggtacctaacggtcgtaaccggtacccggttaccggtacggtaccgaccggtacccgaggtcccctacccgggtacccccgtcggtacctaccgttcccgttcccccg

SEQ ID NO: 2257 - DNA, 640 bp, Homo sapiens
  misc_feature: GYAE6OF02IFGM7.45.75.G09.1.454.CMB.1.raw
  modified_base (263)..(263): a, c, t, g, unknown or other
  misc_feature (263)..(263): n is a, c, g, or t
  modified_base (295)..(295): a, c, t, g, unknown or other
  misc_feature (295)..(295): n is a, c, g, or t
  modified_base (481)..(481): a, c, t, g, unknown or other
  misc_feature (481)..(481): n is a, c, g, or t
  modified_base (492)..(492): a, c, t, g, unknown or other
  misc_feature (492)..(492): n is a, c, g, or t
tcagacgcgatcgacacgaccggtgctcgatttagtatagacatcagggggctggggtctcaggaggcagcgctctcgggacgtctccaccatggcctgggctctgctattcctcaccctcctcactcagggcacagggtcctgggcccagtctgccctgactcagcctgcctcgtgtctgggtctcctggacagtcgatcaccatctcctgcactggaaccagcagtgatggttgggattataccttgtctcctgtaccaangcaccagcaacgaccccaatcatgtatttagnggacggcaggtaacgccggtccctcgtagggtttactaagtccgtacttctcgtcggccttaccgaatcgtacggacaacccgtaccggtcccctcccgtacggaacctaacgttccgtacgtacgggtccctcccgaaggcttagggacgggtacggtacgggctaggttaatttacgtttacgnggttactcgtntccatacgtgaccgtagttagttacggtttcgttttgggttacggtcgggtacgggaaggaccgcggtactacgggtaccgtacggttacggttaccgaccggtaccgtaacggtccctccggtacccccgtcggtaccttaccccgg

SEQ ID NO: 2258 - DNA, 682 bp, Homo sapiens
  misc_feature: GYAE6OF02GMLRL.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtggggggaggcgttgggtccgagggcccggggggggtcccctcgacgacctctcggtgtgcagcctctggattcaccgtcagtggcagtccttccgtgagcgtcgggtcccgccgaggcctccgaggggaacgggccgtgggaggtgggtcgtcgtagttaattttagtacgaggcacgagtcgtactacgctagtacttaccggtaagggccgtatttccgacctacttcctaccaggaacgactaacgttaccgaaggtaacctaccgggttgtttacgttaagaaacttcggaaacctacccgtaggaaccggaccccggaaggaaccgaccggtcctacgtaacttacttacttaggtacgacgtagtacgtacgtacccggaaacccaacgggtaaccccggtaaagtaacctttaccgaacctaaccgtttaaccgttaacgggtacgttaccgggtcgttaaccgggg

SEQ ID NO: 2259 - DNA, 824 bp, Homo sapiens
  misc_feature: GYAE6OF02GCAD5.45.75.G09.1.454.CMB.1.raw
tcagacgcgatcgacacgaccggtgctcgatttagtatagacatcaggggggggggtctcaggaggcagcgctctcgggacgtctccaccatggcctgggctctgctattcctcaccctcctcactcagggcacagggtcctgggcccagtctgccctgactcagcctgccctccctgtccgtggtcctcggacgacgtcgtacgacctaccaacctccctccgtcgacctacggtaggtacctacgacgggtacggtaccgttaccgtttacgttttaagttttaacgtagtcgttaccgttacggtagttacacgacgtaaccaacccaacggacgaaaccgaaaccccgtaacccctaactctaacttaccttaatttacgattacgttacgtaaactaaagttaccgtacccgtacctaggggtttaccgtttacacgttaccgtcgttccttacgtaccgtcggtaccctaacgtaacgttcggacgtaacgtaaacgggtacccctacccgttacccgaccgtaaaccgtctccgttacgggtccgggttacccaacggtacggtaccgtaaacggaacggtaccggtacgttaacgaacgtttaactttaacgttacgacgtacggtacaaccgtaacttaattaaccgtttaagttaccgtttacctaaccgtcggttaacgggtacgtaccgggacgggtaaccgtaagtttacgtacccggaccgttacgggtaacaccggtaaccgaacccggtataaccccggtcccgttacccggttaccgaaccgttccgttccggtaccccgttccccg

SEQ ID NO: 2260 - DNA, 652 bp, Homo sapiens
  misc_feature: GYAE6OF02H8JM9.45.75.G09.1.454.CMB.1.raw
  modified_base (272)..(272): a, c, t, g, unknown or other
  misc_feature (272)..(272): n is a, c, g, or t
  modified_base (275)..(275): a, c, t, g, unknown or other
  misc_feature (275)..(275): n is a, c, g, or t
  modified_base (310)..(310): a, c, t, g, unknown or other
  misc_feature (310)..(310): n is a, c, g, or t
tcagacgcgatcgacacgaccggtgctcgatttagtatagacatcagggggctgggagaggagcccagcactgggattccgaggtgtttccattcagtgatctgcactgaacacagaggactcgccatggagtttgggctgagctgggttttccttgttgctattttaaaaggtgtccagtctgaggagcagctgggtggagtcgtggggggaggcgtttggtccgaggcccggggggggttccctcgaggacctcgtcgtgtgcagcctcnggnttcaccgtcagtggcagcttcctgagctgggcccncaggctccgagggaacggcctgggacgtgggtctcgtagtttaagttttacgacgaggtcacgaggcgtactacggctagactttaccggtaaggccgtataccacctacttcctaccgaaggacgaacgtaaacttccgaaggtaaactacggttcgtttacttaggaaaacttacgaaaccacccgttaggaacgacccccggtaagggacccaacgggtacctacgttatagttaaccgtgtcgacgaagagtacctacggaacccaacggtaaccggaaacgtaattaacctacgtaaacctcgtaacggtagtacgggacgttcggagggaacccgg

SEQ ID NO: 2261 - DNA, 775 bp, Homo sapiens
  misc_feature: GYAE6OF02FV6V8.45.75.G09.1.454.CMB.1.raw
  modified_base (764)..(764): a, c, t, g, unknown or other
  misc_feature (764)..(764): n is a, c, g, or t
tcagacgcgatcgacacgaccggtgctcgatttagtatagacatcagggggggggtctcaggaggcagcggctcctcgggaccgtcgtcctaccatggtcctgggtctctgctattcctcaaccctcctcactcagggcacagggtcctgggcccagtctgccctgtactcagcctgtacctcctgtctgggtctccgtggacagtcgatcaccatcccgtggcacttggactccgagcgtacgtgagttcggttcgggacttagtaaccgttgtaccttcccgttaggtaacctaaacctacgtacctacccgaacgggtacctaaaaccggtccccccaaaactcaagtacggtattttacggacggacggggtactaacggttaacggccggtacccgttcgggtaacggggttttactaaacgttccggttacctttccgtacgttaggttaccctaacgtaaggttcgttaacggacctaaaacggtaccggtacccttacccgtagtaaacccgtaacgttccgtacggtcggtacctacccgaggtccttacgggacggaacgaggtacgtaagtaacttaacgtaacgtcgtactacggtcctacgtattaacgtagtaaccggtaagttacggttacgttaacggtttcgggtaccggttacgggaacggtaccggaaccgtacgtccgtacgtacccggttacgtaaggtacccaacgtaccgtaacggtcctcccggccctagggaccctacnccgttaccccg

SEQ ID NO: 2262 - DNA, 674 bp, Homo sapiens
  misc_feature: GYAE6OF02GHSEV.45.75.G09.1.454.CMB.1.raw
  modified_base (275)..(275): a, c, t, g, unknown or other
  misc_feature (275)..(275): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggtttccttgttgctattttaaaaggtgtccagtctgaggagcagctggtggagtcgtgggggaggcttgggtccaggccgggggggtccctcgagactctcgtgtgcagcctctggattcacgtnagtggcagcttccgtgagctgggtccgcaggcctccgtggggaacgggccgtgggacggtgggtctcgaagttaagttttagacgtagggcaacgtagaccgtactaacgcaagtacttacccgggttaaagggccgtaatttaccgaacccacgttacctacccgtaaggactaactaattcccgaaggaaaccgtacggttagttttaccttaggtaaattacgtaaacctacccgtaggaaccgtaacccggaaggaaccgacggtacctaacgttactaactttaccgtaggtacgcgtaagacgtaacgtaccggaaacccgaacgtaacccgggaaagtaaaccttactaaccgtaaactaaccgttaacggtagtacgggacgttaaccggg

SEQ ID NO: 2263 - DNA, 699 bp, Homo sapiens
  misc_feature: GYAE6OF02FLR5R.45.75.G09.1.454.CMB.1.raw
  modified_base (262)..(262): a, c, t, g, unknown or other
  misc_feature (262)..(262): n is a, c, g, or t
  modified_base (489)..(489): a, c, t, g, unknown or other
  misc_feature (489)..(489): n is a, c, g, or t
tcagacgcgatcgacacgaccggtgctcgatttagtatagacatcagggggggggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtctggggggaggcttggtccaggcccggggggggtccctcgagactctcgtgtgcagccctntggatttcaccgtcagtggcagcttcctgacgctggggtcccgccagggcctccgaggggaacgggcctgggacggtggtctcgtaagttaattttttagacgtagggtcaccgagccgtaactaccgcaaggtactttaccgggttaaacggggccctaatttccaacccgtataccctaccgaaggtacgaacctaacgttacccgaaggtaacctaacgggttnttttaccgttaggaaactacgaaacctacccttagggaacgaccccggaggacaccgggctactattacgttactggtacgtacggaagtagacttacccgaacccgacgtaaccccgggaaagtaaaactttaccgaaacctaaaccgttaacgtaaccggttagtacgggtaacccgttcggtacggggtacccgaagggtaaccccg

SEQ ID NO: 2264 - DNA, 785 bp, Homo sapiens
  misc_feature: GYAE6OF02IVIEW.45.75.G09.1.454.CMB.1.raw
tcagacgcgatcgacacgaccggtgctcgatttagtatagacatcaggggggggggtctcaggaggcagcgctctcgggacgtctccaccatggcctgggctctgctattcctcaccctcctcactcagggcacagggtcctgggcccagtctgccctgactcagcctgcctccctgtcgtgggtctcctggacagtcgatcaccatcccctgcactggactccagcggtgtacgtttacttagtttttaagattcgtcctcgttggtactacgacgtaccaaaccgacccgaacggaccaaaccgtaccccccaaacttccaacttaccgttaatttaactgtaagttacgtaactaaagttaacgtccggtacccgttacggttaaggggtttcctacgtaacgttccgttacttccgtaccgttacggtcctaacccggtaacggttccgtacggtaacgtaaccgttacccggtcccgttacccgtaacggtaccctacgtttccgtacggtcggtcccctacggtacggtacgtaaggacgtacggacgtacgtagttacttacgttacgtagacgtacgactaactaagttaacgttacggtttaacgtttccgtttaccgtacggttaccggggtttacgtccgggggtaccgggtaacgggtaaccgttaacggtaccggtaccgttaccggtacggtacccgaccgtacccggtaccggtaccgttccccggtaccccgttccggtacctaccgtttcccgtacccgttacccccg

SEQ ID NO: 2265 - DNA, 611 bp, Homo sapiens
  misc_feature: GYAE6OF02GK2KJ.45.75.G09.1.454.CMB.1.raw
  modified_base (285)..(285): a, c, t, g, unknown or other
  misc_feature (285)..(285): n is a, c, g, or t
  modified_base (298)..(298): a, c, t, g, unknown or other
  misc_feature (298)..(298): n is a, c, g, or t
tcagacgcgatcgacacgaccggtgctcgatttagtatagacatcagggggggagaggagcccagcactgggattccgaggtgttccattcagtgatctgcactagaacacagaggactcgccatggagtttgggctgagctgggttttccttgttgctattttaaaaggtgtccagtctgaggagcagctggtggagtcgtgggggaggcttggtccaggccgggggggtccctcgagactctcgtgtcgcagcctctggacttcaccgtcagtgcagcttccngagcgtgggtccnccgaggcctccgagggacggcctgggaggtgggtctcgagttaattttacgacaggcacgagcgtactacgcagtacttacgtaggccgtattcaccatcaccagagaaccaattccgaaggaacctacgggttgttttacctagaaacttcgaaactaccctggaacgacccgaggaccacggctacgtattattactgtagcgtagagactacgaaccgacgacccggtaaagaacttaccaactaaccgttaacgtaccggtaagttccgggaacgttaccggtacggggacccgtaacgggtaaccccg

SEQ ID NO: 2266 - DNA, 637 bp, Homo sapiens
  misc_feature: GYAE6OF02FR3H1.45.75.G09.1.454.CMB.1.raw
tcagacgcgatcgacacgaccggtgctcgatttagtatagacatcaggggggggggtctcaggaggcagcgctctcgggacgtctccaccatggcctgggctctgctgctcctcactctcctcactcaggacacagggtcctgggcccagtctgccctgactcagcctgcctccgtgtctgggtctcctggacagtcgatcaccatctcctgcactggaaccagcagtgattttgggattataaccttgtctcctggtaccaacagccaccccggacgaacgaccccccaaaactaatactaattttagtaacgggacaacgtaacgccggccccgttcgggggttttcaagtccgtcttctcgtggcctccgtaagtctggacaacgaccggcccttccctagaactaactcgtccgtgggccttaccgacggctacgaggaccgaggctagtaatttacgtttctcgttcgctactattactcgcgtaagggaccagtaccgtagttgggtcgttcgggcggacgggtacgaggttcgaccgtaccgttaggtcgacggtcccgaagggtcctccggtccccccgttaggtcccgttacgtcccgttacccgtccccggtccccttccctaccgg

SEQ ID NO: 2267 - DNA, 660 bp, Homo sapiens
  misc_feature: GYAE6OF02GJYEM.45.75.G09.1.454.CMB.1.raw
  modified_base (305)..(305): a, c, t, g, unknown or other
  misc_feature (305)..(305): n is a, c, g, or t
tcagacgcgatcgacacgaccggtgctcgatttagtatagacatcaggggggggggtctcaggaggcagcgctctcgggacgtctccaccatggcctgggctctgctattcctcaccctcctcactcagggcacagggtcctgggcccagtctgccctgactcagcctgcctccctgtctgggtctcctgacagtcgatcaccatcccctgcacgtggactccagcggtagacgttacttgtttttaagatgtctcctggtatcagcaaccaccaggccaaacgccccctaaatcatcattttangatgtacaataactccggtccctcgtacggggtttctcatcctcgttctcgtacggcctaccgaagtctaggactaacgtaaccggtccttaccctcgaaccctacttccttaccggtcggcctccgtacgggccgttaagaaccggtcgaaggtacgttagtaacgtttacttaaccgtgacacggacctaactaattaagtttagttaacgtttcgttacccgtacggttacggttacggttcggacgggtaacgtaccgtagttaccggtaccggttacgtaacggttacgaaccggtcccaggtccctaccggtccccgtcggtcctaccggtttcgtacccgttcccccg

SEQ ID NO: 2268 - DNA, 645 bp, Homo sapiens
  misc_feature: GYAE6OF02JEWCQ.45.75.G09.1.454.CMB.1.raw
  modified_base (249)..(249): a, c, t, g, unknown or other
  misc_feature (249)..(249): n is a, c, g, or t
  modified_base (269)..(269): a, c, t, g, unknown or other
  misc_feature (269)..(269): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctcgccctgactcagcctgcctccctgtctggtctcctggacagtcgatcaccagtccctgcactggactccagcggtgtacgttacttgtttttaagntgtctcctgtatcagcaacnccaggacaacgccccaaactcactactatttactgtactagtacaaactactccgtacctcgtacgggtttctacgtactcgtcttctcgtacgtctacctaagtctaggactaagtaccgtcctccgtcgtaaccgtcttcctcgtcggtccgtaccgtacgtacgtacggaacgacgaggtactgtaacttagttacgtcgactacgtactaactacttaattacgttacgttactttccgtaaccgttcgggtttagtcccggggtacggttaaccgggtaccgttaaggttccgtaaccgtcggtaacgtcgtacggtaaccgaacggtcgtcccgtacccgtcgtaacctcgttaccgtcccgttaccccg

SEQ ID NO: 2269 - DNA, 673 bp, Homo sapiens
  misc_feature: GYAE6OF02HD1US.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggatccagcggtgacgttacttgtttttaagatgtctcctggtatcagcaacaccagacaaacgacccccaaatcactctattactgatgtctaaataacgtccggccctcgtacggggtttctcgtataccgtcttctcgttcggcctaccgtaagtccgttggacctaacgtaccggccctaccctacgtacctactccttcgtacgggtcctaccgacgggtacgttacggaacgacggacggtcttaggtaatttaacttaccgtagtaccgagtacctaataacttattaagtttactttacggttacccttaggttaccggttacgttcgggaccggtaacggtaaccgtagttaccggtaccggttaccgtacggtaccgaacgtacccgtaccgccggtacccgtccccggttaccggtcctaacccgttccgtccgtttaccccccgg

SEQ ID NO: 2270 - DNA, 551 bp, Homo sapiens
  misc_feature: GYAE6OF02FZXSG.45.75.G09.1.454.CMB.1.raw
  modified_base (301)..(301): a, c, t, g, unknown or other
  misc_feature (301)..(301): n is a, c, g, or t
  modified_base (323)..(323): a, c, t, g, unknown or other
  misc_feature (323)..(323): n is a, c, g, or t
  modified_base (420)..(420): a, c, t, g, unknown or other
  misc_feature (420)..(420): n is a, c, g, or t
  modified_base (425)..(425): a, c, t, g, unknown or other
  misc_feature (425)..(425): n is a, c, g, or t
  modified_base (438)..(438): a, c, t, g, unknown or other
  misc_feature (438)..(438): n is a, c, g, or t
  modified_base (543)..(543): a, c, t, g, unknown or other
  misc_feature (543)..(543): n is a, c, g, or t
  modified_base (545)..(545): a, c, t, g, unknown or other
  misc_feature (545)..(545): n is a, c, g, or t
  modified_base (547)..(550): a, c, t, g, unknown or other
  misc_feature (547)..(550): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggagggcctggagtgggtctcagttaatttttagtacaggcacagcgtactacgcagacttccgttaagggccgattcaccatctccagagactaattccaggaacacggttgtttcttagaaatgaaaccacctgacgtaccgaggacacggctactatattactgtgcgaganactacgaaccagaacccggaanaacgttcaacaactacgtacggtataggtacgtcgtgggaccaagggaccacgtcaccgtctcctcacgcctccacgacggccagtccgtcctcccncgccncctccacagcacncctcgcgggcacgacgccgccgtcggctcgccgtacggtacacggacctacgttcgtacgtctcgtcgtgtacgacgcggtcgtcggacgaggtcgacactagcncngnnnnc

SEQ ID NO: 2271 - DNA, 853 bp, Homo sapiens
  misc_feature: GYAE6OF02H2CS7.45.75.G09.1.454.CMB.1.raw
  modified_base (193)..(193): a, c, t, g, unknown or other
  misc_feature (193)..(193): n is a, c, g, or t
  modified_base (258)..(258): a, c, t, g, unknown or other
  misc_feature (258)..(258): n is a, c, g, or t
tcagacgcgatcgacacgaccggtgctcgatttagtatagacatcaggggggggggtctcaggaggcagcgctctcgggacgtctccaccatggcctgggctctgctattcctcaccctctcactcagggcacgagggtcctgggcccagtctgccctgactcagcctgcctcctgtctgggtctcctggacngtcgatcacactccctgcactggactaccgaggtcggtagtacgtttacgttaggtttttaaagngttcgttcttccgttagggttactccgaaggtaccaaaaccgtccccgaaacggggaaccctaaaacccggtacccccccaaaaacttccgaaacctttacttaaacccgtttttaagtaccggttaaacgttacggttaaactaaacgtttaaaccggtacccgggtcccgttttaaccggggttacggggttttccctacgttaccgttccggttcgttttacccgttccgtaccggggttacctaacccggtaaggttccggttacggtacctaaaccggtttcccggaccctttacccgtacggtaacctacgtttcccgtcggttacgggtccgtaccggtaaccggtacgttaacggaaacggacggacgggtacttaacgtactttacgttcgtacgtcgttccgtactatacgttaacgtcgggttaacgttagggttaacgtttacggttccggttttaggtccggggttacggacgggtaccggaaccgtacggtaccggttccgtaaccgttccgttacggtaccgtaccggacccgtacgggtcccctaccggttccccggtacggtacctacccgttacccg

SEQ ID NO: 2272 - DNA, 543 bp, Homo sapiens
  misc_feature: GYAE6OF02G54AE.45.75.G09.1.454.CMB.1.raw
  modified_base (388)..(388): a, c, t, g, unknown or other
  misc_feature (388)..(388): n is a, c, g, or t
  modified_base (391)..(391): a, c, t, g, unknown or other
  misc_feature (391)..(391): n is a, c, g, or t
  modified_base (396)..(396): a, c, t, g, unknown or other
  misc_feature (396)..(396): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgctattttaaaaggtgtccagtctgaggagcagctggtggagtcgtgggggagcttggtccaggccgggggggtccctcagactctcgtgtgcagcctctggattcaccgtcagtggcagtcttcctgagctgggccgcaggctccgaggggacgggcctgggagtgggtctcagttaattttgacaggcacagctactacgcagtattccgtaagggcattcacntcncaganacatcgagaactcggtgttctagaatgaaccaccgtgacgaccgagacacggctactactattacgtgtgacgagtagactacggaacccagaacccggaataaaccgttctaactaacgtacgttaacggtagtacggagtaccgg

SEQ ID NO: 2273 - DNA, 730 bp, Homo sapiens
  misc_feature: GYAE6OF02G2LBR.45.75.G09.1.454.CMB.1.raw
  modified_base (244)..(244): a, c, t, g, unknown or other
  misc_feature (244)..(244): n is a, c, g, or t
  modified_base (260)..(260): a, c, t, g, unknown or other
  misc_feature (260)..(260): n is a, c, g, or t
  modified_base (729)..(729): a, c, t, g, unknown or other
  misc_feature (729)..(729): n is a, c, g, or t
tcagacgcgatcgacacgaccggtgctcgatttagtatagacatcagggggtccctcagactctcgtgtgcagcctctggattcaccgtcagtggcagcttcctgagctgggtcccgccaggctccagggaagggcctggagtgggtctcagttaatttttagacaggcacagcgtactacgcagattccggttaagggccgtattcaccatcctccagagacaattccgaaggaacacggttntttctagaatgaaccnccctgacgacccgaggaccacggctctatattactgtgcgagagatcgaacccagacccggaagaaacttcgaacaactacgtacgtactaggactcgtggggaccgaaggggacccaaccgggtcaacccggttctacctcacggtccctacccgaaccgaacggggccctaacgtcccggttaccctttcccccgtaggacccctacccctcccgtacccaaaggtaccgtaccgacccgttaccgggttccgggggaccctaaccggacgggaccccgggtccgttaccggggtccgtcggtacccgttcggtaccgtaacggtacccttacccgtttccgtaccgtacggttcccggaccggttccgttacgggtaaccgggccggggggtaaccgttcgggggaacccggttaacgggacccggttaacgaacgttccgggaacttcggacgtagccgtggacng

SEQ ID NO: 2274 - DNA, 683 bp, Homo sapiens
  misc_feature: GYAE6OF02JY3FI.45.75.G09.1.454.CMB.1.raw
  modified_base (293)..(293): a, c, t, g, unknown or other
  misc_feature (293)..(293): n is a, c, g, or t
  modified_base (501)..(501): a, c, t, g, unknown or other
  misc_feature (501)..(501): n is a, c, g, or t
tcagacgcgatcgacacgaccggtgctcgatttagtatagacatcagggggggagaggagcccagcactgggattccgaggtgtttccattcagtgatctgcactgaacacagaggactcgccatggagtttgggctgagctgggtttccttgttgctattttaaaggtgtccagtctgaggagcagctggtggagtctgggggagcttggtccaggccggggggtcctcgagactcgtcgtgtgcagcctctggattcgaccgtcagtggcagccttctgagcgtgggtccnccgaggcctcgacggggaacggtcccgtgggacggttcgggtctccgtaaggttaacgtttttacggacgtacggtccgtacgaacggtaccgtacgtaccgctaggtacgtttaccggtaagggcctaattccgacctactcctcgagacgactaactccgaaggtacacggttgttactagtaaactcgaaccgtacctaggaacncccgaaggaccacgggtcttacgtacttaacgttacgtcgttacgcgtaacggtagtaccgtaacgaaccccaggtaaaccccggtaaagttaaacggttaccaaccgtaaaccgttaacgtaaccggttagttaccggtaacggtcccggttacgggacccggtaacggttaacccccggg

SEQ ID NO: 2275 - DNA, 639 bp, Homo sapiens
  misc_feature: GYAE6OF02F6HE6.45.75.G09.1.454.CMB.1.raw
  modified_base (219)..(219): a, c, t, g, unknown or other
  misc_feature (219)..(219): n is a, c, g, or t
  modified_base (243)..(243): a, c, t, g, unknown or other
  misc_feature (243)..(243): n is a, c, g, or t
  modified_base (305)..(305): a, c, t, g, unknown or other
  misc_feature (305)..(305): n is a, c, g, or t
  modified_base (475)..(475): a, c, t, g, unknown or other
  misc_feature (475)..(475): n is a, c, g, or t
  modified_base (490)..(490): a, c, t, g, unknown or other
  misc_feature (490)..(490): n is a, c, g, or t
tcagacgcgatcgacacgaccggtgctcgatttagtatagacatcaggggggggggtctcaggaggcagcgctctcgggacgtctccaccatggcctgggctctgctattcctcaccctcctcactcagggcacagggtcctggcccagtctgccctgactcagcctgcctcgtgtctgggtctcctggacaggcatcacatctcctgcactggaaccngcagtgacgttgttattataactntcgtctctacgtaacaacaaccaccgaggactaaaccgaccccaaactcatacgtatttacngtatacgtacagttaagtccggtccctagtacgggtttacgctacgtcgtctttctcgtggaccttacgacgtcgtcggactaaccgcccggtacttccctacgacctacgttcgtcgtaccggctaccgacggtcttggacggacggtacggtctagtacgtttaacgnttaccggactcgctntaagtactcgtaccgacgcgagacctacgtccaaacggttcgttaaaggttcggtacggtaccgggtacggaacggttaacgtacgttaccgaacccggttccgtaggtacccggacttacccggacgggtaccctaccccggtcccgg

SEQ ID NO: 2276 - DNA, 868 bp, Homo sapiens
  misc_feature: GYAE6OF02JF5SD.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcttgggttttccttgttgcttattttaaaaggtgtccagtctgaggagcagctggtggagtcgtgggggaggcgttgggtccgacgggcccgggggggttccctcgacgactccgtcggtgtgacacggcccttcgtggtacttccgacccggttaccaggttcggaccacggtccttccgtcggacgtcggttacggggtcccgccgacggtcccgtaccgggaagggggaacgggtcccggttaggggaacgggtttcgggtaccgttaccggtaaggttttaaacgttttttaacggtaccggaacgggtaccaacgtacggtaccgttaacgtacggacgtaacggtacgtttacccggttaacgggcccgttaactttacccgacctacgttaccgtacccgaaggtaccgtaaccgtaacgtttacccgaaacgggtaaaccgttaccgggttttagttttacccgttaaggtaaacctttaccggaaaccctacccgttacggaacccgggtaaccccggtaaggtacccgtaccggtacccttacgtttaacgttaaccgtttaccgtaggtacggtacgtaacggtacgttaccgaaccccgggtaaacccgtaaccggtaaaccccgggtaaagttaaacccgttaaccgttaaacccgtaaccgttaaccgttaaccgggttaacgttaccgggtacccgttaacccgggg

SEQ ID NO: 2277 - DNA, 636 bp, Homo sapiens
  misc_feature: GYAE6OF02F9LU2.45.75.G09.1.454.CMB.1.raw
  modified_base (399)..(399): a, c, t, g, unknown or other
  misc_feature (399)..(399): n is a, c, g, or t
  modified_base (445)..(445): a, c, t, g, unknown or other
  misc_feature (445)..(445): n is a, c, g, or t
  modified_base (627)..(627): a, c, t, g, unknown or other
  misc_feature (627)..(627): n is a, c, g, or t
  modified_base (634)..(634): a, c, t, g, unknown or other
  misc_feature (634)..(634): n is a, c, g, or t
tcagacgcgatcgacacgaccggtgctcgatttagtatagacatcaagggggtacccgtcagactctcgtgtgccagccgtactggattcacccgtcagtggcagtcttcccttcgacgctcgggtccgtccagggcctcccaaggggaagggccctgggaggtagggtctcgtagtaattttttagactaggccaacacgccgttactacgtcagacttaccgggttaaagggccgatttccacctactctccaggacacaattccgaggtaactacggtgtttcttagtaaatcgaacaccctgacgacccgaggaccacggctctactattactcgtgcacgtagatcgaacccacggaacccggaaagaacttccaacaactacctacggttacnggacgttcgtacggggccaagggaccctacggtcaccggtctaccncgacgtcctaccacgaacggccagtccgtcctcccgtcgcctaccctcctaccaacgtacgtcctaccttcgtcgggtactcgacgccggccgtcgggcgtcgccgtacggtcgaacgtcttacgtccgtcgtctccggtcgtcgcgacggcgcgtcggacgaacggtcgcgtacgtgcgancagctgntc

SEQ ID NO: 2278 - DNA, 903 bp, Homo sapiens
  misc_feature: GYAE6OF02JE1X8.45.75.G09.1.454.CMB.1.raw
tcagacgcgatcgacacgaccggtgctcgatttagtatagacatcagggggggggggtctcaggaggcagcgctctcgggacgtctccaccatggcctgggctctgctattcctccaccctcctcactcagggcacagggtcctgggcccagtctgccctgactcagcctgcctcctgtctgggtctcctggacagtcgatccaccactcccctgccacgtgggactccgaggccgggtgtaccgtttacttaggtttttaagtactcgtccttccgttagggtactacgacgaccaaaccaccccgaagggaccctaaaaccggacccccccctaaaaacgtcctaacttacttaacgttttagtacggtaattacgttaaccgtaaactaaccggttccgggtacccccgttagggttaacgggggttttcctacctacttcccggttcctttccgtaccggttcggtacccgttaaccgttaaacggttccgtacgggtaaccgttaaaccgttacccggggaccccttttaccccgaccgtaacccgttaccgtttccgttcccggttaaccggggtccctacccgggttacgggtaccgttacggaaaaccggtacggggacgttacggttaacggttaacgttttaacgttaccgtacggttacgaaccggttaacctaaaccggtatttaaacgtttcgtttacggttttaaccgttttaccgtacgggtttaccgggggttacgttacggggaccgggttaaccgggtaaccgttaacggttacccgttaaccgggttcccggttaagggtaccgacccggtaccggtaccgtaccggttccccggtaaccccggttcgacccgtttacgttacccgggttcccttaacccccgg

SEQ ID NO: 2279 - DNA, 837 bp, Homo sapiens
  misc_feature: GYAE6OF02HKBS3.45.75.G09.1.454.CMB.1.raw
  modified_base (805)..(805): a, c, t, g, unknown or other
  misc_feature (805)..(805): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccgtgtctgggtcctccgtggacagtcgatccgaccatcctccgtgaccacgtacggaaaccctaacgtaggtagaagttggtttaggggtagtttttttaaggtttcgttaccgttaccgttgggtaaccctaaacaaaccgaccccggacgaaaccgacccccaaaacttactactaacgtttagaacgggtacaaccgtaacggccggtacccgttcgggggtttaccaaggttccggcctttaccgtcctacggtcctaccgtaacggttcgtacggacctaaaccgccggcccttaccgtagaaccctaactcctccggtacggggtacccttccggacggtacgttacgggaacggtaacggtcgggtaacccgtggttaaacgttttaaacgttaccgtacggtaccgtttcggaccttaactagtaacgttcggtaaccgttagggttaaccgttacgtttaaccggttttcgggttacgggttacccggggtacgggtaaccgggtaaccgtaacggtccgttacggtaacccgttacgtaacgggtacgtaccggacccgtaacggtccggttcccggaccccgttaccgggtcctaaccgtcccggtttacccggtaaccccncccgttcccttaccgtaccgtacgttccccgg

SEQ ID NO: 2280 - DNA, 743 bp, Homo sapiens
  misc_feature: GYAE6OF02HSZDK.45.75.G09.1.454.CMB.1.raw
  modified_base (742)..(742): a, c, t, g, unknown or other
  misc_feature (742)..(742): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccgagggaagggcctggagtgggtctcagttaatttttagacaggcacagcgtactacgcagattccgttaaggccgattcaccatctccagagacaacttccaaggaacacggttgtttccttagaaatcgaaccaccctgacgacccgaggaccacggctactatattactgtgcgagagactaccgaaccccgaggtaaaccccggaagtaaaactttccgtaaacaaaccttaccgtaaccgggtagtacgggacgttccggtagggggacccaaaggggacccctacccggtacaacccggtccctaccccgtaacgcccctaacccaaccccggtaaacgggccccctaagttcccgggtttaccctttccccccgtacggtcctacccccttaccccgtacccgaacgaccgaccctacccgtccggtccggggtaccgaccgaccggccgggaccccggtcgggtccgtcgtacccgtcgggtaccgaaacggtaaccgttaccgttccgtaccgtacgttacccgcggttaccgtcggtacggaccggggtccggtacggaccggtaacgggaccgtacggtaacgtaccggagtacgcgtagcctagcgnc

SEQ ID NO: 2281 - DNA, 695 bp, Homo sapiens
  misc_feature: GYAE6OF02JYK0B.45.75.G09.1.454.CMB.1.raw
  modified_base (237)..(237): a, c, t, g, unknown or other
  misc_feature (237)..(237): n is a, c, g, or t
  modified_base (687)..(687): a, c, t, g, unknown or other
  misc_feature (687)..(687): n is a, c, g, or t
  modified_base (691)..(691): a, c, t, g, unknown or other
  misc_feature (691)..(691): n is a, c, g, or t
  modified_base (693)..(693): a, c, t, g, unknown or other
  misc_feature (693)..(693): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccagggaagggcctggagtgggtctcagttaatttttagacaggcacagcgtactacgcagattccggttaaggccgattcaccatctccagagacaattccaggaacacggttntttcttgaaatgaactaccctagacgacccgaggacacggctctaagtattacgtgtgcggtaagagactaccgaacccgacggaacccgggtaaataaacgttcctaacaaacgttaacgtaccggtaagttcggacgtcgtaggggaccgaaggacccgtacccgtactaccgtacctccgtacgacgcccttacaacccgaacgggcccctagttccgggtcccttaccccgtccggtaccacccccttaccgtacccctaaacgaccgtcctacccgtaccggtaccgggacgtaccgtaccggacccggtccgtaccggcgtccggccgtacggtaccgaacggtacccgttacccgttaccgtaccggttaacctccggtaccgtctacgggtaccggcgggttccggacggccggtaacgcggaaccgacgtgtatcgtacgngcgngngc

SEQ ID NO: 2282 - DNA, 717 bp, Homo sapiens
  misc_feature: GYAE6OF02FVTSR.45.75.G09.1.454.CMB.1.raw
  modified_base (192)..(192): a, c, t, g, unknown or other
  misc_feature (192)..(192): n is a, c, g, or t
  modified_base (269)..(269): a, c, t, g, unknown or other
  misc_feature (269)..(269): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagcgtgggttttccttgttgctaattttaaaggtgtccagtctgaggngcagctggtgagtgtggggagcgttcgtccagggccggggggtccctcacgtactctcggtgtgcacgcctgtcggnttcacgtcgagtgcagtcttcctggatcgtcggtccgccgtacggctaccggaggggaacggtccgtagggacggtcgggttctacgtagttaacgttttaggtacgagggctaacgaggtacctaacgtacgcgaacggttaacgtttaccgggtaacgggacccgttaacttaccgacccttaattacccgtaccgtaacggaaccgtaaccgttaaaccttacccggaaacgggtaaccgtaccgggttacggttttaatttaacgaaacttaacggaaaccctacccggtaggaacccgggtacccggaaacggtaccgaacccggtcgttaaccgttaacttacgtaccttggtaggaccgtaggacaccgtaccgaacccgtacgtaaaccggaagtacttaccgaataacccgtacgaacggttagtcggtaccgtacggg

SEQ ID NO: 2283 - DNA, 827 bp, Homo sapiens
  misc_feature: GYAE6OF02JVG3O.45.75.G09.1.454.CMB.1.raw
  modified_base (801)..(801): a, c, t, g, unknown or other
  misc_feature (801)..(801): n is a, c, g, or t
tcagacgcgatcgacacgaccggtgctcgatttagtatagacatcaggggtcccgtcagactctcgtgtgcagcctctggattcaccgtcagtggcagcttcctgagctcgggtccgccaggctccgagggaagggccgtggaggtgggtctcagttaatttttagtaccggacgacacgacgtacgtacgaccgacgagttacgtttacgggaacgggtacgtctaccgactactacctacgagacaaacttaccgacggaacgacggttacgttcgttagtaactagtaacaccgtacgacggaccgacggaccgacggaccgtacgtattacgttacgtagtcggtacgaggtagacgtacgaacccgtaccggaaaccggaacttttttaaaccgaatccggtaaacctacgtaacgtacggtagtacggtacgtcggacggacccgtaaccgggaccaccgtacgcccctacgtccaccgtcaccctaccgaacccgaccgtacgtccgtaccgtcccgtccggtcccgacctaccccgttacccgtaccgtacggaaccgacccgtacccggtacgggtaccgggtacggaccgtaccgggtaccgggtcccgggtaccggtcggtcccggtaccggttaccgggttacccgtaacggttaccccgtttaccggttacccggtaacgggtttacccgaacggttttacccgggttaccggtaccgggggtaaccgggtacccgggaccggtttaaccggggtaaccgcgggggggttacccttaacggttaccgngcgcgtacgtacgtacgcgtcgtacg

SEQ ID NO: 2284 - DNA, 790 bp, Homo sapiens
  misc_feature: GYAE6OF02ICQXU.45.75.G09.1.454.CMB.1.raw
tcagacgcgatcgacacgaccggtgctcgatttagtatagacatcgagggggggggtctcaggaggcagcgctctcgggacgtctccaccatggcctgggctctgctattcctcaccctcctcactcgagggcacgacgggtcctcgggcccagttctgccctgactacacgcctgccctcctgtctgggtctccgtgacagtcgactccacgtacctccctgacctacgtcggactccgagcggttacgtacgtttacgtttagtttttaacgatcgttccgtaccgttgttactcacgtaccaaccgaccgacggaaccaaaccgaccccctaaatcctaacgtacttaagtttaacgtacgtaacgttacgttaactaacgttaaccgtacccggtaccccgttacgggtttaccggggtttacctacgttaccgttaccggttcctttccgttacgtcggtaccttaaccggtacgttccgtaacgtaaccgtaaaccgttcccggtaccttacccgtacgtaaccctatttacccggtcgtccgggtaacctaccgtacggtacccggtaaggtaaccggaccggtacgtaacgtagtttaaacgttaagttacgtacggtacaacgtacccgtaattaaagtacgtttaagttaacgtttcgttaaccgtacggttcggttacgtacgggacggtaagtaccgtagtaccgtaccgtacggtataccggacgaccgtaacgcccgtccggtcccgtcgtactaccctttccgtccgttaccccg

SEQ ID NO: 2285 - DNA, 708 bp, Homo sapiens
  misc_feature: GYAE6OF02J2VIU.45.75.G09.1.454.CMB.1.raw
  modified_base (193)..(193): a, c, t, g, unknown or other
  misc_feature (193)..(193): n is a, c, g, or t
  modified_base (213)..(213): a, c, t, g, unknown or other
  misc_feature (213)..(213): n is a, c, g, or t
  modified_base (238)..(238): a, c, t, g, unknown or other
  misc_feature (238)..(238): n is a, c, g, or t
  modified_base (257)..(257): a, c, t, g, unknown or other
  misc_feature (257)..(257): n is a, c, g, or t
  modified_base (274)..(274): a, c, t, g, unknown or other
  misc_feature (274)..(274): n is a, c, g, or t
  modified_base (385)..(385): a, c, t, g, unknown or other
  misc_feature (385)..(385): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgccctcctgtctgggtctcctggacngtcgatccaccacttccccngccacgttggactccgaggtcggtntacgttacttgttttaagntgtctcgtgtatcgacnctaaccaccgaggaccaaaccgccccctaaactcctaacttcctaattacgtgtacgtgtacaaataccgtccggtacctacggttacgggttcctcgtactcgtcttccncgtcggctaccgtagtcgtcggactaacgtccggtaccctccgtcgtaacctcgttcgtccggtcgccgtcgacggtcgaaggacggtacggcgttactagtaagtttacgttacgcggttacaactactaacgtaatttacgtacgttttagtccgtttaacctgggttaaccgtttcgaccgggtacggaaccgttacgtaccggttacgacccgtttaggtaaaccggtccgtaaccgtacccggtaagtccccgggttaccccgtaccccggttaacgttccccgttacccggttacccgttaccccgtttaccccccg

SEQ ID NO: 2286 - DNA, 906 bp, Homo sapiens
  misc_feature: GYAE6OF02FTB2V.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatgggagtttgggctgagcgtgggttttccttgttgcttagttttaaaaggtgtccagttcgtgtaggagcagtcgtggtaggagtcggtagggggaggtcgtttggtccgtacgggcccggggggttccctcgacggtactcgttcgtgtacgcgacgtcctcgtcggacttcaccgtaccgtaggtcgggactacggtcttccgttggtaccgtcggttcggggtaccccggtccggtacgggtccccgtaccggaacggggggtaaacggggtccccgttaggggtaacgggtttaccggggttccggttacggttaacggttttaaacgtttttttacggaaaccgttaggggtacccgaacggttacgggtacccggttaacgtaccgtaaccggttaaggtaaacccggtttaccggggtttaaacccggggtcccttaacccggtttaaccgtaacccggtttctttaaccccggttaacccgtaacggtaaaccggtaaacctttaaccggtttacccgaaaacgggttaaccccgttaggggttacccttttttaacggttacggtaaacgtttaccggaaaacccgttacccgttaacgggaccgtaacccgggaacgggtaccgaaccggtctttacggtaactttaaccgttactaggttcgacgggtacaggttaacccgaccgtaccggaacggtaacccgggtaaagttaccgttacgtaaactccggtaagttaccggtattaccgggctttaacccgggg

SEQ ID NO: 2287 - DNA, 660 bp, Homo sapiens
  misc_feature: GYAE6OF02HXR0S.45.75.G09.1.454.CMB.1.raw
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctcgccctgactcagcctgcctccgtgtctgggtctcctggacaggcgatcacatcctctgacactggaaccagcaggtcgacgttggttaattataactatcgtctccgtggtaaccaacaacaccaggacaaacgacccccaaactcaatgatttatgtatcgtactaagtaactccggcccttaggtagggtttctagtattcgtcttcgtacgtcggacctaccgtaagttcgtacgacaaccgtccggtacccttcccgacgtaacctacgttcctcggtacgggccttaccgacggtcgtacgggacggtacggaggtcgtagtactttacgttacgtcgacgtacgtctactaagttgtaccgacgaccgacacgtactacttacgtaccttacgtaacgttagtaccggaacgggtaacggaaccgtaagtccgtaaccggttaacccgtcgtttacggaccgtaaccggacccgtaacgggtccttaccccggtaccccgg

SEQ ID NO: 2288 - DNA, 843 bp, Homo sapiens
  misc_feature: GYAE6OF02I1P8E.45.75.G09.1.454.CMB.1.raw
  modified_base (695)..(695): a, c, t, g, unknown or other
  misc_feature (695)..(695): n is a, c, g, or t
  modified_base (739)..(739): a, c, t, g, unknown or other
  misc_feature (739)..(739): n is a, c, g, or t
  modified_base (746)..(746): a, c, t, g, unknown or other
  misc_feature (746)..(746): n is a, c, g, or t
  modified_base (760)..(760): a, c, t, g, unknown or other
  misc_feature (760)..(760): n is a, c, g, or t
  modified_base (771)..(771): a, c, t, g, unknown or other
  misc_feature (771)..(771): n is a, c, g, or t
  modified_base (785)..(785): a, c, t, g, unknown or other
  misc_feature (785)..(785): n is a, c, g, or t
  modified_base (837)..(837): a, c, t, g, unknown or other
  misc_feature (837)..(837): n is a, c, g, or t
tcagacgcgatcgacacgaccggtgctcgatttagtatagacatcaggggggggagaggagcccagcactgggattccgaggttgtttccattcagtgatctgcactagaaacacagaggactcgccagtggtaggtttgggctgtagtcgttcggtttttccgttgttgtacgttaagttttaaaaggtcgttccgtagtcgtaggaaggacgtcgagtcgttgggttaggtacggtcgggttagggggacggttcgttcgggtccggaaccggggtcccgggggggttccctacggtaacggtaccgttccggttcggttcggtacgtccgtaccggtcccgttaccgttcggttaccgtttaccgtacccggttcggtaacgggttccggtacgttaccgttccgttcccggttagggtaccgggttccgggtttaccggggtccccggtcccggtaacgggttacccgtaaccggggaacgggggtaacggttccggtaggggtaccggtccgggttacgtaaccgttttaaggttttaacgttttaccgggtaacgtaacggaccttaacgtacggttaccgtacggtacgtaccgttaagtacccggtttaccggtacgtaccgtacgttaccgtactacgttaccgaacgacgtacgtaaactacgtacggaacgtacttcgggtttnttacggtaaactacgaaacctacgtaacggtaacgcgtaaccgngtaaccngtacgttatacgtntacgtgaacgnactaacgccgtaanccgacgtaacgaatccgtatacgatacgagttcgacgttcgaggcgaccggntacccg

SEQ ID NO: 2289 - DNA, 800 bp, Homo sapiens
  misc_feature: GYAE6OF02H70HO.45.75.G09.1.454.CMB.1.raw
  modified_base (257)..(257): a, c, t, g, unknown or other
  misc_feature (257)..(257): n is a, c, g, or t
  modified_base (314)..(314): a, c, t, g, unknown or other
  misc_feature (314)..(314): n is a, c, g, or t
tcagacgcgatcgacacgaccggtgctcgatttagtatagacatcaggggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgactcaccactccctgccacgtggactccgaggcggtagtacgttacttagtttttaagntcgtctcgtggtatcacgcaaccaccgagacaaccgccccaaactcaatcaatttangtatcgtacaatacgtccggtccttacgtacggggttctactacgtccgtacttcgtcgtcgaccttaccgtaacgtcgttcggacgtaacgtaccggtccctaccgtacggacctacgtacgttacggtcggtcctaccggtacggtaccgtacggaacggtacgacgggtcgtaagttacgtttacgttacgtacgcgtaacgtaccgtaacttaacgttaacgttaacggtttaccggtttaccgttttaacccggtacgggttttaacggggtttaaccggttacccgggggtaaccggggtaaaccgggttaaccgttaaccgggtttaccggtaccccgggtttaacccgggttaacgggtaaaccgtacccgggtaaacccgggtaacccgggtcccggttaaccccgggttacccccggttacccgggtttaccccgtaacccggttttccccggttaaccccggtttacccccccgg

SEQ ID NO: 2290 - DNA, 754 bp, Homo sapiens
  misc_feature: GYAE6OF02F9Q0S.45.75.G09.1.454.CMB.1.raw
  modified_base (746)..(746): a, c, t, g, unknown or other
  misc_feature (746)..(746): n is a, c, g, or t
tcagacgcgatcgacacgaccggtgctcgatttagtatagacatcagggggtccctcagactctcgtgtgcagcctctggattcaccgtcagtggcagcttcctgagctgggtccgccaggctccgagggaagggcctggagtgggtctcagttaatttttagacaggcacagcgtactacgcagacttaccggttaagggccgattcactatctccagagacaacttccaggaacgacggttgtttactagaactgaacctacctagacgacccggagaccacggctactatacttactgtacgtcgaggagtacgtaccgaacccgaaggaaccccggtaaagtaaacttacctaaacgaacttaaccgtaacggttaaggtcgggtaacggtccggttcgggggaaccgtaaaccggggacccgtaaccggtccgaaacccggttccttcccgtacaccggtccctacccgaacccggtaacgggtccccaacggttcccggttcccctttaccccggtccggaccctaccccgttcccctaccccgtaacgaccgtcctacccgtcggtccggggactaccggaccggacccgggtcccgtcgggccgtccggtcccgtacgggtaccgaacgggtacccttaccgttacccggttacgtaccgttaccggtcccgttacggtcgggacggtaccgggcggtaccgggtacggacggggtaccggtacgacgtagcgtgagncgtgctag

SEQ ID NO: 2291 - DNA, 720 bp, Homo sapiens
  misc_feature: GYAE6OF02IFJ2A.45.75.G09.1.454.CMB.1.raw
  modified_base (277)..(277): a, c, t, g, unknown or other
  misc_feature (277)..(277): n is a, c, g, or t
  modified_base (298)..(298): a, c, t, g, unknown or other
  misc_feature (298)..(298): n is a, c, g, or t
  modified_base (353)..(353): a, c, t, g, unknown or other
  misc_feature (353)..(353): n is a, c, g, or t
  modified_base (707)..(707): a, c, t, g, unknown or other
  misc_feature (707)..(707): n is a, c, g, or t
  modified_base (712)..(712): a, c, t, g, unknown or other
  misc_feature (712)..(712): n is a, c, g, or t
  modified_base (717)..(717): a, c, t, g, unknown or other
  misc_feature (717)..(717): n is a, c, g, or t
  modified_base (719)..(720): a, c, t, g, unknown or other
  misc_feature (719)..(720): n is a, c, g, or t
tcagacgcgatcgacacgaccggtgctcgatttagtatagacatcaggggtccctcagactctcgtgtgcagcctctggattcaccgtcagtggcagcttcctgagctgggtccgccaggctccgagggagggcctgggagtgggtctcagttaatttttagacaggcacagcgtactacgcagtacttccgttaagggccgattcaccatcctccagagacaattccaaggacacggttgtttctagaaactgaacacccgtgacgaccgaggacncggctacatacttactgtcgngagagatccgaacccaggacccggaaagaacttcctaacaaacttagtacggtancggtacgtcgtggggacctaagggaccctaccggtctacccgtcttcccacgtaacgacccttcccgaaaccgaacggggtccccctagttaccccgggttttccccgtttaccccccgtcgggtcccctaaccccccgttacccttacccgtaaacggccgtaccgtacccgttcccgggttcgggggacccacggtaaccgggtcccggtcccggtacgggtcccgtcggtacccggttacggtaccggaaacgggtacccttaccggttaccgtaccggtacgttccgaccgttcgagggtccggtaccgggtacggtacgggtcgaaccgggtccggactaaggtacgcngtcgngtacngnn

SEQ ID NO: 2292 - DNA, 960 bp, Homo sapiens
  misc_feature: GYAE6OF02H0S5T.45.75.G09.1.454.CMB.1.raw
  modified_base (196)..(196): a, c, t, g, unknown or other
  misc_feature (196)..(196): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggtttttccttgttgctaattttaaaaggtgttccagtctgaggtancagctgggtaggagtcgtgggggagtcgttggtccgaggtcccgggggggtccctcgagactcgtcggtgtcgcgacggcccttcgtcgggtacttccgacccgttacgacggttacgggaccgagttccgtttcccgtaggtaaccggtcggttcggggttacccggaccggtacgggtcccgtacccggtaaggggggtaaaccggggtcccgtttaggggtacgggtttacggggttcgtaaccgttaaggtttttaaaacgttttttacggtaacggtaccggtaccgaacgtaacggtaccgttacccgttaacggactaacgggttaagtttacccgggttaaaacggggtcccggttaacttttacccgaaacccgttaccgttcccgttaacccgaaagggtaacgttaaacccggtaaactttaccgggaaacgggttaaacccgtaccgggggtttttacgttttaaccgtttaaacgggttaaacgtttaaccggaaaccccgttaaacccccggttaagggaaacccggtaacccccgggggtaaacgggtaacccggaaaccccgggggttcctttaaacccgtttaaacctttaacggttttaaccgtaggttaaccgggtacgtaaggttacgaaccggtttacccggaaaacccgacgggtaaaccccggaaaacgttaaacctttaaccgaacccgttaaacgttaaccgttaaccggggttactacgggttaaccggttaccgggg

SEQ ID NO: 2293 - DNA, 901 bp, Homo sapiens
  misc_feature: GYAE6OF02FXZQP.45.75.G09.1.454.CMB.1.raw
  modified_base (193)..(193): a, c, t, g, unknown or other
  misc_feature (193)..(193): n is a, c, g, or t
tcagacgcgatcgacacgaccggtgctcgatttagtatagacatcaggggagctctgggagaggagcccagcactgggattccgaggtgtttccattcagtgatctgcactgaacacagaggactcgccatgggagtttgggctgagcttgggttttccttgttgcttattttaaaggtgtccagtctgaggngcagctggtggagtcgtgggggaggtcgttcggtccgagggtccccgggggggtcccctccgaacggtaccgtccgttcggtcggttcgccgacgcccttcgtcggtaagtttcctaccggtacgtaggtcggacacggtcctttcccgtaggacgtccgtcggggtcccggaccgacggtccgtaccggaaggggtaaccggtccgtagggtacggttcgggtacttaccggttaagttttaacgtttttacggtaacgacgggtacaacgtacggtaccgttaacgtaccgacgtaaacgttaacgtttacccgggtttaaaccgggaccgttaacgtttaccctaaccgtaccgtacccgtaacccgaaacgtacgtaaacttaaacccggtaaccggtaaacggtaaaccgttacggggtttaccgtttttcggttaaaggtaaacgtttaaccgtaaacccggttacccgtaacggaaacccgggtaacccgggtaacgggaaccggtacccggtaccttaaccgttaactttaaacgtttaccggtacggtacggaccgggttagaaccgggttacgtaaacccgggaaacccccggtaaccggtaaaccccgggtaaagttaaaaccctttaaccgtaaccgtaaacccgtttaaccggtttaaccgggtacggttaaccgggaccggtttaaaccggggg

SEQ ID NO: 2294 - DNA, 660 bp, Homo sapiens
  misc_feature: GYAE6OF02HXZBL.45.75.G09.1.454.CMB.1.raw
  modified_base (193)..(193): a, c, t, g, unknown or other
  misc_feature (193)..(193): n is a, c, g, or t
  modified_base (325)..(325): a, c, t, g, unknown or other
  misc_feature (325)..(325): n is a, c, g, or t
  modified_base (367)..(367): a, c, t, g, unknown or other
  misc_feature (367)..(367): n is a, c, g, or t
  modified_base (516)..(516): a, c, t, g, unknown or other
  misc_feature (516)..(516): n is a, c, g, or t
tcagacgcgatcgacacgaccggtgctcgatttagtatagacatcaggggggggggtctcaggaggcagcgctctcgggacgtctccaccatggcctgggctctgctattcctcaccctctcactcaggcacagggtcctgggacccagtctgccctgactcagcctgcctcctgtctcgggtctcctggacngtcgatcacactccctgcactgactccgagtcggtgtaaccgtttacttagtttttaacgtattcgttacttcgtaggttatacacgactaaccaccaggaccaaacgacccctaacacactatactttaanagtatagtacaagtaccgtccgtacctacggttacggttacnctactctcgttctacgtgtacctactagtacgtcgaactaaaccgtccgtaccctacccgtacgaccctattccgtccggtacgggttccctacggtaacggtacgtacggtaacgacgggagtactaacggttaattacttacgacgngtaacgacaacgtaattaagttaacgttacgttcgttaccgttacgggtgggttacgtccgggaaggtaacccggtaagtaccgttacggtcctacgtcggaacacgaccgatccgtccgaccgtagcctacgtcgtacctccc

SEQ ID NO: 2295 - DNA, 1065 bp, Homo sapiens
  misc_feature: GYAE6OF02HOGSX.45.75.G09.1.454.CMB.1.raw
  modified_base (270)..(270): a, c, t, g, unknown or other
  misc_feature (270)..(270): n is a, c, g, or t
  modified_base (302)..(302): a, c, t, g, unknown or other
  misc_feature (302)..(302): n is a, c, g, or t
  modified_base (308)..(308): a, c, t, g, unknown or other
  misc_feature (308)..(308): n is a, c, g, or t
tcagacgcgatcgacacgaccggtgctcgatttagtatagacatcagggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccatcccctgcacgtggactccagcggtgacgttacttagttttaagtatgtctctggtatcagcaacnccaggccaaacgcccccaaatcatctatttangtactntactaataacgtccgaccttgtagggtttctacatccgtctttactcgtaggtcctaccgtaacgttcgtacggtactaacgttcccgggtacccttacccgtacgtaaaccctacgttacccgttacggtccgggtacccgttaccccgtaacggggttccgttaaacgggaaaaccgggttacccgggtaacgggttacccgtttaacgggtttaaaccgttttaaaccgtttaaccggtttacgtaaaccccggtaacgggttaaacccgttaaacccgttaaacgtttaaaacgtttttaaaccgggtttttaaacccgggttttcccgggttttttaaaccccccggtaaaccgggggtttttaacccccggggggtttttaacccgggtttttaacccggggggggtaaaccccccggggggttaaaacgggggttttaaaacccccccgttaaacgggggttttttaccccccggggttaaaacccccgggggtttttaacccccgggttttaaacccgggggggttaaccccgggtttaaaaccccccggggggtttaaaaccccccccgggttaaaaaccccggggggttaccccccgggttttttaacccccccccccgggggttaaccccccccgggggttttaaaccccggggggttttaaacccccccggtttaaacccccgggttttttaacccccccgggttttacccccccggggttttttaaaccccccccccccccggg

SEQ ID NO: 2296 - DNA, 816 bp, Homo sapiens
  misc_feature: GYAE6OF02H8789.45.75.G09.1.454.CMB.1.raw
  modified_base (173)..(173): a, c, t, g, unknown or other
  misc_feature (173)..(173): n is a, c, g, or t
  modified_base (252)..(252): a, c, t, g, unknown or other
  misc_feature (252)..(252): n is a, c, g, or t
tcagacgcgatcgacacgaccggtgctcgatttagtatagacatcaggggggggggtctcaggaggcagcgctctcgggacgtctccaccatggcctggggctctcgctatttcctcaccctcctcactcgagggcacgtagggtcctcgggcccgaagtcgtcgccctgacncagcctcgcccttccctgtcgtcgggtcctccgtgggaccagtcgaatccacctaccgtcccctgccatggactaccgngtcggggtacttacgttactttagtttttaagtacgttgttccttccgtaggtactcgaacgtacaaccgaccgacgaaccgaaacccgcccctaaaactcgtaccttactaacgtttaagtcgtacgttactaacgttaaacgtaccgtacccggtaccgttcggttaacggggtttcctacgttactccgttcgttcgtacgtacggtcctacgacgttcggagtacaacgtcccgtaccttcgtcctactacgttccgtgtaccggtcccgtaccgtacggtactaagggaaccgtacggtcggttaacctaggtttaacttaacggttcgtactcgaacgtactaacgttaacgtacgtttagtttaaccggtttaccgttaccgttaaccgggttcggttaaccgggttcccgggaacgggtaaccggtaaccggtacggttacccgggtccggtttaccggtcggtaaccggtcccggtaaacccggcccgtttacccggccccgggttccccgtacgttacccccggtacgtttacccccgtcccgtttaccccccg

SEQ ID NO: 2297 - DNA, 681 bp, Homo sapiens
  misc_feature: GYAE6OF02GRKR6.45.75.G09.1.454.CMB.1.raw
  modified_base (471)..(471): a, c, t, g, unknown or other
  misc_feature (471)..(471): n is a, c, g, or t
tcagacgcgatcgacacgaccggtgctcgatttagtatagacatcaggggggggggtctcaggaggcagcgctctcgggacgtctccaccatggcctgggctctgctattcctcaccctcctcactcagggcacagggtcctgggcccagtctgccctgactcagcctgcctccctgtctgggtctcctggacagtcgatcaccactcccctgcactggactccagtcggtgtacgttacttgttttaagtatgtctctgtatcagcaaccaccaggacaaacgacccccaaactcatactaatttagtagtatgtacaagtaactcggccctcgtacgggtttctcgtatcgtcttctcgtgtactctacgtctgactacgtacgcctccacgacctactcgtcgtcggtcctcggacgtcgtacgaacggtacgtacggtcgttagtaacttactttacgtgaccgtanaccgtaactaacttaagttaacgtttaggtttccgttttacccgtacggttaccgggtttacgttccggggacgggtaaccgggtaccgtaacgggtttaccggtacccggttacgtacggtacccgtaaccggtacccggtaacggtacccgtcccggtacccccggttaccggtacccgttacccggttccttacccggttccccccg

SEQ ID NO: 2298 - DNA, 791 bp, Homo sapiens
  misc_feature: GYAE6OF02GCDA0.45.75.G09.1.454.CMB.1.raw
tcagacgcgatcgacacgaccggtgctcgatttagtatagacatcaggggagctctgggagaggagcccagcactgggattccgaggtgtttccattcagtgatctgcactgaacacagaggactcgccatggagtttgggctgagctgggttttccttgttgcttatttaaaaggtgtccagtctgaggagcagcgtggttggaggttcgtggggggaggtcgtttgggtcccgaggggtccccggggggggtccccttcgacggtaccgttcgttccggtgttcggccgaggtcccttcgtaggtaactttcctaccggtacgtacggttcggccgacgtccgtttccctaggtaagtccggtccgggggttcccgacccgtagggtccctacccgggtaggggaaaccggggtccctcgggggtaggtacgggttacctcgtaaggtttaagtttttaacggtacgagggtccgtagaacggtccgttaacgtacggtcacggtaaccgttaccggttaacggggacctacttcgaactcgttccaacgtcgagtaacgacttaccgaaggtaaccgtaggttacgtttgttaacgtaaagttacgaaaccctaccgtacgtaccggaccgtaacggaccgtaccggtaacttaccgttaaccttaagttacccgtggtttcgaacggtacgtagtaaccggttaacggaacccgtaacggaaacccgttaagaaacctttaccgtaactaaccgtaacgttacgtacgtacggtggttaacccgggg

SEQ ID NO: 2299 - DNA, 541 bp, Homo sapiens
  misc_feature: GYAE6OF01C2DDB.38.23.C01.1.454.CMB.1.raw
  modified_base (307)..(307): a, c, t, g, unknown or other
  misc_feature (307)..(307): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttggtccnccaggctccgagggacgggctggagtgggtggccatataaaccacgatggaactagaaaaagactatgtggactcgtagtgaagggccgattcaccgtctccagagacaacgccaagaattcactgtatttgcaaatgaacagcctgagagtacgaagacacggccaatatattattagtaagtaaaagatactattacgataagtgggtaggacggtacggtacgggtggtac

SEQ ID NO: 2300 - DNA, 498 bp, Homo sapiens
  misc_feature: GYAE6OF01DHY9X.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgttagcttggtaccagcagaaagcacgacagtcccctaagttgctcatttattggtcatctactcgggtgtccgggtccctgaccgattcagcggcagcggatcgtgggacagatttcactctcaccatcagcagccctgcagactgaagatgtggctagtttattactgtcagctaatattatggtatcctcggctcactttcggcggagggaccaagggtgaagatcaaggcgtaacg

SEQ ID NO: 2301 - DNA, 512 bp, Homo sapiens
  misc_feature: GYAE6OF01BB1OB.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacgggacatcgtgatgacccagtctccagactccctggctgtgtctctgggcgagagggccaccatcaactgcaagtccagccagagtctttgtcagctccaagaatatgagttcgttagcttggtaccagcagaaagcacgacagtcccctaagttgctcatttatggtcatctactcggtgtccgggtccctgaccgattcagcggcagcgatcgtgggacagtatttcactctcaccatcagcagcctgcagactgaagatgtgctagtttatactgtcagctaatattatggtacttccgtcggtctcgtacgtttcgggcggtacgggtaacccaagggtggacgagtacgaaggtcgtaaacgg

SEQ ID NO: 2302 - DNA, 492 bp, Homo sapiens
  misc_feature: GYAE6OF01AJHB7.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccagcagaaagcacgacagtcccctaagttgctcatttattggtcatctactcgggtgtccgggtccctgacccgattcagcggcagcggatctgggacagatttcactctcaccatcagcagcctgcagactgaagatgtgctagtttattactgtcagcaatattatggtatcctggctcactttcggcggagggaccaaggtgagatcaagcgtaacg

SEQ ID NO: 2303 - DNA, 490 bp, Homo sapiens
  misc_feature: GYAE6OF01B1GFX.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccagcagaaagcacgacagtcccctaagttgctcatttatggtcatctactcggtgtccgggtccctgaccgattcagcggcagcggatctggacagatttcactctcaccatcagcagcctgcagactgaagatgtgctagtttatactgtcagcaatatatggtatcctaggcttcactttcgggcggagggaccaaggtggagatcaagcgtaacg

SEQ ID NO: 2304 - DNA, 552 bp, Homo sapiens
  misc_feature: GYAE6OF01B70GH.38.23.C01.1.454.CMB.1.raw
  modified_base (353)..(353): a, c, t, g, unknown or other
  misc_feature (353)..(353): n is a, c, g, or t
  modified_base (383)..(383): a, c, t, g, unknown or other
  misc_feature (383)..(383): n is a, c, g, or t
  modified_base (389)..(389): a, c, t, g, unknown or other
  misc_feature (389)..(389): n is a, c, g, or t
  modified_base (411)..(411): a, c, t, g, unknown or other
  misc_feature (411)..(411): n is a, c, g, or t
  modified_base (500)..(500): a, c, t, g, unknown or other
  misc_feature (500)..(500): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttcgtgtaggctatttagaaggtgtccagtgtgaggtgcagttggtggaatcgtgggggaaacttggtccaggccgtggggggtccctgaagctctcctgtgcagcctctggattcattatttagtaatcattggaatggagtttgggccgccaggcctccgaggggacgggctgggagtgggtcgccacgttaanaaaccacgataggaactagaaaagctatgngactcngtgaaggcattcacgtctcganagacacgcaaagattcactgtattagacaaatgaacctgcctggatagtacgaagactacggcaattatagttaagttcgaagtaaagnttacattcgagttaagtgggtacgggtactaggggttacggtggtccttagg

SEQ ID NO: 2305 - DNA, 522 bp, Homo sapiens
  misc_feature: GYAE6OF01BEKIT.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatattagtaatcattggatgagttgggtccgccaggctccagggacgggctgggagtgggtggccactataaccacgatggaactgaaaaagctatgtggactctgtgaagggccgattcaccgtctccagagacaacgccaagaattcactgtatttgcaaatgaacagcctgagagtcgaagacacggccatatattatgtagtaaaagatacattcgatatggtggacgacgtacgggtggtacg

SEQ ID NO: 2306 - DNA, 536 bp, Homo sapiens
  misc_feature: GYAE6OF01D2W3K.38.23.C01.1.454.CMB.1.raw
  modified_base (406)..(406): a, c, t, g, unknown or other
  misc_feature (406)..(406): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgttagcttggtaccagcagaagcacgacagtcccctaagttgctcatttatggtcatctactcgggtgtccgggtcctgaccgattcagcggcaggcgatcgtgggacagtatttcactctcaccatcagcagcctgcagactgaagntggtgctagttttatacgtgtctagactaatattagtggtacgttccgttacgggcttccgtagttttccgggcgggtaacggggaaccctaaggggttcggaaggaagttcgaaaggtccggtaaacgg

SEQ ID NO: 2307 - DNA, 495 bp, Homo sapiens
  misc_feature: GYAE6OF01ERY0D.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgttagcttggtaccagcagaaagcacgacagtcccctaagttgctcatttattggtcatctactcgggtgtccgggtccctgaccgattcagcggcagcggatctgggacagtatttcactctcaccatcagcagcctgcagactgaagatggtgctagtttatactgtcagctaatattatggtatcctcggctctacgtttcggcggaggaccaagggtgagatcaagcgtaacg

SEQ ID NO: 2308 - DNA, 535 bp, Homo sapiens
  misc_feature: GYAE6OF01CGJAU.38.23.C01.1.454.CMB.1.raw
  modified_base (403)..(403): a, c, t, g, unknown or other
  misc_feature (403)..(403): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgttagcttggtaccagcagaaagcacgacagtcccctaagtgctcatttattgtcatctacgtcggtcgtccgggtcctgaccgattcagcggcagcggatcgtggacagattcactctcacatcagcagctgcagactagaagntgtgctagtttatactgtacagtactaatattatggtactccgttacggtcttcgtaccgttttcgggacgggtaacgggtaacccggtaaagggttagggaacggtactaacggaaaggtccggtaaacgg

SEQ ID NO: 2309 - DNA, 495 bp, Homo sapiens
  misc_feature: GYAE6OF01BYATT.38.23.C01.1.454.CMB.1.raw
  modified_base (407)..(407): a, c, t, g, unknown or other
  misc_feature (407)..(407): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgttagcttggtaccagcagaaagcacgacagtcccctaagttgctcatttattggtcatctactcgggtgtccgggtccctgaccgattcagcggcagcggatctgggacagatttcactctcaccatcagcagcctgcagactgaagntgtggctagtttatactgtcagcaatattatggtatcctggctctactttcgggcggagggacccaaggtggagatcaaggcgtaacg

SEQ ID NO: 2310 - DNA, 484 bp, Homo sapiens
  misc_feature: GYAE6OF01BM3KD.38.23.C01.1.454.CMB.1.raw
  modified_base (377)..(377): a, c, t, g, unknown or other
  misc_feature (377)..(377): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgttagcttggtaccagcagaaagcacgacagtcccctaagtcgctcatttatgtcatctactcggtgtccggtcctgacgattcagcggcagcgatcgtggacagattcactctcaccntcagcagctgcagactgagatgtgactagtttatactgtacagctaatataagtgtagtcctagctcagtttcggcggacggaccaaggtcgagatcaagcgtaacg

SEQ ID NO: 2311 - DNA, 556 bp, Homo sapiens
  misc_feature: GYAE6OF01AFI8T.38.23.C01.1.454.CMB.1.raw
  modified_base (275)..(275): a, c, t, g, unknown or other
  misc_feature (275)..(275): n is a, c, g, or t
  modified_base (377)..(377): a, c, t, g, unknown or other
  misc_feature (377)..(377): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgaggaggccaccatcaactgcaagtccagccagagttcttttgtcagctaccaaagatatgagttcgtagcttggtaccngacagaaagcaacgacagtcccctaagtgctcatttatgtcatctactcgggtcgtcccgggtcctacgaccgtattcgacgcggtcaggcgatcgtggacngtattcactctcacatcagcagcctgcaagacagaacgtagtagtacgggtctaagttttaacttacgttgtacgaagtactaaattacttagttacgggtacttccgtcggtctcgttacgtttcgggcggtaaccgggtaaccgaagggtaggacgtaagtacgaaagcgtaacggg

SEQ ID NO: 2312 - DNA, 650 bp, Homo sapiens
  misc_feature: GYAE6OF01CYU50.38.23.C01.1.454.CMB.1.raw
  modified_base (352)..(352): a, c, t, g, unknown or other
  misc_feature (352)..(352): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatcattgatgagttggtccgcaggctcgagggacgggctggagtgggtggccactataaaccacganaggaactagaaaaagactaagtgtaggactcgtagtggaagggccagttccgaccgttccgtccgaagaacgaaccgaaaccgacctaaaaggtaaacttaccgtaacgttagttaactttttacggaacctaaaagttagaaaaccgacgacccttaggaacggtaaggtaccggaaaaggacccgaaccgggccctaaattacgttaatttaagtttagtaaggttaaaaacgattactagtttacgaatttagtacggggttacggaccggtaacgggttacggggtgtaaccgg

SEQ ID NO: 2313 - DNA, 529 bp, Homo sapiens
  misc_feature: GYAE6OF01APBND.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcattttctctgttgctctggatctctggagcctacggggacatcgtgatgacccagtctccagactccctggctgtgtctctgggcagaggccaccatcaactgcaagtccagccagagtcttttgtcagctcaagaatatgagttcgttagtcttggtaccagcagaaagcacgacacgtccctaagttgctcatttatgtcatctactcggtcgtccggtcctgaccgtattcgagcgcagcgatcgtaggactagtactttcactctcacactcagcacgcctgcagtacagaacgtatgtgtactagttttaacttacgtgtacagtactaatattagtcggttactccgtcgtactcgtacgtttcggcggtaacgggacgtaagggtcggaagtacgtacgaagtcggtaacg

SEQ ID NO: 2314 - DNA, 545 bp, Homo sapiens
  misc_feature: GYAE6OF01C0THM.38.23.C01.1.454.CMB.1.raw
  modified_base (232)..(232): a, c, t, g, unknown or other
  misc_feature (232)..(232): n is a, c, g, or t
  modified_base (312)..(312): a, c, t, g, unknown or other
  misc_feature (312)..(312): n is a, c, g, or t
  modified_base (423)..(423): a, c, t, g, unknown or other
  misc_feature (423)..(423): n is a, c, g, or t
  modified_base (531)..(531): a, c, t, g, unknown or other
  misc_feature (531)..(531): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccaccatcaactgacaagtccagccagngttcttttgtcagctaccaagaatatgtagttgttagtcttggtaccagcaagaaacgcaacgacacgtaccctaagtcnctctatttatgtcatctacgtcggtcgtccgggtcctgaccgattcagcgcgagcgatcgtggacagtacttcactctacacatcagcagcctgcagactagaacagtggngtacttagttacttacgtgtacaagtactaattagttagtacggttacgtccgtacggtcgtaccgttacgtttcgggacggtagggaaccgtaagggtcggaagtanaccgaagcgtaacg

SEQ ID NO: 2315 - DNA, 563 bp, Homo sapiens
  misc_feature: GYAE6OF01BID2J.38.23.C01.1.454.CMB.1.raw
  modified_base (347)..(347): a, c, t, g, unknown or other
  misc_feature (347)..(347): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaagtgtccagtgtgaggtgcagttggtggaatcgtgggggaaacttggtccagccgtgggggtccctgagctctcctgtgcagcctctggattcattatttagtaatcattggatgagttggtccgcgagctcgagggacgggctgggagtgggtgccatataaaccncgatggaaactagaaaaagtctagtgtaggactctgtagaacgggccattccgaccgtctaccgagacgaacaaccgacaaagaacttacactagttactttagactaaatcgaaacagtaccgtagaagtacgtacgaaacgacacggaccaatatattattagtagtaaaagtatactattagatagtagggtagacgtacggtagggtgtacg

SEQ ID NO: 2316 - DNA, 529 bp, Homo sapiens
  misc_feature: GYAE6OF01B8SNK.38.23.C01.1.454.CMB.1.raw
  modified_base (377)..(377): a, c, t, g, unknown or other
  misc_feature (377)..(377): n is a, c, g, or t
  modified_base (416)..(416): a, c, t, g, unknown or other
  misc_feature (416)..(416): n is a, c, g, or t
  modified_base (423)..(423): a, c, t, g, unknown or other
  misc_feature (423)..(423): n is a, c, g, or t
  modified_base (440)..(440): a, c, t, g, unknown or other
  misc_feature (440)..(440): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagtagttcttttgtcagctccaagaatatgagttcgtagcttggtaccagcagaaagcacgacagtcccctaagttcgcttacattttatggtctatcgtacgtcgggtcgtccgggtcctgaccgtattcgagcggtcgaggcgatcgngggacagtacttcatcctcaccatcagctacgctgcganactgaangtgagtctagttattcngtcagctaatatagtgtactccgtggtcctcgtacgttcgggcggtacgggaaccgtagggttcggaacgtagtacgagccgtaaacgg

SEQ ID NO: 2317 - DNA, 741 bp, Homo sapiens
  misc_feature: GYAE6OF01B08JM.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggtttccttgttgctatttagaaggtgtccagtgtgaggtgcaggttggtggaatcgtgggggaaacttggtccaggccgtggggggtccctgaagctctctgtgcagcctctggattcattatttagtaatctagttggatggtaggtttcggtccgccgaggcctccggaggggtacggggcgtgggaggtggggtcggacctaacgtaataaacccgacggaagtagggaaacttaaggaaaaaagactaagtggtacggacttcgttaggtaggaaacgggtccgtaacgttccgaacccgttcctaccgaaggaaacgaaccgaaaccgaccaaaaggtaactttaccgaacttagtttaagttttacggaacgtaaagtacggaaaccgacggtacccgtaaggaacggtaaacgggttacccgaaaacggtaacccgaacccgggtaccctaaagttaactttaaagtttaaagtttaaggtaaaggtttaaaaacgtattaacgttaacgtttacgtaaagtttaaggttacggggtacggtaaccgggtaacgggttacggggggtcggttaaacg

SEQ ID NO: 2318 - DNA, 523 bp, Homo sapiens
  misc_feature: GYAE6OF01EWRQM.38.23.C01.1.454.CMB.1.raw
  modified_base (366)..(366): a, c, t, g, unknown or other
  misc_feature (366)..(366): n is a, c, g, or t
  modified_base (408)..(408): a, c, t, g, unknown or other
  misc_feature (408)..(408): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagtctccaagaatatgagttcgttagcttggtaccagcagaaagcacgacagtccccaagttgctcatttatggtcatctacgtcgggtcgtccgggtccctgaccgattcagcggcagcggatcgnggacagtattcactctcacatcagcacgctgcagactgaagntgtgctagtttatactgtacagtactaattattagtgtacgtccgtacgtcgttctacggtttcggcgggtacgggtacctaaggggtcggaagagtacgaaaggtccgtaacgg

SEQ ID NO: 2319 - DNA, 777 bp, Homo sapiens
  misc_feature: GYAE6OF01EGPDD.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtcagtgtgaggtgcaggttggtggaatcgtggggaaacttggtccaggccgtgggggtccctgagctctcctgtgcagcctctggattcattatttagtaatctaagttggatggtaggtttcggggtcccgaccgacggcgtaccggacggggacgggggcgttgggagggttggggtcggaccgtaacgtaacgtaaacccgacggtaacgtagggaaaacccttaaaggaaaaaacgtaccgttaagttacgggtaacggtacgttcgtaggttacgggaaacgggtacccgttaacgttaccgtacccggttaccctaccgaaggtaaccgaaccgaaaccggaacctaaacgtaactttaccgtaacgttaggttaacgtttacgaactaaaacgtacgaaccgacgtaccgtaggtaacggtacggttaacggaaacgaccgaacgggtaccctaaagtttacgttaacgtttaacgttaaggtttaaacgttaaaaacggttaattaacgttaagttaaccgtaagttaacgggttacgggttacgggtaacgggtaaccggggttaggggtacggttaaccggg

SEQ ID NO: 2320 - DNA, 535 bp, Homo sapiens
  misc_feature: GYAE6OF01BFLHB.38.23.C01.1.454.CMB.1.raw
  modified_base (366)..(366): a, c, t, g, unknown or other
  misc_feature (366)..(366): n is a, c, g, or t
  modified_base (385)..(385): a, c, t, g, unknown or other
  misc_feature (385)..(385): n is a, c, g, or t
  modified_base (431)..(431): a, c, t, g, unknown or other
  misc_feature (431)..(431): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctctgggcgagagggccaccatcaactgcaagtccagccagagttcttttgtcagctaccaagaatatgagttcgttagcgttggtaccagacagaaacgcaacgacacgtcccctaagtcgacttactatttagttgtactactcgttacgtcgggtcgtcccgggtcctgaccgtnttcgagcggcagcgatcgnggacagtcttcactctcacatcagcacgcctgacagacgtagaagntcgtagacttagtttatacgtgtacatactaattattagtggtactccgcggtctcgtattcgggacggacgggtacgaaggtggaagatacgaagtcgtaacg

SEQ ID NO: 2321 - DNA, 660 bp, Homo sapiens
  misc_feature: GYAE6OF01B290Z.38.23.C01.1.454.CMB.1.raw
tcagtcgatcacgtcacgaccggtgctcgatttagtacacgtgattagggattgggggtctcagagaggagccttagccctggactccaagcctttgcacttggtgatcagcactgagcacagaggactcaccatggaattggggctgagctgggttttccttgttgctatttagaggtgtccagtgtgaggtgtcagttggtggaatcgtggggaaacttggtccagccgtgggggtccctgaagcgtctccgtgtcgcagcctcgtggtattcattatttagtaatcgatttggatggagtttcggggtccgccgtaggcctccggtaggggacggggcgtagggaggttggggtcggaccaacgttaactaaacccgacgacgtacgggaaactagaaaaagctagtggtagactcgtaggaggaacgggcctagttccgaccgtctccgagacgaactaacgaccaagtaacttacacttagttatttacgaacaaagtagaaccaggacctaggaacgacgtacgtaaacgaccgaacggaccagttaactaacgtttaagtttacgtaaacgtaaaaacgtcttacgtaacgtttaccgaagttacggtagggttacgggtacggtaacgggttaccggggtggtcgttaacgg

SEQ ID NO: 2322 - DNA, 532 bp, Homo sapiens
  misc_feature: GYAE6OF01CI3HD.38.23.C01.1.454.CMB.1.raw
  modified_base (451)..(451): a, c, t, g, unknown or other
  misc_feature (451)..(451): n is a, c, g, or t
  modified_base (495)..(495): a, c, t, g, unknown or other
  misc_feature (495)..(495): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcattatttagtaatcattggatgagttgggtccgccaggctccgagggacgggctgggagtgggtggccactataaaccacgatggaactagaaaaagctatgtggactctgtgaagggccgattcaccgtctccagacgacaacgacaaagattcactgtatttgactaaatgaacngacctagagagtcgaagacacggcatatattattgtagtaaagntacattcgattagtggtaggacgacggtgggtgtacg

SEQ ID NO: 2323 - DNA, 594 bp, Homo sapiens
  misc_feature: GYAE6OF01AML7K.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggtttcctgttgctatttagaaggtgtccagtgtgaggtgcagttggtggaatcgtgggggaaacttggtccagcctgggggtccctgaagctctcctgtgcagcctctggattcattatttagtaatcattggatggagttgggtccgccgaggctccgaggggacgggctgggaggtgggtggccacgtaactaaaccgacgatagggaactagaaaaagctaagtggtaggacttcgtggtaggaaacgggccgtaagttccgacccgttcctaccgaaggacgaaccaacgaccaaagtaacttccaacttagttatttacgactaaatgaaaccagcctagagagtacgaagacacggaccatattattagttagtagtaaaagtatactagttacgagttacgtgggtaggacggacggttcgggtggtacg

SEQ ID NO: 2324 - DNA, 535 bp, Homo sapiens
  misc_feature: GYAE6OF01EJGN8.38.23.C01.1.454.CMB.1.raw
  modified_base (409)..(409): a, c, t, g, unknown or other
  misc_feature (409)..(409): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctccaagaatatgagttcgttagcttggtaccagcagaaagcacgacagtcccctaagttgctcatttatggtcatctacgtcggtgtccgggtcctgaccgattcgagcggcagcggatcgtgggacagtatttcactctcaccatcagcagcctgcagctgaagntgtgctagtttattactgtcagactaatacgttagtggttacgttcccgtcggtcttaccgtacggtttcgggacgggtaacgggacccggtaagggtcgggaatacgtacgtaaggcgtaaacgg

SEQ ID NO: 2325 - DNA, 559 bp, Homo sapiens
  misc_feature: GYAE6OF01DCWYM.38.23.C01.1.454.CMB.1.raw
  modified_base (356)..(356): a, c, t, g, unknown or other
  misc_feature (356)..(356): n is a, c, g, or t
  modified_base (520)..(520): a, c, t, g, unknown or other
  misc_feature (520)..(520): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaggtgtccagtgtgaggtgcagttggtggaatcgtgggggaaacttggtccagccgtggggggtccctgaagctctcctgtgcagcctctggattcattatttagtaatcattggatgtaggttgggtccgccaggcctccgaggggacgggctgggagtggggtgccatactaaaccncgatggaaactagaaaaagctaatggtaggaactcgtggtaggaacgggccgtattccgaccgtctaccgagaacgacaacgacaagaacttcactgtaatttgacaatagaacagtcctagagagtacgaagacacggaccagtatattatgtataaagctanattcgtatagtggtacggacgtaggtacgggtgcgttag

SEQ ID NO: 2326 - DNA, 674 bp, Homo sapiens
  misc_feature: GYAE6OF01C1ERC.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttcctgttgcttattttagaggtgtccagtgtgaggtgcagttggtggaatcgtggggaaacttggtccagcgtgggggtccctgagctctcctgtgcacgcctcgtggattcattatttagaattcagttggatggtaggtttcgggtcccgaccgaggcctccggaagggggccgggcgtgggaggttggggcggccaacgtaacaaaccgacgagtaaggaaactaaggaaaaacgtactagtggtacggactcgtaggtaggaacgggtcccgtaattcccgaccgtcctaccgagaacgaaccgaaacgaccaaagaacttactacttgttatttacgaactaaatagaaccacgtacctaggagtaacggtacggaaacgacgaaccgggaccctaagttaatttaattaacgtttaaggtaaaggttaaaaagtattaacttaacgtttacgaaagtttaggttaggggttacggtaccggaacgttaagggttacggggttacggg

SEQ ID NO: 2327 - DNA, 543 bp, Homo sapiens
  misc_feature: GYAE6OF01D33FS.38.23.C01.1.454.CMB.1.raw
  modified_base (505)..(505): a, c, t, g, unknown or other
  misc_feature (505)..(505): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagcctggggggtccctgaagctctcctgtgcagcctctggattcattatttagtaatcattggatgtagtttggggtccgccgaggctccgagggacggggctggagtgggtgccactataaaccacgatggaaactagaaaaagctatgtggactctggtggaagggccgattccacgtctccagagacaacgccaagaattcactgtatttgacaaatgaacagctagagagtcgaagacaacggccattataattattgtagtaaagtattanattcgattagtggtggacgacggttacgggtgcgtaag

SEQ ID NO: 2328 - DNA, 619 bp, Homo sapiens
  misc_feature: GYAE6OF01A9GJP.38.23.C01.1.454.CMB.1.raw
  modified_base (472)..(472): a, c, t, g, unknown or other
  misc_feature (472)..(472): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagagggccaccatcaactgcaagtccagccagacgttcttttgtcagcctccaagaatatgagttcgttagcttggtaccagcagaaagcacgacacgtacccctaagttcgcttctatttattcggtactattcttaccggtcgggtccggttcccggggtccctcggacccgtacttcgacggcgggcaggcggacgtcggtacgggactaagtactttccaccttccgtaccgaacctagtaccagcacgccctggacaacgacgtagaagngtggtacggtacgttagtttaacttcgtagtaccgagtactaattagttagttacggttacgtcccgttcggtccgttcgttacggtttcggggaccgggtaaccggtaacggtaacgggtggaacgagtacgaaggtcggtaacgg

SEQ ID NO: 2329 - DNA, 732 bp, Homo sapiens
  misc_feature: GYAE6OF01C61M5.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatgtaattggggctgagcgttgggttttccttgttgctattttagaaggtgtccagtgtgaggtgcaggttggtggaatcgtagggggaaacttggtccagccgtggggggtccctggagctctcctgtcgcagcctctggattcattatttagtaatcattggatgaggttgggtccgccgaggctccggaggggacggggctgggacggtgggtcggaccaacgtaactaaaccgacgaagtacgggaaactaagaaaaaggactaagtggtagggacttcgtggtaggaacgggaccgtagttccgaccgtctaccgagaacgaacgaaccgtaccaaagtaacttacctacgttagttaacgtttagaacgtaaaacgtacgaaaccgtaaggtccccgttaaggaacggtaacggtaccgaaaaggtaacccggaaccggtacccgtaaagtttaaatttaacgttttaaatttaagggttaaagttaaaaaacggttaactaacgtttaaacgtttaaccggtaaagttaaccggtttggggttaacggggaccgttaaaccggggttaaccgggggttcggttaaacgg

SEQ ID NO: 2330 - DNA, 601 bp, Homo sapiens
  misc_feature: GYAE6OF01BQ2E0.38.23.C01.1.454.CMB.1.raw
  modified_base (591)..(591): a, c, t, g, unknown or other
  misc_feature (591)..(591): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttgggtccagccgtgggggtccctgaagctctcctgtgcagcctctggattcatatttagtaatcattggatggtagttgggtccgcaggctccgaggggacggggcgtgggagtggggtcggccactaagtaaccacgataggaactagaaaaagctatgtggactcgtgtgaacgggctatcaccgtctcgagtacgacacgaccaagtaacttcacttgtatttgactaaagtcgaactacgaccgtaggaaggacggtacgaaaggaccgaccggtaaccagttaacgttattaacgtttggtaaagtaaaaggtactacgtatttaccggaattaggtcgggtacggtacggacgggttcgggngggtctacgg

SEQ ID NO: 2331 - DNA, 544 bp, Homo sapiens
  misc_feature: GYAE6OF01E52G4.38.23.C01.1.454.CMB.1.raw
  modified_base (307)..(307): a, c, t, g, unknown or other
  misc_feature (307)..(307): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttggtccncaggctccgaggggacgggctgggagtggggtggccactataaaccacgagtggaaactaggaaaaagctatgtggactcgtggtgaagggcctatcaccgtctccgagacgacaacgccaagtaactcactgtatttcgactaaatgaacagcctagagagtacgaagacacggaccatatattagtagtagtaaagatactattcgaaatgtgggtgacgacggtgggtggtacg

SEQ ID NO: 2332 - DNA, 548 bp, Homo sapiens
  misc_feature: GYAE6OF01B8XLF.38.23.C01.1.454.CMB.1.raw
  modified_base (274)..(274): a, c, t, g, unknown or other
  misc_feature (274)..(274): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccngcagaaagcacgacagtcccctaagtgctcatttatgtcatctactcgggtggtccgggtcctgaccgattcagcggcagcggatcgtgggactagtactttcacttcctcaccgtatccaagcagccctagaccagactgaagtagtgtggctagttttattaccgtgtacagtactaattattatcggtagttccctcggtcttcgtaccgtttcgggcgggtaacgggtaacccgtaagggtacggaaggtaactcgaaaggcggtaacgg

SEQ ID NO: 2333 - DNA, 767 bp, Homo sapiens
  misc_feature: GYAE6OF01DORA0.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattgggctgagctgggtttccttgtgctatttagaggtgtccagtgtgaggtgcagttggtggaatcgtaggggaaacttggtccagtcgtgggggtccctgagctctctgtgcagcctcgtggtacttctattagtttagtaatctagttggattggtaggtttcgggtccgaccgtaggctcccggagggggaccgggtgtgggaggtggggtacggacctaacgtaaactaaacccgagtaagtacgggaaaccgtaaggaaaaaagtcgttaagtacggtagggtaaccttacggtaggttacggaaacggggtccccgtaagtttacccgacccggtttaccgacccgtaaggaacggaaacccgaaaccggaaccgtaaaacgtaaacgttaccgtaaccttaggtttaacgttttaacgaacttaaaacgttaacgaaacgtaacgtacccgttagaacgggtacgtaaccggaaacgtaaccgaccggtaactaacgttaattaagtttaacgttaggttaaaacggtaaaagtacgttaacttaaacgttaccggtaaagtttaacgttacgggttacgggtaaccgggtaacgggttaacggggtgggttaaccgg

SEQ ID NO: 2334 - DNA, 855 bp, Homo sapiens
  misc_feature: GYAE6OF01D64TL.38.23.C01.1.454.CMB.1.raw
tcagtcgatcacgtcacgaccggtgctcgatttagtacacgtgattagggattggggggtctcagagaggagccttaggccctggactccgaaggcctttgcacttggtgatcagcactgagcacagagactcaccatggaattgggctgagcttgggttttccttgttgtctacgttttagaaggtgtccagtgtcgaggtgccagttggtggaatcggtaggggaaccttgggccaggccggtcgggggtccctgaacgtctctccgtgtgcgtacgcctgtggtacttctattaatttagtaatacgtattcggataggtagttccgggtccgacggacggccgtaccggacggggtaccgggtcgtaggtacgggtgggtacgtaccaaccgtaagtaaacccgacggtaacgtacgggtaaacgtaaggaaaaacgtactttacggtacggttacggtaaccttacgtaggtacgggaacgggtacccgttaacttacccggtacccggttacccgttacccggaacggtaaccgtaacccgtaaaccccggaaccggtaaacgtaacccgtttaaccctaacgtttacgggtttaacgtttaaggtaaaccgttaaagtaacggtaaaccgtaacggtaaccgttaaggtaaccgggtaacggtaacccgggtaaaccgtaacccggtaaccggttaccccgtaattaaccggtttaaatttaggtttaacgttaaaagggggtaaaacttacgttaacgttaacggtttaccggtaacggttaagttacgggggtaaccggttccgggttaaaaccggggttccgggggttagtcccggtttaacggg

SEQ ID NO: 2335 - DNA, 569 bp, Homo sapiens
  misc_feature: GYAE6OF01AZPKK.38.23.C01.1.454.CMB.1.raw
  modified_base (456)..(456): a, c, t, g, unknown or other
  misc_feature (456)..(456): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagcctgggggtccctgagctctcctgtgcagcctctggattcattatttagtaatcattggatgagttggtccgccaggctccgaggggacggggctgggaggtgggtcggccactaataaaccgagataggaactagaaaaagactaatgtaggactctggtaggaacgggccgagttccgcctatcctaccgagacgaccaacgaccaaagacctacacgtgnggctgcacagtacgaaccggcctaggaggacgggcgaaccgacgacggctggtacgttaccttgtgtggacgagacccgcccccagtcggacgggacacgagggtcgggaacg

SEQ ID NO: 2336 - DNA, 531 bp, Homo sapiens
  misc_feature: GYAE6OF01ENOK3.38.23.C01.1.454.CMB.1.raw
  modified_base (349)..(349): a, c, t, g, unknown or other
  misc_feature (349)..(349): n is a, c, g, or t
  modified_base (467)..(467): a, c, t, g, unknown or other
  misc_feature (467)..(467): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgacaacgtccagccagtagttcttttgtcagctccaagatatgagttcgttagcttgtaccagcagaaagcacgacacgtcccctaagttgctcatttatgtcattcctacgtcgggtcgtccgggtcctgactntcagcggcaggcgatcgtggacagtactttcactctcaccatcagcagcctgacctagactagagagtgtggactagtttaactacgtgtacagactaatattagtggttactcccgngtctcgtagtttacggggccggtaagggaccgaagggtggaacgtaagtacgaaagcgtaacgg

SEQ ID NO: 2337 - DNA, 726 bp, Homo sapiens
  misc_feature: GYAE6OF01D68VA.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaggtgtccagtgtgaggtgcagttggtggaatcgtggggaaacttggtccagccgtgggggtccctgagctctcctgtgcagcctgtggattcattatttagtaatcattggatgagttcgggccgccgaggctccgaggggacgggcgtgggacggtgggtcggccaacgtaataaaccgacgagtaggaactaaggaaaaagtcgtaagtggtacggacttcgtggtacggaacgggtccgtacgttaccgacccggttctacccgaagaaccggtaaacccgaaacccggtaacccgaaaacggtaactttacctaacgttaggtttaacgttttagaactaaacgttaacggaaaccgaacgtacccgttagggaacggtaacggttaccggaaacgtaacccggaaccgggtaccctaagttaactttaagtttacgtttaaggttaaacggttaaaaacgtattacgttaacgtttaccgtaaagttaacggttgggttacggggtaccggtaaccggggttaccggggtgggttaaccgg

SEQ ID NO: 2338 - DNA, 710 bp, Homo sapiens
  misc_feature: GYAE6OF01CO9OI.38.23.C01.1.454.CMB.1.raw
  modified_base (675)..(675): a, c, t, g, unknown or other
  misc_feature (675)..(675): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtggggaaacttggtccagccgtgggggtccctgacgtctctcctgtcgcagcctgtggattcagtctttgatagtattagtggactagtgaccgtacggtcggggtacccggacaacggtcccgtaccggaagggggaacggggtcccggtagggtacgggttcggggtctacggtaaggtttagtttaaggttacgggaaacgtagggttagggtaagggaagttaaggggaccttaggtcggaccgggtaactcgttaggggtaggtaacggggtccgtaagtttacgacgtactacgtccgtaccgaaggtaaccgaacctaaaccgaccgtaaaacgtacctttaccccgtagttaacctacgtaaactaagtacgaaaccgtgtaccagtagacgtacgtggtaacggaccgtaccggttactttagtacttacgtggtaataacgttaaagttnttttaaggaggtttaagaggttaaaggttaacggg

SEQ ID NO: 2339 - DNA, 687 bp, Homo sapiens
  misc_feature: GYAE6OF01AKKZZ.38.23.C01.1.454.CMB.1.raw
  modified_base (265)..(265): a, c, t, g, unknown or other
  misc_feature (265)..(265): n is a, c, g, or t
  modified_base (267)..(267): a, c, t, g, unknown or other
  misc_feature (267)..(267): n is a, c, g, or t
tcagtcgatcacgtcacgaccggtgctcgatttagtacacgtgattagggattgggggtctcagagaggagccttagccctggactcccaaggccctttgcacttggtgatcagcactgagcacagaggactcaccatggaattggggctgagctgggttttccttgttgcttatttagaaggtgtccagtgtgaggtgcaggttggtggaatcgtagggggaaacttggtccaggccgtggggggtccctgacgctctcctgtncngcctctgattcatatttagaatctatggtatgagttggtccgccaggctccgaggggacgggctgggaggtgggtgcccaatacaaaccgagagtaggaaactagaaaaacgctagtgtaggactcgtaggtaggaacgggtccgtagttacccgtacgtcccgtaccaacggaacgtaaaccaacccggtaccaaaggtaaactttaccgaacgtttagttaagtttacgaactaaagtacgtaaacgtacgtaccgtaagaacggtacgtaaccggaaacggaccgtaacccgggactaagttaacttaagtttacgttaggtttaaacgtaaaaagttcttaacgttaagtttaccgtaattaaggttcgggtaacgggtaccggttaacggggttacggggtacggtacgttaggg

SEQ ID NO: 2340 - DNA, 532 bp, Homo sapiens
  misc_feature: GYAE6OF01EBT3N.38.23.C01.1.454.CMB.1.raw
  modified_base (374)..(374): a, c, t, g, unknown or other
  misc_feature (374)..(374): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttgggtccagcctggggggtccctgaagctctcctgtgcagcctctggattcatatttagtaatcattggatgagttgggtccgcaggctccgagggacgggctggagtgggtggccactaataaccacgatggaactagaaaaagctangtggactctgtagagggcattcaccgtctccagagacaacgccaagaactcactgtatttgacaaatcgaacagcctagagagtacgaagacacggaccagtactattatgtagtaaagtatcattcgattagtggtggacgacggtagggtggtacg

SEQ ID NO: 2341 - DNA, 641 bp, Homo sapiens
  misc_feature: GYAE6OF01AOGUY.38.23.C01.1.454.CMB.1.raw
  modified_base (313)..(313): a, c, t, g, unknown or other
  misc_feature (313)..(313): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagcttgggttttccttgttgcttattttagaaggtgtccagtgtgaggtgctaggttggtggaatcggtagggggaaacttggtccaggtccgtcggggggtcccctggaacgtccgtctccgtgtcgcagcctctggattcattatttagtaatcattggntgtaggtttgggccgcgaggctccgaggggacgggctgggaggtgggtcgacctactaactaaaccagagtaggaactagaaaaagtctatgtggactcgtggtacggaagggccgtattccgtacccgtccgtaccgagacgaaccaaccggaccaaagtacttactaacgttgttaatttcgaactaagtacgaacacgtcaggtagacggtacgaacgaccgacggacctaagttaacttattaagttagtaagttaaaagtattaactagtttacgaagttacggttaggtacgggtaccgggtaacgggttaggggtggtacg

SEQ ID NO: 2342 - DNA, 525 bp, Homo sapiens
  misc_feature: GYAE6OF01EH1ZA.38.23.C01.1.454.CMB.1.raw
  modified_base (345)..(345): a, c, t, g, unknown or other
  misc_feature (345)..(345): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccagcagaaagcacgacagtcccctaagttgctctatttatggtcatctactcgggtgtccgggtcctgaccgnttcagcggcagcggatcgtggacagtatttcactctcacatcagcagcctgcagactagaagtagtgtggcttaagtttacttacgtgttacagtactaattattagtggttacgtcctcggtctcgtacgtttcgggcgggtaacgggaccgtaagggtaggagatacgaagcgtaacg

SEQ ID NO: 2343 - DNA, 547 bp, Homo sapiens
  misc_feature: GYAE6OF01B3R3I.38.23.C01.1.454.CMB.1.raw
  modified_base (304)..(304): a, c, t, g, unknown or other
  misc_feature (304)..(304): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagaatcatggatgagtggtccncaggctccgagggacgggctgggagtggggtggccacgtaataaaccgacgatacggaaactagaaaaaagctatggtaggaactctggtaggaacgggccgattcaccgtctaccagacgacaacgaccaaagattacgaactgtatttgacaaatgaacagcctagagagtacgaagacacgacatatatatagtagtaaagatctatcgtaatagtggtggacgacggtacgggtgtacg

SEQ ID NO: 2344 - DNA, 571 bp, Homo sapiens
  misc_feature: GYAE6OF01C1889.38.23.C01.1.454.CMB.1.raw
  modified_base (352)..(352): a, c, t, g, unknown or other
  misc_feature (352)..(352): n is a, c, g, or t
  modified_base (380)..(380): a, c, t, g, unknown or other
  misc_feature (380)..(380): n is a, c, g, or t
  modified_base (465)..(465): a, c, t, g, unknown or other
  misc_feature (465)..(465): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccaccatcaactgcaagtccagccagtagttcttttgttcagcctccaagaactatgagttcgttagcttggtaccagcagaagcacgacacgtccctaagtcgctctatttatggtcatctacgtcggtcgtccgggtcctgaccgnttcagtcgcagcgtatcgtgggacagtnttcactctaccacatcacgcacgcctgcagtactagaacgtgtgtaggacttaagtttattacgtagtactagtactaaagtttnttaacgttcgggttactcccgttcggtccttccgttacggtttccggggacgggtacggggtaacccgtaaggggtacggaacgtataccgaaggtcgtaaacggg

SEQ ID NO: 2345 - DNA, 1048 bp, Homo sapiens
  misc_feature: GYAE6OF01DP49I.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattgggctgagcttgggttttcctgttgctattttagaggtgtccagtgtgaggtgctaggttggtggaatcggtagggggtaaacttcggtccagccgtggggggtccctagacgctctccgtgtcgcagtcctcgtggtactttcaatttatttaagtaatcgtaagtttggattggtaagggtttcggggtcccgaccgtagggtcccgttacccgggaacggggggtaccggggggtccgttagggggtaagggtttcggggggtaccggtaccccgtaaacgttaaaccgttaaaaaccccgacggtaaagttacggggaaaaaccttaagggaaaaaaaaacggtaccgtttaaaggttacgggttaacggggtaaccctttaccggtttagggtaacggggtaaaccgggggtacccgttaaccgtttaccccgtaaccccggtttacccgttaaccccggtaacggtaaaaccgggaaacccgtaaaacccggtaacccgtaaaaacgttaaacccgtttaccgttaaaccgtttaacggttttaaacgtttttaacggaacccgttaaaaacgttaccgggtaaaacccgtaaccgggtaaccccggtttaaaggggtaaaccgggtaaaccggggtttaacccgggaaaaccggggttaaaccccgaaaccccgggggtacccttaaaaccgttttaaaacgtttaaacggtttttaaacggtttttaaccgggtttaaaagggtttaaaaaaaccggttacgttttaaacccgttaaaacggttttaaaccccgggtttaaagtttaaaccggggtttacgggggtttaaaccggggttaaccccggggttaaaacccggggggtttaaccggggggttcggggttaaaacccggg

SEQ ID NO: 2346 - DNA, 547 bp, Homo sapiens
  misc_feature: GYAE6OF01EBJBW.38.23.C01.1.454.CMB.1.raw
  modified_base (348)..(348): a, c, t, g, unknown or other
  misc_feature (348)..(348): n is a, c, g, or t
  modified_base (513)..(513): a, c, t, g, unknown or other
  misc_feature (513)..(513): n is a, c, g, or t
  modified_base (516)..(516): a, c, t, g, unknown or other
  misc_feature (516)..(516): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgccaggctccgagggacggggctgggagtgggtgccactanaaaccagatggaactagaaaaagctaatgtaggactcgtggtgaacgggccgtattccaccgttcctaccgagagaaccaaccgaccaaagtaacttcacgttgtatttgactaaatgaacagcctagagagtacgaagacacggcatatattatagtagtaaantanattcgatagtggtggagacggtgggtgtacg

SEQ ID NO: 2347 - DNA, 610 bp, Homo sapiens
  misc_feature: GYAE6OF01EGXC0.38.23.C01.1.454.CMB.1.raw
  modified_base (319)..(319): a, c, t, g, unknown or other
  misc_feature (319)..(319): n is a, c, g, or t
  modified_base (471)..(471): a, c, t, g, unknown or other
  misc_feature (471)..(471): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtgggggaaacttggtccagccgtggggggtccctgagctctcctgtgcagcctcgtggattcattatttagtaatctagttggattggtaggttcgggtcccncgaggctccggaggggacggggctgggaggttggggtggccaagtaactaaaccgacgagtacgggaactaagaaaaagctaagtggtaggtactcgtggaggaacgggcctagttccaccgtctaccagacgacaacgacaagactcactnttattgaactaagtagaacagtccgtagaggagtacgaacgaccacgacctaattatatttagttagttaagtaaaagtattactaagttagtaagttaggttcgggtacgggacggtaaccgggttggggtcgtacgg

SEQ ID NO: 2348 - DNA, 617 bp, Homo sapiens
  misc_feature: GYAE6OF01C7BUJ.38.23.C01.1.454.CMB.1.raw
  modified_base (428)..(428): a, c, t, g, unknown or other
  misc_feature (428)..(428): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccaccatcaactgacaagtccagccagtagtttctttgtcacgctaccaagaattatgtagttcgttagtcttggtaccagacaagaaagcaaccgactacgtacccctaagttcgccttctatttagttcggtactactcctacgtcgggtcggttcccgggtccctcgaccgtattcgacgcggcacggcgtatcgtaggacagtacttcactcctaccacntacagccagtcctagacaacgacgtagaagtagtcggtgtacttagtttactcgttgtacagtacttaacttagttacggttacggttaccgtccgttccggtaccttaccgttaccgggttttaccggggacgggtaaccggggtaaccgaggggtacggaagtacgtaacggaacggtacgtaacgg

SEQ ID NO: 2349 - DNA, 668 bp, Homo sapiens
  misc_feature: GYAE6OF01BT1SE.38.23.C01.1.454.CMB.1.raw
  modified_base (263)..(263): a, c, t, g, unknown or other
  misc_feature (263)..(263): n is a, c, g, or t
  modified_base (602)..(602): a, c, t, g, unknown or other
  misc_feature (602)..(602): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggtttccttgttgctattttagaaggtgtccagtgtgaggtgctaggttggtggaatcgtagggggaacttggtccagccgtgggggtccctgagctctcctgtgcngcctctggtacttcattatttagtaatctagttggatggtaggtttggggtcccgcgacggctccggaggggacggggcttgggaggttgggtcggccaacgtataaaccgagtataggaactaagaaaaacgtactaagtggaggtactcgtagtacggaacgggtccgtagtttaccaccggttctaccgaacgtaacgaaccctaacgaccaaagtaacttcctaagtagtttattacgaactaaagttagaacctagtacctaggaacggtagtaaccggaagaccgaccgggtacctaagttaattagtttaacgttagtaaggttaaaaactntacgttaacttcggtaaagttacggttagggtacgggtaccggtaacgggtaccggggtaggtacg

SEQ ID NO: 2350 - DNA, 718 bp, Homo sapiens
  misc_feature: GYAE6OF01CQGWW.38.23.C01.1.454.CMB.1.raw
  modified_base (554)..(554): a, c, t, g, unknown or other
  misc_feature (554)..(554): n is a, c, g, or t
tcagtcgatcacgtcacgaccggtgctcgatttagtacacgtgattagggattgggggtctcagagaggagccttagccctggactccaaggcctttgcacttggtgatcagcactgagcacagagactcaccatggaattgggactgagctggtatttttcctttggcttattttaaaaggtgtcagtgtagaagtgcagctggtggagtcgtgggggagtacgttgggtagagccgtgggactaggtccctagacgactctccgtgtgcgagtccgtacgtggtaatttaactaaaattttaatagtaataagtcgacctagtcgaccacggttacgggtacccgaaacaacgtccgtaccggaaggggaacgggccgttagggaggttcgggtactacgtaaggttgttagttaggaaacgtggtacggtaaccagttacgcctaagtcggtacggtacctcgtagggtagggaaccgggtacctaccgtttaccgaacctacgtcctaccggaacgacgtaaccaaaccggaccaagctaccctaccgtntaacctctacggaactaaacgtacgtaacgtagtccgtaagtaccgtacccgtaaggaccggtaacctccggttaccctttacgttactttaccggtaggttaccgtaaccggtaaaacccgggtccccggttaaatcggtaaacgttaggtaagtaaaccggg

SEQ ID NO: 2351 - DNA, 581 bp, Homo sapiens
  misc_feature: GYAE6OF01DGA2S.38.23.C01.1.454.CMB.1.raw
  modified_base (406)..(406): a, c, t, g, unknown or other
  misc_feature (406)..(406): n is a, c, g, or t
  modified_base (411)..(411): a, c, t, g, unknown or other
  misc_feature (411)..(411): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttctttgtcagctaccaagaatatagattcgttagcttaggtaccagacagaaagccacgacacgtcccctaagttgctcatttattggtcatctacgtcgggtgtccgggtccctggtacccgatttcagtcggcgagcggatcgtagggactaagtcttacactctacacatcngacanccctgacaacgactaggaagtagtcgtgtctaagtttatactgtacagtactaattagttagtacggttaacgtccgtaccggcttaaccgtacgttttccggggaaccgggaacggggtaacccaaaggggttcggaaacggtactaacccggaaggacccgtaaacgg

SEQ ID NO: 2352 - DNA, 796 bp, Homo sapiens
  misc_feature: GYAE6OF01DGAZM.38.23.C01.1.454.CMB.1.raw
tcagtcgatcacgtcacgaccggtgctcgatttagtacacgtgattagggattgggggtctcagagaggagccttagcccctggactccaaggcctttgcacttggtgatcagcactgagcacagaggactcaccatggaattggggctgagtcgttgggtttttccttgttgtcttattttagaaggtgtcagtgtgaggtgctagttggtggaatcggtagggggtaaaacttcggtcccgaggtcccggtcggggggttcccctaggaacgtcctccttccgtgtcgccacgtcccttcgtggtacttactaatttaagttttaagtaattctagtttaggatggttaggttcgggtcccgcgacggtccgtaccggacgggggaccggggtcgttggggacgggttggggtacggaccctaaacgttaacgtaaaacccgaacggtaacgtaacgggaaaacttaaacggaaaaaacgtacttaaggttaggtacggtacttcggttaggaacgggaaccgggtcctaacgtttcccgtaacccgttcctaccgaacggaacgaaaccgaaccgaaccgtaaagtaacttaccgtacgttagtttaacgtttacgaacgtaaacgttacgaacgtacgtccgtaaggtaaggtaacggtaaccggaaacgaaccggtaaccgtaaccttagtttaattaacgtttagttaagtaaagtaaaagtacttacttaacgttacgtaagttaggttaggtacgggtaccggttagggtaacgggtggtacgttagg

SEQ ID NO: 2353 - DNA, 540 bp, Homo sapiens
  misc_feature: GYAE6OF01BQW7F.38.23.C01.1.454.CMB.1.raw
  modified_base (307)..(307): a, c, t, g, unknown or other
  misc_feature (307)..(307): n is a, c, g, or t
  modified_base (439)..(439): a, c, t, g, unknown or other
  misc_feature (439)..(439): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcattatttagtaatcattggatgagttgggtccncaggctcgagggcgggctggagtgggtggccactactaaaccagataggaactaggaaaaagactatggtaggactcgtgtaggaagggccgtattcgaccgtctaccagagacaacgcaaagaattcactntatttgacaatgaacagctagagagtacgagacacggccagtatattatagtagtaaagatacgtattacgatagtggtaggagacggtacgggtggtacg

SEQ ID NO: 2354 - DNA, 623 bp, Homo sapiens
  misc_feature: GYAE6OF01B6K7T.38.23.C01.1.454.CMB.1.raw
  modified_base (171)..(171): a, c, t, g, unknown or other
  misc_feature (171)..(171): n is a, c, g, or t
  modified_base (382)..(382): a, c, t, g, unknown or other
  misc_feature (382)..(382): n is a, c, g, or t
  modified_base (489)..(489): a, c, t, g, unknown or other
  misc_feature (489)..(489): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacaatcgtgatcgacccagttcnccagactccctggctgtgtctctgggcagaggccacatcaatgcaagtccagccagatctttgtcagctcaagatatgagttgttagcttggaccagcaagaagctacgacacgtcccctaatttgctcattttattggcaattctactcgggtctccggggtcctcaccggacttccgaggccggcgaaggtccgtaagtcgtacggganacggtaatttcgaacctcgtactaccaacgttcaacgcaacggccttacggataacgaccgtagaaagaagtcggtaggtacctaggtttaactttacgtaaccgtnaacgcgtaaatagtttaaacgtgtaacggttccgttaacggcccgttaacgtaccgtttaccggttcgggaacggtaaccgggttaacgggtaccgggaaaggtattacccgggtaaagaacgttaaacccggg

SEQ ID NO: 2355 - DNA, 795 bp, Homo sapiens
  misc_feature: GYAE6OF01A0U1J.38.23.C01.1.454.CMB.1.raw
  modified_base (251)..(251): a, c, t, g, unknown or other
  misc_feature (251)..(251): n is a, c, g, or t
  modified_base (267)..(267): a, c, t, g, unknown or other
  misc_feature (267)..(267): n is a, c, g, or t
  modified_base (305)..(305): a, c, t, g, unknown or other
  misc_feature (305)..(305): n is a, c, g, or t
  modified_base (311)..(311): a, c, t, g, unknown or other
  misc_feature (311)..(311): n is a, c, g, or t
  modified_base (351)..(351): a, c, t, g, unknown or other
  misc_feature (351)..(351): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagcttgggttttcctgttgcttattttagaaggtgtcagtgtgaggtgcaggttggtggaatcgtagggggaacttggccagccgtgggggtccctgacnctctctgtgcagcctntggattcattatttagaatcattggatgagtttggccncgagcncccgaggggacgggctgggacggtgggcgaccacgttaanaaaacccgacggagttacgggaaaccttaaggaaaaaacgtaccgttaaaggtcggttacggtacctaccgttgggtaagaacgggggtaccctacgtttccaaccggttcctaccgaacggaacgtaacgaaaccgccgtaaaagtacgtttaccgaacgttagtttaacgtttacggaactaaaacggtagtaaaacccgacggtcccgtaagggaacggttaaccgggtaacggaaaacggacccgttaaaccggggacccttaaagtttaaccgtttaaagtttttaccggttaaaggtttaaaacgggttaaaaaacgtgttttaaaccccgtaaaagttttacccgggaaaagtttttttacggggaacgggggttacccggggaaacccggttaacccggggggttttaaccgggggggtaggttttaaaccccggg

SEQ ID NO: 2356 - DNA, 604 bp, Homo sapiens
  misc_feature: GYAE6OF01A3JPE.38.23.C01.1.454.CMB.1.raw
  modified_base (341)..(341): a, c, t, g, unknown or other
  misc_feature (341)..(341): n is a, c, g, or t
  modified_base (470)..(470): a, c, t, g, unknown or other
  misc_feature (470)..(470): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtggggaaacttggtccagccgtgggggtccctgaagctctcctgtgcagcctctggattcattatttagtaatcattggatgagttgggtccgcgaggctccgagggacgggctcgggagtgggngccaactataaaccgacgataggaactaagaaaagactaagtgtaggtactgtggtaggaacgggccgtaacttccgaccgtctaccgagaacgacaacgacaaagtaactcaactgttagtttcgaanaacgtagaacagcctagacgaggtaacgaagaccgacggacctaagtataacgtttagttagttaagtaaaagtattactatttacgaagttagttacgggtacggtacggtaacggttacggggtggtaaccg

SEQ ID NO: 2357 - DNA, 650 bp, Homo sapiens
  misc_feature: GYAE6OF01EEZLH.38.23.C01.1.454.CMB.1.raw
  modified_base (271)..(271): a, c, t, g, unknown or other
  misc_feature (271)..(271): n is a, c, g, or t
  modified_base (515)..(515): a, c, t, g, unknown or other
  misc_feature (515)..(515): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagcttgggttttccttgttgctattttagaaggtgtccagtgtgaggtgcaggttggtggaatcgtagggggtaaacttggccagccgtgggggtccctgagctctcctgtgcagcctntggtattctattatttagtaatctagttggattggtaggttcgggtcccgccgaggtccgtccggaggggaccgggggcgtgggaggttggggtcggcctaacgtaacaaaccgacggagtaggaaactaaggaaaaagtactagtgtcggtactcgtgtacggaacgggtccgattccgacccgtcaccgagaacgaccaacgacaaagtattctacttgttattacgaactaagtacgaacncgactaggaacggtacgtaacggaacgaaccgaccggacctaagttaacttaatttagttagttaagtaaaaacgtattactaagttaccgtaagttaggttgggtacggacgggttaacgggttcgggtggtac

SEQ ID NO: 2358 - DNA, 852 bp, Homo sapiens
  misc_feature: GYAE6OF01CEYJE.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccagtggaagttggggctgagtcgttgggttttccttgttgtacttagttttaagaaggtgtccgtagtgtggaggtgcgtaggttgggtaggtaagtcggtaggggtaaacttcgggtccgtaggtccggttcgggggtccctaggaacgtccttcctccgtgtcgcgtacggtcccttgtggtactttacgaattttaactttaaggtaattctagtttaggagttgtagggttcgggtacccgccgtacgggccgttacccgggaagggggtcggggccgttagggggtacgggttggggtaccggacctaaaccgttaaaccgtaaaaaccggtacgtaaggtaacgggtaaaaactaaagggtaaaaaaacgtcgtttaaggttaggtacggtaacgttcgttaggtaacgggacgggtaccgtactttaccgtacccgttacgtaccgaacgtaacgaaaccgaaaccgtaaccgtaaaaggttaacttccgtaagttacgttttaacgttaacgacgtaaaagtacgaaacgtacggttaccgtaggtaaacggtaaccgggttacgaaaccggtaccgaaccggtacttaaagttaatttaaacgttagtttaagttaaaagttaaaaacgtgttaacttaacgttaacggtaagttaacgggtttcggttacgggaccgggttaaaccgggttaggggtacggttaacg

SEQ ID NO: 2359 - DNA, 601 bp, Homo sapiens
  misc_feature: GYAE6OF01EOAJP.38.23.C01.1.454.CMB.1.raw
  modified_base (397)..(397): a, c, t, g, unknown or other
  misc_feature (397)..(397): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcatatttagtaatctattggattgagtttggggtccgccgaggctccgaggggccggggctgggaggtggggtgccactaactaaaccgacgagtaggaactaagaaaagatagtgtggactntgtagaagggccattcacgtctcgagacgacaacgaccaaagacttcacttgttatttgactaaatcgaatacgcctagaaggacgtacgaacgaccgaacggacctaagtataatttagttaacgttaagtaaaagtacttacgtaattacgaaagtttaggtgggtacgggacccggtaacgggttaacgggggtggtaacg

SEQ ID NO: 2360 - DNA, 782 bp, Homo sapiens
  misc_feature: GYAE6OF01DJN2I.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggtaagttggggctggagtcgttcggggttttccttggttgtacgttatttttaggaaggttcgttccgagttggtggtaggttggacgtaggttgggtaggtaaacgttcggtagggggtaaaacgttcgggttaccgacggtcccggttcggggggttacccctaggaacgtccgttcgtccgtgtcgccgacgtcctgtggtattctaattagtttaacgtaatcgtagttggagttggtaggtttcggcccgacgacggtccgtaccggaggggtacggtcgtgggagggtgggtaccgtcctaagtaaccgtaaaccgacgtaagtacggtaaacgaaagtaaaaacgtacgtaggtacgtaggtacttgtaggtacggaacggtactacgttccgaccgttacgtaccgaagtacgaaccgaacgaacgaaagtactacgtagtttctaacgtttagaacgtaataacgtaacgacgtacggttaagacggtaacgttacgaaaccgacgtaaccggtaactaagtttaactttaagttaaacgtttaggtaaaggttaaaaacgttataaccgttaagttacgtaaagttacgggttagggtaccgggtaacggtaacgggttagggtcggttaacg

SEQ ID NO: 2361 - DNA, 770 bp, Homo sapiens
  misc_feature: GYAE6OF01CQVL9.38.23.C01.1.454.CMB.1.raw
  modified_base (606)..(606): a, c, t, g, unknown or other
  misc_feature (606)..(606): n is a, c, g, or t
tcagtcgatcacgtcacgaccggtgctcgatttagtacacgtgattagggattggggaggtctcagagaggagccttagccctggacctccgaaggcctttgcacttggtgatcagcactgagcacagaggacctcaccagtggaagttggggctgacgtcgttgggttttccgttgttgtacttagtttaggaaggttcgtccaggtggtggtaggtgtcgtaggttggtacggtaagttcggtagggggtaaacttcggtaccgacggtccgggttcgggggtaccctaggacgtccttcgtccgtgtcgcacgtctcgtgtactctaatttagttagtaatgtagttaggtgttacggtaggttccggtaccgcgtacggtccgtaccgggaggggtccgggtgtagggtgggtcgggtacgaccgtaaacgtaaccgtaaccggaacgtaagtaaaccgggtaaagtaaacgaaaacgtagtacggtaggttacgtaacgtcggttaggaacggtacggtaccgttacttacccgtaccgtcctacggagtaaccgacgaacgacgtaagtactacgtacgttagtacttacgaataacganacgtacgtacgagtaacgtacgtaacgaacgaccgtaccggtattaacgtttaagttacgttaggtttaacgtaaacgtaaaccgttgttaaacgtacgttttacgggaagtttcggttacgggggaacccgttacggggtacggtttggggtccgtttaacgg

SEQ ID NO: 2362 - DNA, 973 bp, Homo sapiens
  misc_feature: GYAE6OF01C870T.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcacatggaagttggggctgagtcgttgggttttccttgttgtcttagttttagaaggttgtccagtggtaggaggtgcgtaggttgggtaggtaagttcgggtagggggtaaaactttcgggtaccgacgggtccgggttcggggggtccctaggaacgtccttcgtccgtggtcgccgacggtcctcgtacggtattactaattttaagttttaaggtaacttacgtagtttagggaacgtttagggttaacgggtttccgggtaccccggtacccggtaaacgggtcccccggtttacccggggaaaggggggggttaaccccgggggtcggtttaacggggggtaacggggtttccgggggggtacccggaaccccgtttaaaaccggttaaaaaccgttaaaacccccggaaacggtaacggtttaaacgggtaaaaaccggttaaaaacgggaaaaaacggttaccgttaaggttcggtaacgggttaaccttacgggttacgggtaacgggtaacccggggtaccgtttaaccgttacccgtaccccgttacgtacccgaaggtaacgaacccgtaaaccgacgtaaacgtaacttaccgtaacgtttagtttaacgtttacgaacgtaaacgtacggtaacctaacggtcccgttaggaacggttaccggtaacggaaacggtacccgaacggtacccttaaagttacgttaagtttaaaccgttaggttaaaacgtttaaaactacgtttaacgttaacgtttaccggtaaagttacgggtttacgggaacgggttacccgggttaacgggttacgggggtagtttaaccggg

SEQ ID NO: 2363 - DNA, 677 bp, Homo sapiens
  misc_feature: GYAE6OF01DNNIB.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtagggggaaacttggtccagccgtgggggtccctgagctctcctgtgcagcctctggattcattatttagtaatcattggatgaggttggtccgcaggctccgagggacggggctgggagtgggcggccaactaataaaaccacgtagtaggaaactaagaaaaagtacttaagtggtaggtactcgtggtacggaacgggtcccgagtttaccgaccgttacctaccgaaggtaacgaacgaaacccgaccaaaggtaactttacgaaccttggtttaacttttacggaacttaaagtacgaaacacggtacccgtaggaaggtaacgggtaaccgaaagaaccgaccgactaataattaactttaagttacggttaaagtaaaaagttataccgtaagtttaccgaagtttaaggttacgggtcgggaacggtacggggttaacggggtgggtacgttaacgg

SEQ ID NO: 2364 - DNA, 670 bp, Homo sapiens
  misc_feature: GYAE6OF01ARDT6.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggtttccttgttgctattttagaaggtgtccagtgtgaggtgcaggttggtaggaatcgtagggggaacttggtccagccgtgggggtccctgaagctctcctgtgcagtcctctggattctattatttagtaatcattggataggagtttgggtcccgccgacggctcccggagggggaccggggcgtagggaggttcggggtcggacccgtaacgtaactaaaacccgacggaagttacgggaaacctaggaaaaactgaacttaagtggttagggtacttcgttaggtacggaacgggtcccgtagtttacccgtaccggtcctacccgaggaacgaaacgtaaccgaacctaaaggtacttacctacttagttaatttgtaacaaatacgaaacgtagtacctaggaacgtacgtaacgaacggtaccgacgaccaattattaattagttagttaagtaaaagatactaagttactaagtagttggtagggtacgtagggtacgggtcgg

SEQ ID NO: 2365 - DNA, 737 bp, Homo sapiens
  misc_feature: GYAE6OF01DCPD8.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagagactcaccatgaattgggctgagctggttttccttgtgcttatttagaaggtgtccagtgtgaggtgcagttggtgaatcgtaggggaaacttggtccaggccgtgggggtccctgaagtctctactgtgcagcctctggtacttctaattattttaagtaattacgtagtttaggacttggtaggtttcggggtacccaccgacggtcctccggaaggggtaccggggtcgtgggaggttcggggtcggacctaacgttaacgtaaaacccgacgtagttacggaaactaaaggaaaaacgtacgttaagtcggtaggtaacttcgttaggtaacggaacgggtccgtaatttcccgaacccgttcctaaccgaacgaacgtaaaccaaccggtacccaaagtaactctactagttaactttagaactaaacgtgaaactacgtccgtagaacggtacgtaaccgaacgaaccgaccggtaactagttaagtttaacttttaaaggttacgttaaaggttaaaacgacttacttaaacggttcgtaaacgtttacggtcggggttaaccggtaacccgttaggggttaaccggggtggttcctttaacggg

SEQ ID NO: 2366 - DNA, 903 bp, Homo sapiens
  misc_feature: GYAE6OF01BVN0W.38.23.C01.1.454.CMB.1.raw
  modified_base (210)..(210): a, c, t, g, unknown or other
  misc_feature (210)..(210): n is a, c, g, or t
  modified_base (896)..(896): a, c, t, g, unknown or other
  misc_feature (896)..(896): n is a, c, g, or t
tcagtcgatcacgtcacgaccggtgctcgatttagtacacgtgattagggattgggggaggtctcaggagaggagccttagccctggactccaaggcctttgccacttggtgatcagccactgagcacagaggactcaccatggaattggggctgagtcgtgggttttccttgttgcttagttttagaaggtgtcctagtgtgaggtcgnaggttggtggaatcgtggggaaacttggtccaggtccgtcggggggtcccctggaacgtccgtcgttcccgtaggttcgccgaacggtccccttacgttcgggtaactttacgtaattttaagttttaacggttaaacttcgttaaaagtttgggtaaacgtttgggttaaagggttttccgggggtaccccgtaccggtaaacgggcccgtttacccggggaaaggggggtacccggggggtcctagggggtaacgggtttcggggggttccgggtaacccctaaaccggttttaaacggtaaaaacccccgtaacggggtaaccgttaacgggggtaaaaaccgtttaaaggaaaaaaaaccggttacggtttaagtttacggtacgggtaaaccttcgttagggtaacgggtaaaccggggtacccgttagtttacccggaacccgttttccgaaaccccggtaagtaaaccggtaaacgaaaacccgtaccggtaaaaacgtaacctttacaaccgtttaggtaacgttttacgaaacgtaaagttacgaaaccgtaagtccgtaaacgtaggaacgttacgaaaccggaccgtaacggacctaagttacgttaacgtttaagtcgttaaagtaaagtatactacgtacgtaagtagtcggtggtaccggtacggttcgggngttaacg

SEQ ID NO: 2367 - DNA, 687 bp, Homo sapiens
  misc_feature: GYAE6OF01CDHGF.38.23.C01.1.454.CMB.1.raw
  modified_base (446)..(446): a, c, t, g, unknown or other
  misc_feature (446)..(446): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatgacccagtctccagactccctggctgtgtctcgtgggcgaggacgggccacatcaactgacaagtccagccagtagttcttttgtcagtctaccaagaatagtagtagttcgttagcttacggtaccagcgaagaaacgcaacgactacgtaccctaagttcgcttatatttagtcggtactattccgtacgtcgggtccgttccgggtcctagaccgtatcgcggcggacgacgcgtatcggtaggacagttacttcactcctacgactactacacgcacgtccgngactagtacgtaagaacgtgtaggttacggtactttaacggttttaacgtacgttacgtacgtaaacggtaaacttaagtttagttaacgggttcgggttaaccgttccccgggttaccggttaaccgttacccggtttacgggggtttacccggggaacggggtaaacccgggtaaaccggggttaaggggtacgggtaaagtaaccggtacccggtaaaaggggtcccggtaaacgggg

SEQ ID NO: 2368 - DNA, 839 bp, Homo sapiens
  misc_feature: GYAE6OF01EOIOP.38.23.C01.1.454.CMB.1.raw
  modified_base (645)..(645): a, c, t, g, unknown or other
  misc_feature (645)..(645): n is a, c, g, or t
  modified_base (724)..(724): a, c, t, g, unknown or other
  misc_feature (724)..(724): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactacaccagtaggaagttgggggctggagtcgttcgggtttttccttgttgtcgttattttaggaagggttgtccgaggtggtcggtaggtgcgtaggttgggtgggtaatcggtagggggtaacgttcgggtccgaggtccggttcgggggtcctaggaacgtcctcctcgtgtcgcacgtccgtcgtggtattactattatttagtactatacgtgtagtacggtggtcgggtccggccgacggtcgtaccggtacggggacgggtcgggtgggtgggtcgggtcggtaccgtaaccgtaaaccgtaaaccgtaaccgacggtaacggaaacggttaaaacggtaaaacggtaaacggtaacgtaggttaacgggtaaccggtacggttaggtaacgggtaaccggggtaaccggttaccggtaccgttaccccgcccgtttaaccgacggtaaaccgaacccgaaacccgaacgtaaacgtacggttaacttacggttaagtttacgttanaacgtaaacgtaacggaacgtaaccgtacgacgggtaggtaaacggtaccggaaaggacccgtaacgaacgtaacgttntttaaaggttactttagggttaaacggtaaaggtaaattacggtttaagacgtttaaggttcgggtttacggggtacgggtcgggtaaaccggggtttaggggtcggttaccggg

SEQ ID NO: 2369 - DNA, 754 bp, Homo sapiens
  misc_feature: GYAE6OF01DANWR.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgcttattttagaaggtgtccagtgtgaggtgcagttggtggaatcgtaggggaaacttggtccagccgtcgggggtccctggaagctctcctgtgcacgcctctggattcattatttagtaatctattggatgtaggttcggtccgccgtagctcgaggggacgggtcgtgggtaggtggggtcgacccgtaacgtaactaaaaccgacgtaagtacgggaaaacctaaggaaaaaaagacttaagtaggtacggtaacctcgtaggtacggaaacggggccgtaattcccgtaacccggtccgttaccgaaggaaacgaacccgaaaccggacccgtaaaagtaaccttacgtaacgtttacgtttaagtttacggtaaactaaaacgtacgaaaccgtacgtaacccgttaggaacggtaacggtacggaaaacggaaccgtaaccgggactaaacgttaaagtttaactttaaagttaggttaaaagttaaaaagtactttaacgtaaacgtttacgttaagtttaaggtacggggttaacgggacccggttaacgggggttaacggggttcgggttaaacg

SEQ ID NO: 2370 - DNA, 797 bp, Homo sapiens
  misc_feature: GYAE6OF01BI5OB.38.23.C01.1.454.CMB.1.raw
  modified_base (167)..(167): a, c, t, g, unknown or other
  misc_feature (167)..(167): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctcgtggagccgtacggggacatcgtgatcgacccngtcctccagacctcccgtggctgtcgtctcgtgggcgaggacggaccaccgatcaactggactaacgtccagcccgaagtacgtttctttttcgtaccgacgtaccttaccgaaagtaattagtggttacggtttacgttagtcggtttacggtaacccgaggtacaaacggaaacgacccgtaacggaaccgttaacccggttacccccgtttaaggtttcgtaacctttaccgtttaagtttttaacggttccggtaccttaaacgtttccgttaacccgggttccgggggttaccggttccccgggggttccctaacgggtaccggttaacttccggacggcccggtacgaacgggtccgggtaatcccgggtagggtaacctacggttacctttaccgtaaccttctaacccgtaccttacgacacgtaccgaccgtccgtacgaacggaccgtacgtagtaacggtgttcggtagtacgtttaagtttacttacgttacgttaaccacgtagttaaatacgttacgtaagggtccttacggtccgtaccgttacggttcggttacgggacgggtacggtaacggtaagggttcgaaaccgtagtaacccggaaggtcgtaacggg

SEQ ID NO: 2371 - DNA, 710 bp, Homo sapiens
  misc_feature: GYAE6OF01CR9UY.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattgggctgagctgggttttcctgttgctatttagaaggtgtcagtgtgaggtgcgagttggtggaatcgtggggaaacttggtccagtccgtggggggtccctggaacgctctccgtgtcgcacgtccctgtggtacttcaattaagttttaagtaacttctagtttagggattcggtaacggtttcgggtcccgaccgacggtcctccggaagggggacgggtcgtagggtaggtcggggtcggtacctaaacgtaactaaaaccgacgtaagtaggaaactaagaaaaagtactaagtggtacggaactcgtaggtacgaaagggtcctacgttaccgtaccgtaccttacccgaagaacgaaccgaaaccgaaccgtaaagtaacttaccgtaacttggtttaatttacgaacgtaaatacgaaacgtacgaccgtaggaggaacggtacgaaacgacgaacgtaccgtaataagttaagtttagttataaaggtaaaatagttacgtatttacgtaagttaggttacgggaggtaacccggtacgggttacggggtggtaaccg

SEQ ID NO: 2372 - DNA, 669 bp, Homo sapiens
  misc_feature: GYAE6OF01DESEY.38.23.C01.1.454.CMB.1.raw
tcagtcgatcacgtcacgaccggtgctcgatttagtacacgtgattagggattggggggagctacaacaggcaggcaggggcagcaagatggtgttgcagacccaggtcttcatttctctgttgctctggatctctggagccgtacggggacatcgtgatcgacccagtctccagcctccctggctgtgtctcgtgggcgaggacgggcccaaccatcaactgacaacgtccagccagtagttctttgtcagctaccaagaatatgtagttcgttagtcttaggtaccagcaagaagcaacgacacgtaccctagtcgctactatttatgtcactctacgtcgggtcggtccggtcctcgaccgattcgacggcggacaggccgtatcggtaggactagtacgttccactctaccacataccgagaccgacgtccctaggaccgtagtaccgtagaaacgttcgtacgggttacgtacgtttaagttttaacgttaccgttacggttaccaaggttaacctaaagttttacgttacgggttacggttaccggtacccgttccgggtaccgtttacccgttacggggtttaccggggaccggggtaaaccggggtaaccgtaaggggttacgggaaagtacgttaaaccggaaggttacccgggtaacgg

SEQ ID NO: 2373 - DNA, 818 bp, Homo sapiens
  misc_feature: GYAE6OF01A7A4Y.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctatttagaaggtgtcagtgtgaggtgctagttggtggaatcgtaggggaaacttggtccagtccgtgggggtccctgacgtctctcctgtgcagtcctcgtggattcattattacgtaatctattggatggtaggtttcgggtccgccgaggccgtccggacgggggacgggtcgtgggtacggtggggtccggtacctaacgttaaacgtaaacccgaaaccggtagttaacggggtaaaactaaaggaaaaaaacggtaccgttaaaggtacggtaggtaaccgtaccgttaggggtaagggaaaccggggtcccgttaacgtttacccgtaacccggttacccgttacccggaagaaaccgggtaaacccaaacccggaacccgtaaaaagttaaacccgtttacgtaaacctttagggtttaaactttaaggtaacccgtaaaagttaccggtaaaaccgtacggtaaccgtacggaaacgtaagggtaaccggaaaacggaccggtaaccgacccgttaaattaaatttaagtttaaacgttaagttaaacggtaaaaacgttagtaccgttaaagttacgtaaagttaacggttcggggtaggtaaacccgggttacgggttaacgggggttggtaaccgg

SEQ ID NO: 2374 - DNA, 548 bp, Homo sapiens
  misc_feature: GYAE6OF01B5UNK.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccagcagaaagcacgacagtcccctaagttcgctctatttattggtcatctacgtcgggtgtccgggtcctgaccgattcgagcggcaggcggactcgtcgggacagtactttcgacttctccacctatcagcacgccctgactacgactgaagtactaggtggtacttaaggtttattacgttgtacaggtactaagttattagtggttacgtccgtcggtctctacgtttcgggccggagggaccgtaagggtcggagacgtcaaggcgtaacgg

SEQ ID NO: 2375 - DNA, 821 bp, Homo sapiens
  misc_feature: GYAE6OF01COFFV.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaagttggggctgagtcgttgggtttttccttgttgtcttagttttaggaaggtgtccagtggtgaggtgcgtaggttggtggaagtcggtagggggtaaacgtttggtccgtacggtccggttcggggggtccctaggaacgtcctcgtccgtggtcgcgtagcccttcgtggtatttcatttatttaagtaatctaagtttggattggtaggtttcgggtcccgcgacggtcctccggagggggaccgggcgtagggtaggtggggtacgaccgtaactaagtaaaacccgacggtaataacgggaaactaaggaaaaaaacgtcttaagtggtacgtaccttacggtaggtacggtaaacgggaccctagttacccgaccgtacgtaccgaaggtaacgaaccgaaacgaaccctaaaacgtaacttaccgtaacttacgttaacgttttacgaactaaagtaacgaaacgtaaccgggtaccgtaggggtaacgtaccggtacggaacgggaaccgtaaccgggtcgttacggttaacctttaacgttaccggttacggtaacggtaaacccgggtaaaaccggaacccccggttacccgttacggtaacggggttcgggggttaacgggggttaaggtttacggtcgggttaccggggtccggggtaaaccccgggg

SEQ ID NO: 2376 - DNA, 867 bp, Homo sapiens
  misc_feature: GYAE6OF01C9SRZ.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctcgtggagccgtacggggacatcgtagatcgacccagtctccagcctcctggctgtcgtctcgtgggcgagacggccacatacaactgacaagtccagcctagtagttcttttacgtcagtaccttaccgaaagaattagtaggtaacgtttcggtttaacgtcgtttacggtaaccagtacgaaaggaaagaccgaacaacgtaccgtaacccgttaagttcgtacttacttaagtttactttcggtactacgttccgtaccgttcggggtacgttccccggggtaccctagtaccgtagtccgaacggtccggacgtacggacggtagtccgtagggtacacgttctttaccgaacctccgtacctacccgtaagtccaacggactaaccggtcccgttagaacccgtaacggaaaccttagggtaaacgttacggtacgggtttaccggttaagtttaaaccggttttttacgttaacccggtttaggtacccgtaaacggttaaacctttaaagtttttaacggtttaggttaaccccggggtttaaaccgttccccccggggtttaggtaaccccggttttaacggtttaaaccccgggggttttaccggggggaaaacccgggggttaaaccgggggttaaacccggttaaggggggtaaacggggtttaaaaccttaacccggggttaaaaccggaaaccggggtttaccccgggtttaaaacggggg

SEQ ID NO: 2377 - DNA, 719 bp, Homo sapiens
  misc_feature: GYAE6OF01B2C8H.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggactgagctggtatttttccttttggcttaattttaaaaggtgtccagtgtgaagtgcagcgtgggtggagtcggtgggggagtacgttggtagagccgtgggccacgggtccctggacgtacctcctccgtggtcgccacgtcccttcgtggtattaaccgtaaaattttaatgtaaacttaagtcgacctagtcgaccgtacgtcgggtacccgaacgaacgtccgtaaccggaaggggacgggtccgtagggtacggtcgggtactacgtaaggttggtttaaggtacggaacgtaggtacggtaactagtacgtacctagtcggacggtactgtcggtaggacggccgtactccgacctatccgtacgaagacgaaccgaaccgacaaggtcctccttcctaggtactcgtagaactaacgtacgaacgtacgtacgtacgaacgtaccgtagggtaaccggtaccgtacccggttacctttacgtttagttccggtaacggttacggaaaaccggttaaaacccgggtcccggttaaggtaccggtaccgtaaggttaacggtaaccggg

SEQ ID NO: 2378 - DNA, 714 bp, Homo sapiens
  misc_feature: GYAE6OF01CHITQ.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaagttggggctgagctgggttttccttgttgcttattttagaaggtgtccagtgtgaggtgcagttggtggatcgtaggggaaacttggtcaggccgtgggggtccctgacgctctctgtgcagcctcgtggtactttcatttatttaagtaattctagttggagttggtaggtttcggggtcccgccgagggtcctaccggaggggggtaccgggcgtgggtaggttcgggggtcggacccgtaaacgttaacgtaaaaacccgacggagttacgggaaaaccgttaaggaaaaaacggtacttaagtggttaaggaccgttcgtggtaacggacgggtacgtacgttccgaccggttcctaccgaagtaacgaacgaaccgaactaaagtaacttaccaagttagttaatttacgtaacctaaagtacgtaaacacggtccgtagaggtacggtacgaacgaaccgacgacctaagttaattacgtttaagttaaggttaagtaaaaacgtattaactaacgtttacgagttagtcgggtaggtaccggtaacgggttacggggtcggtacg

SEQ ID NO: 2379 - DNA, 805 bp, Homo sapiens
  misc_feature: GYAE6OF01A4ZYG.38.23.C01.1.454.CMB.1.raw
  modified_base (258)..(258): a, c, t, g, unknown or other
  misc_feature (258)..(258): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctccngtgcagcctctggacttcattatttagtaatctagttggatggaggtttcgggtccgccgacggctccgagggggacgggtcgtgggaggtggggtcggaccgtaacgttaaacgtaaacccgacggaagtacgggaaaacgtaggaaaaaaacggtacgttaagttggttacgggaccttacggtacggtagggaaacggggtcccgttaacgtttacccgacccgttcccgtaccccgtaaggaacggaaccccgtaaaccgaccccgtaaaaggtaaccttaccgtaaccgtttaggtttaacgttttaggaaccgtaaaattacggtaaaaccgtacgaccggtttaaggaacggtaacggttaaccggaaacgggtaacccggaacccgggtacctaacgttaaatttaacgtttaatttaacgggttaaagttaaaaaaggtactttaaccgttaaagttttaccggtaaagtttaagggttcggggttaacgggggtacccggttaaccgggggttaaaccgggggttggggtaaacccg

SEQ ID NO: 2380 - DNA, 874 bp, Homo sapiens
  misc_feature: GYAE6OF01B6HBR.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatcgacccagtctccagacctccctggctgtgtctcgtgggcgagacgggccaccatacaactgcaacgtccagccgagtagttcgttttgtcagcctaccaaagtaattagtaggtagtttccgttagtccgtttaggtaccagaccaaggaaacgcgaaccgacgtacgtaccccgtaggttacgtacgttacctaagttttaacgttcggtactacgttaccgttaccggttccggggttaccggggttcccggggttccccgttacgggtaacccggtacgtttaccggacgggtccgggtaccggtacgggtaccggtacgttaccggtaacggggtaaccgtaacgggtttaccttttacccgaaccctttcccgttaacccgtaacccgttaacgtaccccgaaacggttacccgtaaccgtaccccggtacggtaaccgtaaccggtaaaccgtagggtaaacgttacggttacggtttaccgggtaacgtttaaacccgttttttaacgtttaaccgttacggttaaccgtaacgttaaccgttaagtttaaccggtttaggtttaccgggtttaccggttcccgttacccgggtacccgtttacccggtttaaccggggtttccgggggtaaccgggtaaaccggggtaaccggttaaacgggtcgggtaaacggtaaccgtaacgggtaacggtacccgggtaacgg

SEQ ID NO: 2381 - DNA, 776 bp, Homo sapiens
  misc_feature: GYAE6OF01ARIS1.38.23.C01.1.454.CMB.1.raw
  modified_base (723)..(723): a, c, t, g, unknown or other
  misc_feature (723)..(723): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagcgttgggttttccttgttgcttattttagaaggtgtcctagtgtgaggtgcaggttggtggaatcgtaggggtaacttggtccagccgtcgggggtccctgaacgcgtctccgtgtcgcgacgtcctcgtggtacttctaattagtttagtaattactagttaggtatggtacggtttcgggtacccgccgtacggtccgtccggacgggggtaccggggtcgtgggtagggtcggggtacggacccgtaacgttaaccgtaaaccgtaacggtacgtaagggtaaacgtaaacggtaaaaacgtacgttagtacggtacggtaaccgttacggtaggtaacgggtaacgggtcccgttaacgttccccgtaaacccggttccgttaacccggaacggtaaacccgaaacccggtaaacccggtaaccgtaaacgttaaacgttacctaacgtttaggtttaactttacggaaactaaagtaccgaaactacgtccgtaaggagtaacggtaacgaaccggtacgacccgtactaagttagttaatttacggtaagtaaacgtaaacgtntagtacgttactattacgggtcggtacggtacggtacgggttagggtcttacg

SEQ ID NO: 2382 - DNA, 785 bp, Homo sapiens
  misc_feature: GYAE6OF01CC8CU.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaatgggctgagctgggtttctgttgctatttagaggtgtcagtgtgaggtgctaggttggtacggaatcggtagggggtaaactttcgggtccgacggtccggttggggggttcccctaggaacgccttcgtccgtgtcgcacgtcctgtggtattccgaattatttacgtaatctattcggtaatgaaggtttcgggccgccgaggtcctcggaggggcgggtcgtgggaggttgggtacgcctaataacgttaaaccacggtaagtaacggaaactaaggaaaaagtctagtagtcggacttcgtaggtacggaaacgggtccgtaacgttaccgaacccgttaccgaccgtaacgaacggaacccgtaaacgggaacccaaaacggtttaacgttaccgtaaccgtttacggtttaacgtttacgtaaccgtaaagttaccggaaacgtacggtacccgttaagggtaaccggtaacggggttaaccgaaaccgggttaaccgaacccggggtactaaacgttaacgtttaaagttaacggttaaggtttaacggtaaaaaggtactttacgtaacgtttacgtaaattcgggtaacgggttacgggaaccggttaaaccgggttgggggtacgttaaccgg

SEQ ID NO: 2383 - DNA, 1006 bp, Homo sapiens
  misc_feature: GYAE6OF01CUE61.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattgggctgagctggttttccttgttgcttatttagaggtgtcagtgtgaggtgctagttggtggaatcgtaggggtaaacttggtccagccgtgggggtccctgagctctccgtgtgcacgcctctaggtattctaagttatttataatcagtttggatggtacgttcggggtcccgccgacgggtccgttacccggagggggaccggggtcggtagggtacgggttcgggggttaccggaccccgtaaaccgttaaaacgtaaaaaccccggtaaaccgggtaacgttaaacgggggtaaaacccgttaaaagggaaaaaaaaaccggttacctttaaagggttggttaaccggggttaacccgtttacggtttacggggttaacgggtaaaaccgggggttacccccgttaacggttttaccccggtaaacccccgggtttacccgttaccccggaaaaccggttaaaccgggaaaaccccgtaaaacccccgggtaaaccccgtaaaaacgttaaaaccgttttacccgtaacgttttaaccgggttttaaacgtttttaacccggaaaccgtttaaaaacgttaaaccgggtaaaacccgttaaccgggttaacccccgttaaaggggtaaacggttaaacccgggtttaaacccgggaaaccggtaaaccccgggttaacccggtaaacccctttaaagttaaaccgttttaaagttttaaaacggttacggttttaaaacgggtaaaaaacgtttacctttaacggtaaacgttttaacggtaaagttacggtttacggggtaacgggttacccgggttaacggggtttaacccggggttacgggtcgtttttaaccggg

SEQ ID NO: 2384 - DNA, 709 bp, Homo sapiens
  misc_feature: GYAE6OF01DW5KJ.38.23.C01.1.454.CMB.1.raw
tcagtcgatcacgtcacgaccggtgctcgatttagtacacgtgattagggattggggaggtctcagagaggagccttagccctggacctccaaggcctttgcacttggtgatcagcactgagcacagaggactcaccatggaattggggctgagctgggttttcctgttgcttattttagaggtgtccagtgtgaggtgctaggttggtggaatcgtagggggtaaacttggtccaggccgtggggggtccctgaacgctctcctgtgcagcctcgtggattcattattagtaatcattggatgaggttcgggtccgccgaggcctaccggaggggacgggctgggaggtggggtcgacctaactaactaaacccgagtagtacggaaactaaggaaaaaacgtacttaagtggtacgggtacttcgtagggtaggtaaacggggcccgttattaccgtacccggttcctacccgaaggaacgtaaccaaaccggaaccctaaaaggtaactttaccgtaactttaggttaacttttacggaacttaaaacgtacgaaacctacggaacccttaggaaacgacggttaacggaaacggaacccaacgggtacctaaattaagttaactttaagttcggtaaagttaaaagtacttctaagttacgttaagtagttaccggggtaggacggtaacgggtgggtcgtaacg

SEQ ID NO: 2385 - DNA, 837 bp, Homo sapiens
  misc_feature: GYAE6OF01CNA07.38.23.C01.1.454.CMB.1.raw
  modified_base (241)..(241): a, c, t, g, unknown or other
  misc_feature (241)..(241): n is a, c, g, or t
tcagtcgatcacgtcacgaccggtgctcgatttagtacacgtgatttagggtagttggggagactaacaacaggcaggccagggcagaccaagatggtgttagcagtacccccaggtccttctagtttcctcgtgttggactctcggattcttcgtggacgccgtacgggacattcgtagatccgaacccagtcgtccagacctcccgtggctgtgtctcggtggcgagacggacctaacnctacgaacctgacgaacgtccgagcccaggtacgttccgtttgtccaggtcttaccgaaagttaacttactagtaagtttcgttaacgtacgttggttaccacggaccgaaggtaaaacgccgaaccggtaaaccgtaaccggttacccccgttaaaggttccggtccgttaacgttacggttttaagttcgggtaccgtaaccttaaccgttaaccggttcggggttacggtttaccccggggttaccccttacgggttaccccgttaacgtttaacccgaacggttcccgggacccgtaaggtacccgggtaattcccggttaacgggaccgtaaacgtaccgtttttaacccgacctttaccgtaaccgtaaccctaacgtacccgtaacgtaccctaaggtcccgttaggacgtaacggaacgttacggtaaacgtagttacggttacgtacgttaaacgttttacgacgttacgtacgaagttactaagttcttaggtacgttacgtcccgtacggtaccgttactaccggttacggcggaaaccggtccgtaagggtcgtacgtagttaaccgaacgggccgttaacggg

SEQ ID NO: 2386 - DNA, 729 bp, Homo sapiens
  misc_feature: GYAE6OF01B36DJ.38.23.C01.1.454.CMB.1.raw
  modified_base (193)..(193): a, c, t, g, unknown or other
  misc_feature (193)..(193): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattgggctgagcttgggttttccttgttgcttatttagaagtgtcagtgtgnggtgctggttggtggaagtcgtagggggtaaacttggtccagtccggtgggggtcctgaagctctccgtgtcgcacgtccttcgtaggtacttactaatttaagtttaagttaaatcgtaagttggaagttggtacgggtttcgggtcccgacacggtccgtacggagggggacgggtcgtgggtaggtcggggtcgacctaacgtaactaaaccgacgtaagtaacggtaaacgtaagaaaaaacgtcgttaagtggtcggacttcgtggtaggaacgggcctattccgtaccgtcacgagaacgaacaacgacgtaagtaacttctacgttagtactttacgaataaactacgaaactcgaccgtagaacggtacgtaacggtaacgacgtaaccgaccttaagttagttaaacgttttacgttaaggtttaaaaggtaaaacgtacttaacgttaaagttaccggttaaagttacgggttacgggttaacgggtaccccgggttaaggggttacccgggggttgttaacccgg

SEQ ID NO: 2387 - DNA, 721 bp, Homo sapiens
  misc_feature: GYAE6OF01AIBLT.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatcgacccagtctccagactccctggctgtgtctcgtgggcgagacgggccaccatacaactgcaacgtccacgccgagtacgttcgtttttgtcacgtctaccaaacgaattagtgtacggtttcggttacgtcgttacggtaccagtcaagtaaacgccacgaccacgtaccccttaaggtcgtactctattttagttggtactagtccgttacggttcgggttccgggttcccgggttcccgtacggtaccgtacttcgacggcggacgacggccgtacgtcgtacgggactaggtactttccacttcctaccaccacgttcgacgtccacgtcctacggaccgtaacgtacggtaagaacgtacgttgggtacgttaacgtttacgtttttaactacggttactacggtaacgtaacgttaagtttacgtttaacgggttcggttaaccgttcccggttacggtaccgtttaccggttaccgggtttaccgggaccggggttaacggggtaaccgtacggggtacggaagtaccgtacggtaacgggtaccgttaacggg

SEQ ID NO: 2388 - DNA, 675 bp, Homo sapiens
  misc_feature: GYAE6OF01D0CEP.38.23.C01.1.454.CMB.1.raw
  modified_base (569)..(569): a, c, t, g, unknown or other
  misc_feature (569)..(569): n is a, c, g, or t
  modified_base (629)..(629): a, c, t, g, unknown or other
  misc_feature (629)..(629): n is a, c, g, or t
tcagtcgatcacgtcacgaccggtgctcgatttagtacacgtgattagggagttggggaggtctcagagaggagccttagccctggactccaaggcctttgcacttggtgatcagcactgagcacagaggactcaccagtggaattgggctgagtcgttggtttcctgttgacttatttagaggtcgtaccagtgtgaggtgcgagttggtggtaactcggtaggggtaaacttcggtaccgaacggtcccggttggggggtcccttaggaacgtcttcctccgtgtgtcacgtccttccgtaggtacttacctaagttagttacgtaatcctagttacggagttaggtacggtttcgggtcccgccgtaacggtccgtacccggaagggggccgggtcgtagggagggttcgggacgacccgaagtaaccaaccgacgagtaaggaacgtaaagaaaacgactagtaggtacgacttcgtaggaggaccgggacgtacgttccgaccgttcaccgaagtacggaacaaccgtaacaacgtagttacagttagtacttgaactaacganaaccgtagccgtagagagtacagaacacgacctaagtattagtaagttgtaaagtaaagntaactagttagaattggtacggttagaccggttacggcggtgtacg

SEQ ID NO: 2389 - DNA, 845 bp, Homo sapiens
  misc_feature: GYAE6OF01AOSZC.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggactctctggacgccgtacgggacatcgtgatcgaccagtctccagtacctccctggcttgtcgtcctcgtgggcgaggacgggccaccataccaacgtcgacgtaacgtccgacgaccgtaggttacgtttcgttttcgtacgacgtcctaaccgtaagtaattagtgtacggttcgttagtcgttacgtacagtacgaacgaacgtacgaccgaccgtaccgttaccccgttaaggttcgtaccttacgttaagttttacgttcgtactacttcggttaccggttcggggttccggttcccggtacctacggtaccgtacgttacgcggtaccgtcggacggtcgtacgtcggtacggtaactacggttacttacccgtacgtaccctaccgacctactacccggacgtacggaccttaccgtacggaaccgtacgttaaccggtaacggtacggtacggttcgggtaacgttaaccgttttaagtttaccgtttacgtaacgggttaacctaacggttaactttaaaccgggtttagttacccggggttaccggttaccggtttaaccccggttacccgggtttaccgtttacccgggttcccgggggtttaaaggggggacccggttaaaaccgggggtacccgggtttaaaggggtacccggttaacggtaaacccgggaaccgttaacccgggggtaagtttacccggggg

SEQ ID NO: 2390 - DNA, 752 bp, Homo sapiens
  misc_feature: GYAE6OF01E4286.38.23.C01.1.454.CMB.1.raw
  modified_base (190)..(190): a, c, t, g, unknown or other
  misc_feature (190)..(190): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggacgccgtacggggacatcgtgatcgacccagtctccacgactcccgtgctgtntctcgtgggcgaggacggaccacagtaccaagtcgactaacgccacgccaggtacgtttcttttgtaccacgtcctaccgaaagtaattagttacgttacggtttacgttacgtccgttacggtaccacggacgaagaaacgaccgaacgacctaccgtacccgttaagttcgtactacttagtttacgtcggtactacgttcgtaccgggttcgggtccgggttccgggtaccccgttacggaacccgtacgttacgaaccggggtccggaaccggtagggtaccgggtacgttacccggtaggggtaacccttaggttaccgtttaccctacccttccgttaacccgtaaccctacgtactaaccgtccggtacccgtacgtcggaacgtaacgtaacgaggtaagtcggttacggtagtacgtttagtttaaccgtcgtcgtacgtaattaacgttaattacgttagttcggtacgttccacggtaccgttaccggtacggttaccggggacgggtacgtacgggtaacggtcggtaacagttaccgaggacgtacggg

SEQ ID NO: 2391 - DNA, 688 bp, Homo sapiens
  misc_feature: GYAE6OF01DM7LX.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacagtcgtgatcgacccagtctcacgtactcctgctgtgtctgtggcgagcggccacatcaactgacaagtccacgacctagtacgtttcgttttgtcacgtctaccaaagtaactagttggtacgtttacggttagtcgtttacggtaaccacgacgtaacggaaacgtaccgaaccggacgtaccgttacccctaaggttctacgtttactaatttttacgttcggtacttacttccgtaccggttcgggttaccggttcccgggtcctacggtaccgtacgttacgacggccggcacggcgtacgttcggtaggactagtacttaccacgttcacctacactacgactaccgacggtcctacggacgtaacgacgaacggtaacggtgttcggtacggttaatttaacggttttatcgttacgttacaagtaacttaagttcgttacggtcgttaccgccgttacggtcttaccggtcgggtacgggacgggacggtaaccgtagggtacaacggtactaacggagtcgtaacggg

SEQ ID NO: 2392 - DNA, 775 bp, Homo sapiens
  misc_feature: GYAE6OF01CCUJ0.38.23.C01.1.454.CMB.1.raw
  modified_base (261)..(261): a, c, t, g, unknown or other
  misc_feature (261)..(261): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattgggctgagtcgttgggttttccttgttgtcttattttaagaggtgtccagtgtgaggtgcgtaggttggtaggaatcggtaggggtaaacttggtaccaggccggtcgggggtaccnggaacgtctctcgtgtgcacgtcctcgtaggtacttacatttaagtttaagtaacttatagttagagttaggttacggttcgggtccctacgacgggtcctaccgggagggggtaccgggtcgtaggggtaagggtcgggtacgaccctaagtaacgtaaaccgacgtagtaacgaaacgtaagaaaaacgtctagtagaggtactgtaggaggaacggtaccgttactaccgtaccgttcacgaagtaacgaaccaaaccgtaacaaagtaccttactaacgttagtttagttacgaagaaagttaacgaactacggtaccgaagggtaacgtaaggtaacccggaaacgaccggaacccggtacccttaaaagtttaattaaacgtttacggtttaaagtaaaacggttaaaacgtaacttacgtttaaacgttaaccggttaaattacgggtttacgggggaaacgggttaccgggttaaacggggtttacccggggttggttaaacccgg

SEQ ID NO: 2393 - DNA, 686 bp, Homo sapiens
  misc_feature: GYAE6OF01ELKPQ.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccagtggaattggggctgagtcgttgggttttccttgttgcttattttagaggtgtccagtgtgaggtgctagttggtagaatcgtaggggtaaacttggtccagtccgtcgggggtccctgaacgcttctccgtgtgcctacgtcctcgtggtacttacgtatttaatttagaatctagttggaattggaggtttcgggtcccgaccgtacggcgttaccggagggggtacgggtcgttgggaggttggggtcggaccctaaacgtaacctaaaccgacgtagtagggaaactaaggaaaaagcttaagtcgtaggtactcgtggagtaacgggcctacgttacgacccgttcgtaccgaagtaacgacgaaaccgaaccgtaagtaacgttacagttacgttaagtttcgaactaaagtacgaacgtagaccgtaggaactacggtacgaacgacgaaccgctagtacttaagtttatacgtaaagttaaacgtatacgtattacgtattaacgggttcggtaggaaccgttaacgggtcgggtgtaccg

SEQ ID NO: 2394 - DNA, 777 bp, Homo sapiens
  misc_feature: GYAE6OF01C8837.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcacatggaattgggctgagcgttcggttttcctgttgcttatttaggaaggtgtccgtagtgtgaggtcgctaggttggtacggaagtcggtagggggtaaacttcggttaccgacggtccggtgggggtcccctaggacgtccttccgtccgtgtacgcagtcccgtctggtacttaccgtaaacttaacgtaaaaagttgtagggatcgaccgtaccggtcgggtccccgtaccgacggcctaccggacggtacggaaggggctgggaggtacgggtcgacgtaacgtagttactacgtagttagacgtagtaagggttaaactttaagacgtagtacggtcgtaccgtacggcggaacgtaccgtataccgactacgttaccacgaagacgtaactaacgtaaccaaggacctacgtaacctactactttaagtaccgtaacaagttaacgaacgtacggtacccggttaagggcccgtaacggttacccggaaggtaccgtaccggttacgttcgtaacgttacccggttagtccggaaccgggtaaccggtaaaaccggtacccccggttaccttaccggggttacgggttaacggggggttaccggttaacggtttaaggtcccggggttttaaacccggg

SEQ ID NO: 2395 - DNA, 694 bp, Homo sapiens
  misc_feature: GYAE6OF01CJSU4.38.23.C01.1.454.CMB.1.raw
  modified_base (131)..(131): a, c, t, g, unknown or other
  misc_feature (131)..(131): n is a, c, g, or t
  modified_base (184)..(184): a, c, t, g, unknown or other
  misc_feature (184)..(184): n is a, c, g, or t
  modified_base (196)..(196): a, c, t, g, unknown or other
  misc_feature (196)..(196): n is a, c, g, or t
  modified_base (346)..(346): a, c, t, g, unknown or other
  misc_feature (346)..(346): n is a, c, g, or t
  modified_base (356)..(356): a, c, t, g, unknown or other
  misc_feature (356)..(356): n is a, c, g, or t
  modified_base (487)..(487): a, c, t, g, unknown or other
  misc_feature (487)..(487): n is a, c, g, or t
tcagtcgatcacgtcacgaccggtgctcgatttagtacacgtgattaggggagttaggggggagctacaacaggcaggccaggggcagcaagatggtgttgcagacccaggtcttcatttctctgttgctntggatctctggagtccgtacggggacatcgtgatgaccagtctcagactccgngctgtgtctcgngggcgagagggcccaccataccaacgtgacaacgtaccagcctagacgttcttttagtccaagtcctacaaagtaattagtacggtacgtttagttaacgtcgtttaggaaccagacgaagaaacgctaacgacctacgtacctaagttnctatactttntacggtactatactacgtcgggttacggtccggtcccgtagtaccgtagttacgacgcggacgtacggacgtacgttacggaggactaagttcgtttaccaacgtcctacaccgtatacaggactacgtcngacagtacgaagtaacaggtcgtagtacgtttaattaaagttcctaagtgaaccgttataaagtttacggtacgttaacgggtacctcgggtaaccgttaccttacgggttacccggttacggggtaaacccgggtaaaaccggggccgttaaaaggggttacgggaaaacgtaaggttaaacggtaaaccggacgggttaaacggg

SEQ ID NO: 2396 - DNA, 688 bp, Homo sapiens
  misc_feature: GYAE6OF01CFDA0.38.23.C01.1.454.CMB.1.raw
  modified_base (406)..(406): a, c, t, g, unknown or other
  misc_feature (406)..(406): n is a, c, g, or t
  modified_base (492)..(492): a, c, t, g, unknown or other
  misc_feature (492)..(492): n is a, c, g, or t
tcagtcgatcacgtcacgaccggtgctcgatttagtacacgtgattagggagttgggggagctacaacaggcaggcagggcagcaagatggtgttgcagaccccaggtcttcatttctctgttgctctggatctcgtggacgccgtacgggacagtcgtgatcgacccgagtctccagacctccgtggctgtcgtctcggtgggacgaggacggacccaccagtacaacgtgacaacgtccagccgaagttcgttcttttgcacgcctacaaagtatgtggtagttcgtagtccgttacggacagacaagaacgtcaacgactaccgtacctaagtgcctttataagtttcgtcgtacttacgtaccgtacggtcgggttccggtacccggtacctagtaccgttntacggacggccggtacgaacgggtccgaaggttccggtaggtaacacgttacttccacgttccacgtaccgactgacgcaacgtcncgacgacgacgtaggactacgtggtacgttacttagtttacgtactacgtacgtacgtaacttaagttacgttaccggttaggtacccgtaccggttccgttaccgttacgggtttacccggttaggggaccccgggtaaaggtaccggttaaacgggtacgttagaaccggtaacgtaaccgggtagttaccggg

SEQ ID NO: 2397 - DNA, 689 bp, Homo sapiens
  misc_feature: GYAE6OF01CVPAP.38.23.C01.1.454.CMB.1.raw
  modified_base (184)..(184): a, c, t, g, unknown or other
  misc_feature (184)..(184): n is a, c, g, or t
  modified_base (188)..(188): a, c, t, g, unknown or other
  misc_feature (188)..(188): n is a, c, g, or t
  modified_base (190)..(190): a, c, t, g, unknown or other
  misc_feature (190)..(190): n is a, c, g, or t
  modified_base (192)..(193): a, c, t, g, unknown or other
  misc_feature (192)..(193): n is a, c, g, or t
  modified_base (198)..(198): a, c, t, g, unknown or other
  misc_feature (198)..(198): n is a, c, g, or t
  modified_base (569)..(569): a, c, t, g, unknown or other
  misc_feature (569)..(569): n is a, c, g, or t
  modified_base (577)..(577): a, c, t, g, unknown or other
  misc_feature (577)..(577): n is a, c, g, or t
  modified_base (590)..(590): a, c, t, g, unknown or other
  misc_feature (590)..(590): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagtcggtcgttcgtgtagctattagagtgtcngtgngngnnagtgngagtggtggaactgtcagtcggtggggtcctgatctctcgtgcgcgacgtccctgtcggtattacttaatttagtttagtaaccttagaagttgtaacggtttggtaacggggtttcggtaccccgtaccgacggttccgtacccggggtaggggacccggggttggtagggacgggttgggaccggaacctaaccgttaaaactaacccgtaacggaagttaaccgggtaaaacgtaaaagaaaaccgttataaacggttcggaagttcccgtaacggttcggggttaagggaaaaccggtccgtacggttacctaaccggttcaccggtaacgaacgtaaccacgaacgttaacaaattccaggtttanacgttaanacgaatagaacgngtacgtagagacgtacgacgacgtacacttagttatattagtaataagtaactagtagtacttgtaggttaggacggtacggtaggaggttcggtatgg

SEQ ID NO: 2398 - DNA, 712 bp, Homo sapiens
  misc_feature: GYAE6OF01DP4U0.38.23.C01.1.454.CMB.1.raw
  modified_base (348)..(348): a, c, t, g, unknown or other
  misc_feature (348)..(348): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcttgggttttccttgttgctattttagaaggtgtccagtgtgaggtgcgtagttggtggaatcgtagggggtaaacttggccagccggtggggtccctgagcctctcctgtgcacgtcctctggtacttcattatttagtaatcagttggtatggtagttcgggtccgaccgacggtcgtacggaggggaccggggngtgggaggttgggtcggacccacgtaactaaaccgaacgtagtaacggaacgtaaagaaaaactactaagtggtacggacttcgtagtacgggaacggtaccgtaacgtttaccgtaccggttacctacccgtaaggaccgaaaccgaaaccggaccgaaaacgttaaacttcctaaccgttagtttaacgtttagaacctaaagtacgaaacctacggtaccgtaacggagtaaacggtacggaacgtacccgacggtaaccattaacttaaatttacgttaagtaaagttaaaagtcttacgttaattaacgagttaggtagggtacggacgggtaaccggttacggggtcgtcgttaacgg

SEQ ID NO: 2399 - DNA, 934 bp, Homo sapiens
  misc_feature: GYAE6OF01EHIZ6.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaagttggggctgagtcgttcgggtttttccttgttgtacttagttttagaaggtgtccagtgtgaggtgcgtaggttggtggaattcggtagggggaaacttgggtccaggtccggtcgggggtccctaggacgtctccgtcgtgtcgacgacgcccgttcgtaggtactttacgtaatttaacgttttaaggtaatcgttagtttaggacgtttggtaacgggtttcggggtaccccgtccggacggttcccggttaccggaaggggggtaccgggggtcgttcgggggtacgggttacggggtacggtaaccccgtaacttaaaaccggtaaaacccgtacggtaacggtttaaacgggaaaacgttaaacggaaaaaaacgtaccgttaaacggttagggttacggtaacccgtttcggttacggggtaacgggtaaacccgggggtacccttaacgtttaccccggtaacccggttaccccgtaaccggtaaacggaaacccggtaacccgtaaacccggaacccgtaaaacggtttaaccctttacgtaaccggttttacggtttaaagttttcggaaaccgttaaaagttacccggaaaccgacggtttacccggaaggttaacggaccgggttaacgaaaccggtaccgggaaacccggtaccttaaagttacgtttaaagtttacttaaggttaaaacggtaaaaggttaacttaacttaaacgggttaccgtaagttaacgggtcgggttacgggtaaccgggtacgggttggggttacgtacgg

SEQ ID NO: 2400 - DNA, 755 bp, Homo sapiens
  misc_feature: GYAE6OF01A31FZ.38.23.C01.1.454.CMB.1.raw
  modified_base (249)..(249): a, c, t, g, unknown or other
  misc_feature (249)..(249): n is a, c, g, or t
tcagtcgatcacgtcacgaccggtgctcgatttagtacacgtgattagggagttgggggagctacaacaggcaggcaggggcagcaagatggtgttgcagacccaggtcttcatttctctgttgctctggatctctggacgccgtaggggacatcgtgatcgacccagtctccagtacctccctggtctgtgtcctcgtgggcgaggacgggccaccatacatgacaacgtccacgaccagtacgtttnttttcgtcgagcctaccaagaatatgtacgttcgtagtcttcggacacggacaaggaacgcgaaccgaccgtaaccgtaccccgtaagttcgccttacttattttacgttcggtatactcgttacggtccggggttcgggtcccgggtcctcggtaccgtacgttcgacggccggcgagggccggtacgtaccggtacgggactaggttacctttacacccgttacctaccaaccgtacttaccgacgtacccgtaacggtcccgtacgacgtaaccgtaggtaacggtaagtcgggttacggtaggttactttaacgggtttttacttaccggttcgtaaccgtaagtaccgtttaaaatttacgttaacgggttaggtttaaccccgttccggttaccggtacccgtttaccggtaccgggtttacgggaacccgggggtaaccgggtaaccgggtaaggggttaacccgtaggtaaccgtaaggttaaccggtcggtaacggg

SEQ ID NO: 2401 - DNA, 843 bp, Homo sapiens
  misc_feature: GYAE6OF01D91KU.38.23.C01.1.454.CMB.1.raw
  modified_base (833)..(833): a, c, t, g, unknown or other
  misc_feature (833)..(833): n is a, c, g, or t
  modified_base (836)..(836): a, c, t, g, unknown or other
  misc_feature (836)..(836): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagtcttgggttttccttgttgcttattttagaaggtgtcagtgtgaggtgcgtaggttggtggtaatcggtaggggggtaaaacttcgggtccgaacggtccggttcgggggggttacccctaggaacgtcctccgttccgtggttcgaccgtacgtcccgttcgttacgggtactttacctaaagtttaattttaaggtaaattccgttaagtttagggtagttgggttaacgggtttcggggtacccgtacccggtacgggtccggttacccgggaggggggaaccggggtcggtaggggtagggttcggggtacggtaccctaaacgttaacgtaaaacccgaacggtaagtaacgggtaaaacctaaaggtaaaaacggtacgttaaggtacggttacggtacgttacgtagggttaggaaaccgggtacctacgttaccgacccgttacaccgaaggtaacgaccgtaaaaccgacctaaaggttaacttaccgtaagtttacggtttaatttacgaaacttaaacgtacgtaaccgtcggtaaccctaggaaacggtacggaacgaaaaaccgtccgaacgtacctaagtttaagttaacgttagttacgttaaaaggtaaaacgtcgttaacgttagttacgagttaggtcgggtagacgggtaacggtttacgggngtntttacgg

SEQ ID NO: 2402 - DNA, 750 bp, Homo sapiens
  misc_feature: GYAE6OF01EAP3W.38.23.C01.1.454.CMB.1.raw
  modified_base (210)..(210): a, c, t, g, unknown or other
  misc_feature (210)..(210): n is a, c, g, or t
  modified_base (395)..(395): a, c, t, g, unknown or other
  misc_feature (395)..(395): n is a, c, g, or t
tcagtcgatcacgtcacgaccggtgctcgatttagtacacgtgattagggattggggaggtctcagagaggagccttagcccgtggactccaaggcctttgcacttggtgatcagcactgagcacagaggacctcaccagtaggagttgggctggacgtcgttcgggttttccttgttgtcttagtttagaggtctcgagtgtgaggtgngtagttggagagtcggtagggtaactggtccgaggtccggtcggggtcctagacgtcctcgtcgtggtcgctacgtcctacggtggtactttactaatttaacgtttaagtaactacgtagttggtagttaggtacggtttccgggtcccgacggtacggtccgtacgggaacggggtccgggtntgggtacggtcgggtaccgaacctaacgtaaaccgtaacgaagagtaacggaaactaaaggaaaacgtcttaaggtcggtagtcgttacgtaggtacggaaccggtctacgttacccgaccggtactaaccgaggaacctaaccgaacgaaccgtaaagttacttccgtaagtttgttaaccgtagaacctaaagtaccgtaacgtcgtaccgtaaggtaacggacgtaaccgaaccgtacgaaccgtacgttaatttaacgttagttacgttaaagttaaacgtaaagttactacgttaagtacgttaaagcgggtttgggaacggtaccgggttagggttcggtacgttacgg

SEQ ID NO: 2403 - DNA, 778 bp, Homo sapiens
  misc_feature: GYAE6OF01CY0CK.38.23.C01.1.454.CMB.1.raw
  modified_base (333)..(333): a, c, t, g, unknown or other
  misc_feature (333)..(333): n is a, c, g, or t
tcagtcgatcacgtcacgaccggtgctcgatttagtacacgtgattagggattgggggtctcagagaggagccttagccctggactccaaggcctttgcacttggtgatcagcactgagcacagagactcaccatggaattggggctgagtcgttgggttttcccttgttgcttagttttagaaggtgtccagtgtggaggtgctaggttggtaggaatcggtagggggaaacttggtccgagccggtcggggggtccctagaagcctctctgtgcagcctcgtgtatctattatttagtatactagttaggtatggtaggttcggggtcccnccgtacggccgtccggagggggtacggggtacgtgggtacgggttcgggacggtacctaaaccgtaacgtaaaccgaaccgtaggtaaacggtaaaccgttaaaaggaaaaaacgttacgtaaggttacggtacggtacgttcggtaagggttacgggacgggtaccctaacgttccgtacccggttaccgtaccgtaacggaacgtaaacccgaaccgaaccgtaaacgttaacttactaacgttgtttaagttacgaactaaacgtacgaaccgtaaggccgtaagaacggtaacggtaaccggtaacgacccgaaccgataacttaatttagtttaaagttaggttaaaacgtaaagtacttaccgtaatttaacggtaagttacggttagggggttaccgtaaccgggttacggggttacgggttagttaggttttacggg

SEQ ID NO: 2404 - DNA, 774 bp, Homo sapiens
  misc_feature: GYAE6OF01ER4RA.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctcctggctgtgtctcgtgggcgagacgggccacatcaactgcaacgtccagccagtagttcttttgtcagcctaccaagtaacttataggtacgtttcgttagtcgttacggtaccagaccaaggaaacgtccaaccggtacctaccggttacccccttaaaggttccgaccgttactagttttagttcggtactacgttacttaaccggtccgggttcgggttaccccggggtcccgtacgggtaacccgtacgtttacgaccggtcgggacgtaccgggacggtaccgtcggtacgggaaccgtacggttacttttaccgacctttacccggcctaacctactaccgtacgaacgtccgtacctacggacgtaacgtacgtacgaagtgtacggtacgttacgttaacggttttactacggttacgtagtaaccggttaataacgtttaacgttggttaaccggtacgttttacccgggtcgttacccgttccggtttacccgggttaccggggggaacggtaacccggggttaaccgaaacggggttacgggaacggtttaaccggtacccggtaaaggtaccggttaaccggggg

SEQ ID NO: 2405 - DNA, 862 bp, Homo sapiens
  misc_feature: GYAE6OF01BCY86.38.23.C01.1.454.CMB.1.raw
tcagtcgatcacgtcacgaccggtgctcgatttagtacacgtgattagggagttggggaggtctcgagagaggagccttagccctggactccaaggcctttgcacttggtgatcagcactgagcacagaggactcaccatggaattggggctgagctgggtttcctgttgctattttagaagtgtccgagtgtgaggtgcgtaggttcgggtaggaagttccggtagggggtaaaacctttggggtaccccgaaggtccccggttggggggggtccccttaggaacggccttcgttacccgtgtcgcgaggtcccttccgtgggtacttcgtaattattttaaggtaattcctaagtttcggaagttggtaggtttcgggtacccgcccgtacgggtaccttaccggagggggtaccgggtcgtagggacggttcggggtaccggaacctacgttaaaccgtaaacccgaacggtacgttacgggaaactaacggtaaaaaacggactttaacggtcggttaacgggtaaccgttcgttacggtacgggaaacgggtcccggtaaactttcccggacccgttacctaccgtagggaaacgtacccaaaccgggtacccgtaaaggttaaccttaccgaacgtttacggtttaacgtttacggacctaaagtttacggaaaccgtacggtaccggtaacggaaggtaaccggttacgggaaaaccggaccgtaaccggggacccttaagttaaccgttaagtttaccgggttagtaaacggttaaaactaagtcgttaaaccgttccgaaaggtttaagtccggggttagaccggttaaccgggttagggtccggttaaccgg

SEQ ID NO: 2406 - DNA, 583 bp, Homo sapiens
  misc_feature: GYAE6OF01AQO54.38.23.C01.1.454.CMB.1.raw
  modified_base (361)..(361): a, c, t, g, unknown or other
  misc_feature (361)..(361): n is a, c, g, or t
  modified_base (406)..(406): a, c, t, g, unknown or other
  misc_feature (406)..(406): n is a, c, g, or t
tcagtcgatcacgtcacgaccggtgctcgatttagtacacgtgattagggattggggggagctacaacaggcaggcaggggcagcaagatggtgttgcagacccaggtcttcatttctctgttgctctggatctctggagcctacggggacatcgtgatgacccagtctccagactccctggctgtgtctctgggcgaggagggcccaccatcaactgcaagtccagccagtagttcttttgtcagctaccaagaatatgtagttcgttagtcttggtaccagcaagaacgcacgacacgtccctaagttgctctatttatggtctatcgtacgtcgggtcgtcccgggtcctgtaccgtnttcgagtcggcaggcggtactcgtgggactagtactttccactcncacctatcgacgcacgcctgactacgactagaatgtaggtcgtagttagtttactacgtgtacacgtataattagttacggtggttcctccggtacgtccgtacgttaccgggttccgggacgggttaaccggacggtaaggggtacgaagtacgtaacgtaacggtccggtaacgg

SEQ ID NO: 2407 - DNA, 771 bp, Homo sapiens
  misc_feature: GYAE6OF01EIEWJ.38.23.C01.1.454.CMB.1.raw
  modified_base (121)..(121): a, c, t, g, unknown or other
  misc_feature (121)..(121): n is a, c, g, or t
  modified_base (203)..(203): a, c, t, g, unknown or other
  misc_feature (203)..(203): n is a, c, g, or t
  modified_base (254)..(254): a, c, t, g, unknown or other
  misc_feature (254)..(254): n is a, c, g, or t
  modified_base (269)..(269): a, c, t, g, unknown or other
  misc_feature (269)..(269): n is a, c, g, or t
tcagtcgatcacgtcacgaccggtgctcgatttagtacacgtgattagggattggggaggtctcagagaggagccttagccctggactccaaggcctttgcacttggtgatcagcactgancacagagactcaccagtaggaagttggggctgagtcgttgggttttccttgttgtcttagtttagaaggtgtccaggtgtgnggtgcgtagttggtggatggtaggggaacttggcacgtccgtcggggtccnggacgtctctcgtgncgacgctcgtgtattctattatttaagtatactagttaggtattggaggtttcgggccgcgacggtcgtacggacgggggacggtcgtagggacggttgggtcgaccctaacgtaaaccgtaaaccgacgtaagtaacggaaacgtaaagaaaacgtctagtacggtaggtacctacgtaggtaacggacgggtaccgtacgttaccgaacccgttccggtaacaggtaaaccggtaaccccaaacggtaaccctaaaggtaaaccctttacgtaacggtttacgtttaagttactaaacttaaacggtacgaaccgttagtcccggtaagtaaacggtcgggtaaacgaaaccggtacggtaacccgggaaccttaaacgttaactttaaagttttacgttaaacgggtaaagttaaaaacgttacgtatttaaacgggttaacgaggtttacggtggggtaacgggtacccgggttacgggttaaggggtccgtaaacgg

SEQ ID NO: 2408 - DNA, 750 bp, Homo sapiens
  misc_feature: GYAE6OF01CA2IO.38.23.C01.1.454.CMB.1.raw
  modified_base (154)..(154): a, c, t, g, unknown or other
  misc_feature (154)..(154): n is a, c, g, or t
  modified_base (160)..(160): a, c, t, g, unknown or other
  misc_feature (160)..(160): n is a, c, g, or t
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (201)..(201): a, c, t, g, unknown or other
  misc_feature (201)..(201): n is a, c, g, or t
  modified_base (217)..(217): a, c, t, g, unknown or other
  misc_feature (217)..(217): n is a, c, g, or t
  modified_base (224)..(224): a, c, t, g, unknown or other
  misc_feature (224)..(224): n is a, c, g, or t
  modified_base (708)..(708): a, c, t, g, unknown or other
  misc_feature (708)..(708): n is a, c, g, or t
tcagtcgatcacgtcacgaccggtgctcgatttagtacacgtgattagggattgggggagctacaacaggcaggcagggcagcaagatggtgttgcagacccaggtcttcatttctctgttgctcgtggactcttcgaggacgccgtacggganttcggngactcgacccagttcaccgagcctccgnggctgtncctagnggacagcgacctacgntacagtnacgacgcagaccgaggttacttcgtttagacgacgtacctaacaaaggtaactgtaccgtagtttacgtagtcgttaaccgaccgagtaacaacggaacgtccaaacggacttacccgttacaagtcagttctagttatcgactaatccgtacggttcggccggttaccggtaccctaaggtaccgtaacgttccgacgggttaccgacgaagggtaccccgtagtttaacggggaagaaccctttagttaaccgtacttacccgtacttaaccgaccttacggtacaaccggtactaacgtacgttccggaacgtagtaaccggtagtaaacgtcggtaacgtagttaaccgttagtttaacgacccgtttaagacgtaaaccgttagtaaaccgtttagtaaccgttaggggtacctccggttaccgtaccttacggtacccgggttttaccgggaacgggaaccggttaacggttaacggngttaaaaccggtacgtaacggtaacggtaaggttaacccggg

SEQ ID NO: 2409 - DNA, 867 bp, Homo sapiens
  misc_feature: GYAE6OF01CXC65.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagagactcacatgaagttgggctgagtcgttgggtttccttgttgtcttatttagaaggtgtccgtagtgtgaggtgcgtaggttggtaggtaagttccggtagggggtaaaccttgggtaccgacggtccggttcgggggtaccctggaacgtccttccgtccttgtcggaccacggtccctcgtaggtacttacgtaattaagtttaacggtaactactagttaggtaagtggtaaggtttccggggtaccgccgtacggtccttaccgggaaggggtccgggtcggtagggtacgggtacggggtcggtaacccgtaacgtaaaccgtaaaccgtaccggaacggttaaggtaaaaccgtaaggtaaaaacgtacgttacgtagggtacgtaaccgttcgtaggtaacggaaccggtccgtaacgttccgtacccgtcgtaccgaacgacgaaaccgtacgaaccgtaagttaactacctacgttacgtttaaacgttcgtaaactaaacggttacaacgtaccgtaaccgtaaggtaaacgtacgggttaaaccgaaacggtaaccccggacgggttaacccctaagttaaagtttaaggtttaacgggtttaaacccgtttaaaggggttaaaaaaccctgttaaacccttaacccggttttggtaaacccggtttaggttaccggggttacccggaacgggttaaccgggttacgggttcgggtaacttttaacccggg

SEQ ID NO: 2410 - DNA, 663 bp, Homo sapiens
  misc_feature: GYAE6OF01BX52F.38.23.C01.1.454.CMB.1.raw
  modified_base (212)..(212): a, c, t, g, unknown or other
  misc_feature (212)..(212): n is a, c, g, or t
  modified_base (349)..(349): a, c, t, g, unknown or other
  misc_feature (349)..(349): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagtcgttgggtttccttgttgtcttagtttagaaggtgtcagtgtgaggtgctaggttggnggaatcgtaggggaaacttcggtaccaggtccgtcgggggtcctagagtctctcctgtcgcagcctctggtattctattatttataatctagttggatggtagttcggtaccgccgacggcctcggaggggacgggngtcgggaggtcgggtcgaccgaacttaaagtaaaccgaacggtaacgtaacggtaaacgaaacgtaaaagtacgtaatcggtaagtactcggtaggtacgggaacgggtaccgtacttacccgacgttacaccggtaaacgacgtaaccgaacgaccgtaaagtactacgtattagttagttagaaaccaagtaagaaccaggtacctaaggacgaaacgtagaacgacgaaccgctaattatatagttagaaagtaagtgtaaacttggtaaccgtattcgggtaggtggaacggttacggtaggggtgtacg

SEQ ID NO: 2411 - DNA, 777 bp, Homo sapiens
  misc_feature: GYAE6OF01BH8Q8.38.23.C01.1.454.CMB.1.raw
  modified_base (593)..(593): a, c, t, g, unknown or other
  misc_feature (593)..(593): n is a, c, g, or t
tcagtcgatcacgtcacgaccggtgctcgatttagtacacgtgattagggattcgggggagctacaacaggcaggcaggggcagcgaagatggtgttgcagacccaggtcttcgatttctctgtggctcgtcggatctctaggagccgtacggggacagtcgtgacgtgaccctagtcctaccagacctcccgtggctgtgtccgtcgtgggcgaggcggccaccattcaactgacaacgtccacgcctagtacgttcgtttgtcacgtctaccgaagtagtatcgtacgttacgttacgtcgttacggtacagacaagtaacgcaccgaccgtccgttaccgtaaggttcgaccttacttacgttttattcggtacctacgttaccggttacgggttccggggttaccgggttccccgggttccttacggtacccggttacgtttcggaccggttcgggaccggtacgggtacgggtaaccttcgggtacggggtaaacttacggttaactttcccgaacttccccgtaacctacccgtaatcccgaaacgccgaacgttccccgaggtacacgtaaccggttgaagggttntacggggtactgttttaacgtttaactacggtcgtacgacttaaacgttaacttaggtaagttccggttacccgtcggttcggaccccgtttagttacccggggttaccggggaacggaaacccggggtttacccaaggggttcgaaacgttaaccgtaccgggaaaggttcccgggtaacggg

SEQ ID NO: 2412 - DNA, 750 bp, Homo sapiens
  misc_feature: GYAE6OF01ELF3E.38.23.C01.1.454.CMB.1.raw
  modified_base (621)..(621): a, c, t, g, unknown or other
  misc_feature (621)..(621): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggacgccgtacgggacatcgtgatcgacccagtcctccagtacctcccgtggctgtcgtctcgtggcgaggcggacccacataccaagtcgacaacgtccacgtaccgaggtactttcgtttttaggaccacgtcctaaccgtaaaggtaacttaggttacgtacggttttaccggttaggtccgttaacggtaccaaggtaccgaaaggaaacgtaccgaaaccggtacccgtacccggtttaacccccgtaaggttccgtactttacgttaagtttttacgtcggtaactacgtttaccgttacggttcccggggttccggtcccccggtacctacggtacccgtatccggacggtccgtacggaggtcggtaccgtggaccggattaccgttactcctaccgtcaccacgtaatccgaacgcctcggtccagacgtaacgacgttaggagttacgtggtacgtacttttaacgttacgtacgngtaacgtaccgtaaattagttaccgttggtaccggttccgtaccgtcggtaccgtttacccgttaggggtaccgggacggtaaacgggtaccgaagggtccgtaataacggcgtaacgggcgttaaggg

SEQ ID NO: 2413 - DNA, 803 bp, Homo sapiens
  misc_feature: GYAE6OF01AELJV.38.23.C01.1.454.CMB.1.raw
  modified_base (728)..(728): a, c, t, g, unknown or other
  misc_feature (728)..(728): n is a, c, g, or t
tcagtcgatcacgtcacgaccggtgctcgatttagtacacgtgattagggagttggggaggtctcagagaggagccttagccctggactccaaggcctttgctacttggtgatcagcactgagcacagaggactcaccataggtaagtggggctagagtcgttcgggtttttccttggttgtacttagtttttaaggaaggttcgttaccgaggttggtaggtggtcgtctaggtttggacggtaagttcggtagggggtaaacttggtaccgacggccggttacgggggtccaacgtacgtctccgtccgtgtacgcacgtccgtcgtggtactcgtaatttagtttaagtactcgtagttggtagtcggttaaggtttccgggtcccgcggtaacggtcccggtcgggtaacgggggaccgggtcggtggggtacggttcgggtaccgtaccgttaacgttaaaccgaaaccggtagaaggtacggtaaacgaacggaaaggttaactaggttgtaacggtaccgttgtaggaacggtacggtactacgtacgtcccgtacgacgtagaacggtaacacccggacgtaagtacttacccggtattacggttactaacgagaactacgaagtacgcgttaacggaagtaggtaccggaacgacgtaccggtaactaagtttacttaagtttaccgtaaaggtttaaccaaaggtttcgttaaacgtnttaaaacggggttcttaaacggggttcgggaaacccgggttaaccgggttaacggtttcggggttaactaccggg

SEQ ID NO: 2414 - DNA, 972 bp, Homo sapiens
  misc_feature: GYAE6OF01EULF9.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaagttgggctgagctcgggttttccttgttgcttatttagaggtgtcagtgtgaggtgcgtaggttggtggaatcgtagggggtaaacttggtccaggtccggtcggggggtcccctaggaacgtccgttccgttccgttggtcggcctacggtccccttcgttagggtactttacctaattttaattttaacggtaattctaaggtttcgggtaatttgggtaagggttttccgggggtaccccgtacccggtacggggtacccgtttccccggggaaggggggtaaccgggggtcccggttaggggtaacgggtttccgggggtacggtacccccgtaaaccgttaaaacgtaaaaccccgtacggtaaacggttacgggtaaaaaccgttaaacggtaaaaaaaaccggtccgttaaagggttacggtttaaccgggtaaaccctttccggttaaggggttaacggggtaaaacccgggggtcccgtaaaccgttttaccccggtaaccccgtttaccgtaaccccggtacggaaaccgggaaacccgtaaaacccggacccgttaaaaacggtaaacttttaccccgacggttttaacggttactttaacgggtaaactaaacgttacgtaaacgtacggtacccgttaggaaggtaaacccgggtacggtaaaccgccgtaacccggtaccgttaaattaagtttaaaccttttaagttaggtttaaaaggtaaaacgtacttaaccgtaacgtttacgtaaaccggtttaacgtacgggggttacgggaaaccgggttaccggggttaaaggggtccgggtaacgg

SEQ ID NO: 2415 - DNA, 788 bp, Homo sapiens
  misc_feature: GYAE6OF01BUL7H.38.23.C01.1.454.CMB.1.raw
tcagtcgatcacgtcacgaccggtgctcgatttagtacacgtgattagggattgggggagctacaacaggcaggacaggggcagcaagatggtgtgcagacccaggtcttcatttcctctgttgctctggatctctggagccgtacgggacatcgtgatcgacccagtctccagacctccctggctgtcgtctcgtgggcgaggacggccacatcgaactggaccaagtccacgaccgagtacgtttcgttttagttcacgaccttaccgaagtaactagtacgtacggttttcggttacgtacgtttacggtaacccgacggtaccgaaaacggtaaccgaccgtaacccggtaaccgtaacccggtttaacccccggtttaaggtttaccggtacctttaacctttaagttttaccgttcgggttaaccttaacggttcccgtttaaccgggttcgggggtaccgggtttcccggggttaccccgtacggtacccggttaacgttcggacgggtccggaccgaagggtcccgggtacttacggtaccgggtaactacggttacttacccgaccttacctaccgacctacgtaccagtacccgtacgccgtgaccctaaggtcctaggagtcgtggtctacgtttagtttactacgtagtaacgtactactaagttacgttagttccggtacggtcccgtagtacccggttcgttaccgggttcgggaacgggttacggtaacgtaaggggttacaacggttaccgacgttaacgggccgttaacgg

SEQ ID NO: 2416 - DNA, 998 bp, Homo sapiens
  misc_feature: GYAE6OF01BOHG2.38.23.C01.1.454.CMB.1.raw
tcagtcgatcacgtcacgaccggtgctcgatttagtacacgtgattagggagttgggggtctcagagaggagccttagccctggactccaaggcctttgccacttggtgatcagcactgagcacagaggactcaccagtggaatggggctggacgcttggggttttccttggttcgacttattttacggaaggtgttcccaggtgtggagggtgtcgtaggtttgggtaggaagttcggtagggggtaaactttcgggtaccgtacggtccggttggggggttacccctggaacggtcctcgtccgtgttacgctaggtccttccgtggtacttaccgattaagtttaagtaacttacgtaactttgggtaattggtaaggtttcgggtacccggaccgtacgggccttaccgggtacggggggtaaccggggtcggtacggggaacgggttcggggggtacggtaccccggtaaccgtttaaaacggttaaaacccccgaacggggtaactaaaccgggggtaaaaacttaaccgggggtaaaaaaaaacgttcccggttaaagggtttacgggttaaacgggttaaccgtttaccggttaaccggggttaacggggaaaaccggggttacccgttaacggtttaccccgtaacccggttacccgttaacccgaacgggtaaaccggaaacccgtaacccggtaaacccgaacggtaaaacgtttaccgtaacggtttaacgtttaagtttaaccgtaactaaacgtttacggaaacctacgggtccttaagggaaacggtaacggttaaccggaaaccgggtaaacccgtaccgggttaacctaacggttaaagttaacggttttaaacgtttcggggtaaaagttaaaaacgttacgttaaaccttacgggttttaccaacgggttaggtttaaccggggtcggggaaccccggttaaaggggtttacccggggtcggttacgtttaaaccgggg

SEQ ID NO: 2417 - DNA, 611 bp, Homo sapiens
  misc_feature: GYAE6OF01BRPZI.38.23.C01.1.454.CMB.1.raw
  modified_base (195)..(195): a, c, t, g, unknown or other
  misc_feature (195)..(195): n is a, c, g, or t
  modified_base (198)..(199): a, c, t, g, unknown or other
  misc_feature (198)..(199): n is a, c, g, or t
  modified_base (207)..(207): a, c, t, g, unknown or other
  misc_feature (207)..(207): n is a, c, g, or t
  modified_base (219)..(219): a, c, t, g, unknown or other
  misc_feature (219)..(219): n is a, c, g, or t
  modified_base (230)..(230): a, c, t, g, unknown or other
  misc_feature (230)..(230): n is a, c, g, or t
  modified_base (234)..(234): a, c, t, g, unknown or other
  misc_feature (234)..(234): n is a, c, g, or t
  modified_base (239)..(240): a, c, t, g, unknown or other
  misc_feature (239)..(240): n is a, c, g, or t
  modified_base (244)..(244): a, c, t, g, unknown or other
  misc_feature (244)..(244): n is a, c, g, or t
  modified_base (246)..(246): a, c, t, g, unknown or other
  misc_feature (246)..(246): n is a, c, g, or t
  modified_base (249)..(249): a, c, t, g, unknown or other
  misc_feature (249)..(249): n is a, c, g, or t
  modified_base (252)..(252): a, c, t, g, unknown or other
  misc_feature (252)..(252): n is a, c, g, or t
  modified_base (254)..(254): a, c, t, g, unknown or other
  misc_feature (254)..(254): n is a, c, g, or t
  modified_base (262)..(262): a, c, t, g, unknown or other
  misc_feature (262)..(262): n is a, c, g, or t
  modified_base (496)..(496): a, c, t, g, unknown or other
  misc_feature (496)..(496): n is a, c, g, or t
  modified_base (570)..(570): a, c, t, g, unknown or other
  misc_feature (570)..(570): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggacctcaccagtggaagttggggctgaggcggtggttcgtgtaggtcgtattagaggtgcagtgtgngtnntgtgtgangtgggtatgacngcgtcgggtcngatnctcgnngacntntgngtntntatacttntatgtagtgatgtacggtcgccgacgtcggaccgacggtagggacggtggtaggtggtcggtacgtacctaagaaccaacgtacggaacgtaaggaaactaaagtaaacgtacgtagtaggtacgtacgtagtaaggtacccggtacgtcctacgttaccgacgtcaacggaagtactaacccgaactaacgtaacgtactccgttaacgttagttacgaaacgagaagtaacnccaggtagaacggtagaacgggtaccaacggacttagaattcgtaagttaagtaggttaatagaattacccgtntagtacggtatggtaccgacggtaggttcggtaagtgtccg

SEQ ID NO: 2418 - DNA, 888 bp, Homo sapiens
  misc_feature: GYAE6OF01CZ1FR.38.23.C01.1.454.CMB.1.raw
  modified_base (226)..(226): a, c, t, g, unknown or other
  misc_feature (226)..(226): n is a, c, g, or t
tcagtcgatcacgtcacgaccggtgctcgatttagtacacgtgattagggagttgggggagctacaacaggcaggcgagggcagcaagatggtgttgacagaccctaggtcttctatttctcgttgttacgcttcgtggtacttcgtcgtaggaccgtccgtaacgggacagtcggtagactcgaccagtctacacgtcctcgtgtctgtacgtcgtcggtacggngacggacggaccaccgtaatccgaacgttccggaacgttacgacccgagtaaccgtacggtttacgtttttcctttacggttacaaccggtacttaaaccgaagttaaaggttcgtttaaggttaacggttttacggtttacgggtaactttcgggaaaacccaggaagaaacggtaaccgtacggtaacccgtaaccgtacccggtttaacccgtaagttcccggtttactttaagggtttaccgttttagtaccggttcttaacgttaccggtttacgggtccggggttacccggttaccggggttacctaacgtaacggttgtacccgagggttcccggaacgtacgtcgggtaacgttcgggtaagtaccctaagttcgtttaccctaaccgtcctaacgtaccgttagacccggacgttacgaccgttaccgacggaccgtaaggtactacgggatttaacgtcggtaaacggttacttttaggttaccctgtaacggttaacttacgtaaagtaacgttgttaaccgggttccgttaccgggttctaacccggttcggttaaccggttcccggggaaacggggtcccgttaaaggggttaacgtaacgggggtctaaaacgggtccgtaaaacggttcccggggaccttaacgggg

SEQ ID NO: 2419 - DNA, 612 bp, Homo sapiens
  misc_feature: GYAE6OF01CYTUV.38.23.C01.1.454.CMB.1.raw
  modified_base (404)..(404): a, c, t, g, unknown or other
  misc_feature (404)..(404): n is a, c, g, or t
  modified_base (560)..(560): a, c, t, g, unknown or other
  misc_feature (560)..(560): n is a, c, g, or t
  modified_base (566)..(566): a, c, t, g, unknown or other
  misc_feature (566)..(566): n is a, c, g, or t
  modified_base (570)..(570): a, c, t, g, unknown or other
  misc_feature (570)..(570): n is a, c, g, or t
  modified_base (574)..(574): a, c, t, g, unknown or other
  misc_feature (574)..(574): n is a, c, g, or t
  modified_base (577)..(580): a, c, t, g, unknown or other
  misc_feature (577)..(580): n is a, c, g, or t
  modified_base (584)..(584): a, c, t, g, unknown or other
  misc_feature (584)..(584): n is a, c, g, or t
  modified_base (587)..(587): a, c, t, g, unknown or other
  misc_feature (587)..(587): n is a, c, g, or t
  modified_base (589)..(589): a, c, t, g, unknown or other
  misc_feature (589)..(589): n is a, c, g, or t
  modified_base (592)..(592): a, c, t, g, unknown or other
  misc_feature (592)..(592): n is a, c, g, or t
  modified_base (595)..(595): a, c, t, g, unknown or other
  misc_feature (595)..(595): n is a, c, g, or t
  modified_base (597)..(597): a, c, t, g, unknown or other
  misc_feature (597)..(597): n is a, c, g, or t
  modified_base (600)..(603): a, c, t, g, unknown or other
  misc_feature (600)..(603): n is a, c, g, or t
  modified_base (605)..(605): a, c, t, g, unknown or other
  misc_feature (605)..(605): n is a, c, g, or t
  modified_base (607)..(607): a, c, t, g, unknown or other
  misc_feature (607)..(607): n is a, c, g, or t
  modified_base (609)..(610): a, c, t, g, unknown or other
  misc_feature (609)..(610): n is a, c, g, or t
  modified_base (612)..(612): a, c, t, g, unknown or other
  misc_feature (612)..(612): n is a, c, g, or t
tcagtcgatcacgtcacgaccggtgctcgatttagtacacgtgattagggattgggcacggtgggcatgtggcagttatgtcacatgatggaagaaaaaaatttacgcagactccctgaaggtcgattcaccatctccgagagacaaacttccaaaccaacaccctgtatttcgacaaatgaacagcctagacgaactgaacgacacggctatctattacgtgtgacgagagactcgacgtccggaacgaacaaagttcgacttacgggtacgtaaccgttcgacgtaacgtacgtcgggaccgaacggaacccgtggtccaccgtcctcctcgacgccctaccgaccgaacggcccaacgtccggttccttccccgtgcccgtacccctacctaccgaagacnccgtacctcggtaccgggcaccgtacgcccggtaccgcggtacctcggccgtacggtacccgaacggtacccttaccgttacccgaaccggttacgtaccgtaccggtacgtcggaacggtccgggtacgtcggacggaacggcctacgagtacgngctagntcgnacgntgnnnngcgncgngngcncgngncgnnnngngncnngn

SEQ ID NO: 2420 - DNA, 765 bp, Homo sapiens
  misc_feature: GYAE6OF01DSD7V.38.23.C01.1.454.CMB.1.raw
  modified_base (111)..(111): a, c, t, g, unknown or other
  misc_feature (111)..(111): n is a, c, g, or t
  modified_base (434)..(434): a, c, t, g, unknown or other
  misc_feature (434)..(434): n is a, c, g, or t
  modified_base (563)..(563): a, c, t, g, unknown or other
  misc_feature (563)..(563): n is a, c, g, or t
tcagtcgatcacgtcacgaccggtgctcgatttagtacacgtgattagggattgggggagctacaacaggcaggcaggggcagcaagatggtgttgcagacccaggtcttnatttctctgttgctcgtggatctctggacgtccgtaacggggacacgttcgtgtacgtacgacccgtagtccgtaccacgtacccttccgtcggtcgttggttcgttcctcggttcggggacgacgggacgggacccacctataccgaactggaccaacgtccgacgccgtacgtacgtttcttttacgtactacgtactaaccaaagtaacttagttacgttacggtttacgttacgttacgttacgtaaccgtacgacgtaacgaacgaccgaacggtaccgtaccggttaccctaaggtctaccttacttactttacgtntcctactcgttaccggtcgggtccggttccggtaccgtacgtacgtacgtcgacggtcgacggacggcgtacggtcggtacggtacgtactttacttaccgtacctacctaccgaacctacgtcgaccncgtacgcgtcgacgtaacgtacgtaacgtagtacgttggtacggttactttacggttttacgaacgttacgtacgtacgttaattaacgtttacgttacggttaccgttcggttacccgttacgtccggttacgttaccgggtaccgggtacgggaaccggttaggaaccgggttagacgtacggtaactaggcggttacgg

SEQ ID NO: 2421 - DNA, 949 bp, Homo sapiens
  misc_feature: GYAE6OF01BP9GT.38.23.C01.1.454.CMB.1.raw
  modified_base (168)..(168): a, c, t, g, unknown or other
  misc_feature (168)..(168): n is a, c, g, or t
tcagtcgatcacgtcacgaccggtgctcgatttagtacacgtgattagggattgggggtctcagagaggagccttagccctggactccaaggcctttgctacttggtgatcagcactgagcacgagagactcacatggagtgggctagagtcgttggttttcctgttntacgttagtttaggagtcgtcgtagtgtggaggtcgtcgtaggttggtacggtaacgtcgggtaacggggttaaacttcggtacccggtacggtacccgggttaccggggggttacccaaggtaaccgttccgtttaccgtcccgtaggtcggaccgtacgttaccgttcgtacgttactttacgttaagtttaacgtttaactacgttacggttaagttacggtacgttacggggttacggttccgggtaccgtaccggtacggtacccgacggggtacggggtacggtacgggtacgggtacgggtaccggtaccgtaaacctaaaccgtaaacgtaaacccggtaagtaaaccggtaaggtaaaaccgtaaaaggtaaaccgttaacgtacggttaaccggttaacggtaaccgtttacgggtaacggttaacggaacccggtaccgttaccgttaccccgtaccgttaccgtaacgtaacggtaaacccggtaaaccgtaacccggtaaacgtaacggttaaccgttaacgttaccggttaagtttaacgttaaacgtaacgtaaacgtaacgtaacgaaccgttaacggtaacgaacggtaaccggtaaccgtaacgtaaccgtaccgtaacttaacgttaaaggtttaacgttaaggttaaaccgtaaaggttaaacgttacgttaacggttaaagttacggttaacggttacgggtacgggttaacccgttaacggggttaacccgggtttacgtaccggttcggtttaaccgg

SEQ ID NO: 2422 - DNA, 918 bp, Homo sapiens
  misc_feature: GYAE6OF01EO8AR.38.23.C01.1.454.CMB.1.raw
  modified_base (480)..(480): a, c, t, g, unknown or other
  misc_feature (480)..(480): n is a, c, g, or t
  modified_base (903)..(903): a, c, t, g, unknown or other
  misc_feature (903)..(903): n is a, c, g, or t
tcagtcgatcacgtcacgaccggtgctcgatttagtacacgtgatttagggagttgggggtctcagagaggagccttagccctggactccaaggtcctttgcacttggtgatcagcactgagcacgagaggactaccaaccagtagggtaagttgggacttagacgtcgtttcgggttttcttgttcgatttagttttaggaggttcgtccgtagttgtggtacggtgtacgtaggtttacgggaggtaacgtacggtagggggttaaaccttcggtaccgtacgggtcccggggttacgggggtcccgtaggtaaccggtctaccgttcctggttccgacgtacggttccttagtacggtacgttactaagtttaattaaggttactacgttaggtcgtaaggtaggttaccggggttccggtaccgaccgtacgggtccgtcggggtaacgggggtcgggtacggagggttacggggngggttaccgaaccgttaaacgtaactaaaacccggaggtaaggttaaccggaaagtaaacggtaaaacgtacgttacggtaggtaccggtataccgggtaggtaaccgggtaccgggtaccttaccgttaccggtaccgttaccgtaccgtaaccgtaaacgaaacccgtaacccgtaaaccgttaaacgtaaccgtttaccgttacttaacggtttaactacgttaaacgtaaccgtaacgaaccggtcgtaacggaaccggtaaggttaaccggtaacggtaaccggttaaccgaaccgttaacgtaactttaacggtttaatttaacgggtttaagtaaaccggttaaagtacccttaaggttaccgttaggttaaacggtggtttaccgggtagggtaccgggtaccggtttaacgggnggtttagttaccggg

SEQ ID NO: 2423 - DNA, 498 bp, Homo sapiens
  misc_feature: GYAE6OF02HTT4B.38.23.C01.1.454.CMB.1.raw
  modified_base (406)..(406): a, c, t, g, unknown or other
  misc_feature (406)..(406): n is a, c, g, or t
  modified_base (409)..(409): a, c, t, g, unknown or other
  misc_feature (409)..(409): n is a, c, g, or t
  modified_base (491)..(491): a, c, t, g, unknown or other
  misc_feature (491)..(491): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccagcagaaagcacgacagtcccctaagttgctcatttatggtcatctactcgggtgtccgggtcctgaccgattcagcggcagcggatctgggacagatttcactctcaccatcagcagcctgcagactgaagntgnggcagtttatactgtcagcaatattatgtagtcctcggtctcgtactttcggcggtaggaccgaggtggagagtacgacggngtaacgg

SEQ ID NO: 2424 - DNA, 498 bp, Homo sapiens
  misc_feature: GYAE6OF02G1E4I.38.23.C01.1.454.CMB.1.raw
  modified_base (406)..(406): a, c, t, g, unknown or other
  misc_feature (406)..(406): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtctttgtcagctccaagaatatgagttcgttagcttggtaccagcagaaagcacgacagtcccctaagttgctcatttattggtcatctactcgggtgtccgggtccctgaccgattcagcggcagcggatctgggacagatttcactctcaccatcagcagcctgcagactgagntgtgcagtttatacgtgtcagctaatattatggtagtcctcggctctactttcgggcggtacgggacaagggtggagatcgaagcggtaacg

SEQ ID NO: 2425 - DNA, 526 bp, Homo sapiens
  misc_feature: GYAE6OF02G2W70.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccagggacggggctggagtgggtggccactataaaccacgatggaactgaaaaagctatgtggactctgtgaagggccgattcaccgtctccagagacaacgccaagaatcactgtatttgcaaatgaacagcctagagagtcgaagacacggccatatattattgtagtaaaagatacattcgatagtggtggcgacggtacgggtggtacg

SEQ ID NO: 2426 - DNA, 534 bp, Homo sapiens
  misc_feature: GYAE6OF02F2PMX.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccgagggacgggctgggagtgggtggccactataaaccacgatggaactgaaaaagctatgtgactctgtagaagggccgattcaccgtctccagagacaacgccaagaactcactgtatttgactaaatgaacagcctagacgagtacgaagacacggcaatatattatgtagtaaagatacattacgatagtggtaggacgtacggtacgggtggtacg

SEQ ID NO: 2427 - DNA, 531 bp, Homo sapiens
  misc_feature: GYAE6OF02H9AW2.38.23.C01.1.454.CMB.1.raw
  modified_base (334)..(334): a, c, t, g, unknown or other
  misc_feature (334)..(334): n is a, c, g, or t
  modified_base (341)..(341): a, c, t, g, unknown or other
  misc_feature (341)..(341): n is a, c, g, or t
  modified_base (440)..(440): a, c, t, g, unknown or other
  misc_feature (440)..(440): n is a, c, g, or t
  modified_base (486)..(486): a, c, t, g, unknown or other
  misc_feature (486)..(486): n is a, c, g, or t
  modified_base (525)..(525): a, c, t, g, unknown or other
  misc_feature (525)..(525): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaggtgtccagtgtgaggtgcagttggtggaatcgtgggggaaacttggtccagccgtggggggtccctgaagctctcctgtgcagcctctggattcatatttagtaatcattggatgagttggtccgcaggctccgagggacgggctgggagtgggngccatanaaaccacgatggaactagaaaagctatgtaggactctgtgagggcgtattccgaccgtctaccagacgacaacgcaagactcactgttatttgacaatnaacacgctgagagtacgaagacacgccatatattatgtagtaaagntactatacgtatagtggtcggcggtacggtacgggtggnttacgg

SEQ ID NO: 2428 - DNA, 532 bp, Homo sapiens
  misc_feature: GYAE6OF02HF8RY.38.23.C01.1.454.CMB.1.raw
  modified_base (495)..(495): a, c, t, g, unknown or other
  misc_feature (495)..(495): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagtaatcattggatgagttgggtccgccaggctccgaggggacggggctgggagtgggtggccactataaaccacgatggaactagaaaagactatgtggactctgtgaagggccgattcaccgtctccagacgacaacgccaagaactcactgtatttgacaaatgaacagcctagagagtacgaagacgacgccataatattattgtaagtaaagntactattcgaatagtggtggcgtacggtgggtgctag

SEQ ID NO: 2429 - DNA, 654 bp, Homo sapiens
  misc_feature: GYAE6OF02GAA89.38.23.C01.1.454.CMB.1.raw
  modified_base (265)..(265): a, c, t, g, unknown or other
  misc_feature (265)..(265): n is a, c, g, or t
  modified_base (327)..(327): a, c, t, g, unknown or other
  misc_feature (327)..(327): n is a, c, g, or t
tcagtcgatcacgtcacgaccggtgctcgatttagtacacgtgattagggattggggaggtctcagagaggagccttagccctggactccaaggcctttgcacttggtgatcagcactgagcgacaggagaacgtcgaccataggaatggggctgagcgtggtttcgtgtggctatttagaaggtgtccagtgtgaggtgcagttggtggaatctgggggaaacttgggtccaggcctggggggtccctgaagctctcctgtcgnacgcctgtggattcattattagtaatcattggatgagttggtccgcaggctcgagggcgggngtggagtgggtcgactacgtaactaacgacgtagtagaacgaagaaaagtagtagtgtacgtacgtcgtaggtacgaagggtactacgttccgaaccgtctacgagacgaacgaaccgactaaagtaacttactaacgttagttacgttacgacgtaagtacgaacgtacgtaccgtaggacgtacgtaacggaacgaccgaacggtacctaagttaagttaacgtttacgttaaggttaaaggttaaaacgtacttaacgttaacgttacgttaagttacggttagggttaccgggtacgggtaacggggttaccgggttaggacg

SEQ ID NO: 2430 - DNA, 530 bp, Homo sapiens
  misc_feature: GYAE6OF02I8RNP.38.23.C01.1.454.CMB.1.raw
  modified_base (304)..(304): a, c, t, g, unknown or other
  misc_feature (304)..(304): n is a, c, g, or t
  modified_base (378)..(378): a, c, t, g, unknown or other
  misc_feature (378)..(378): n is a, c, g, or t
  modified_base (404)..(404): a, c, t, g, unknown or other
  misc_feature (404)..(404): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggtttcctgttgctattttagaaggtgtccagtgtgaggtgcagttggtggaatctgggggaaacttggtccagcctggggggtccctgaagctctcctgtgcagcctctggattcatatttagtaatcattggatgagttgggtccncaggctccgagggacgggctgggagtgggtggccatataaaccacgatggaactagaaaaagctatgtagactntagtgaagggcatcacgtctccaganacacgcaagatcatgtattgacaatgaacagacctgagagtacgaacgacacggccaatatattagttagtagtaaaagtatactaattacgattacgtgggtacggacgtacggtagggtgtacg

SEQ ID NO: 2431 - DNA, 532 bp, Homo sapiens
  misc_feature: GYAE6OF02ICWNX.38.23.C01.1.454.CMB.1.raw
  modified_base (274)..(274): a, c, t, g, unknown or other
  misc_feature (274)..(274): n is a, c, g, or t
  modified_base (358)..(358): a, c, t, g, unknown or other
  misc_feature (358)..(358): n is a, c, g, or t
  modified_base (371)..(371): a, c, t, g, unknown or other
  misc_feature (371)..(371): n is a, c, g, or t
  modified_base (417)..(417): a, c, t, g, unknown or other
  misc_feature (417)..(417): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccngcagaaagcacgacacgtcccctaagttgctctatttagttgtcatctacgtcgggtgtccgggtcctgaccgattcagcggcngcgatcgtggacngatttcactctcaccatcacgcacgcctgacacggtactaggaagngtgtggcttaagttttattactgtcagtactaatattagtggttactccgtacggtctacgtacgtttcgggacgggtaacggtaccgaaggtggagtaactacgtagcgtaacg

SEQ ID NO: 2432 - DNA, 521 bp, Homo sapiens
  misc_feature: GYAE6OF02G96FX.38.23.C01.1.454.CMB.1.raw
  modified_base (349)..(349): a, c, t, g, unknown or other
  misc_feature (349)..(349): n is a, c, g, or t
  modified_base (484)..(484): a, c, t, g, unknown or other
  misc_feature (484)..(484): n is a, c, g, or t
  modified_base (517)..(517): a, c, t, g, unknown or other
  misc_feature (517)..(517): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccgagggacggggctggagtgggtgccactataaaccncgatggaactgaaaaagctatgtgactctgtgaagggccgattcaccgtctaccagagacaacgccaagaatcatgttattgacaaatgaacagcctagagagtcgaagacgacgccatatatattgtataaagntacattcgatagtggtggcgtacggtacggtgntacg

SEQ ID NO: 2433 - DNA, 544 bp, Homo sapiens
  misc_feature: GYAE6OF02GQFFT.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagcctggggggtccctgaagctctcctgtgcagcctctggattcattatttagtaatcattggatgagttgggtccgccaggctccgagggacgggctggaggtgggtggccactataaaccacgataggaactagaaaaagactatgtaggactctgtgaagggccgatcaccgtctccagagacaacgacaagaacttacattgtatttgactaaatgaacagcctagagagtacgaagacacggcctaatatattattagtagtaaaagatactattacgatagtggtggacggacggtacgggtgtacg

SEQ ID NO: 2434 - DNA, 535 bp, Homo sapiens
  misc_feature: GYAE6OF02IN7K0.38.23.C01.1.454.CMB.1.raw
  modified_base (304)..(304): a, c, t, g, unknown or other
  misc_feature (304)..(304): n is a, c, g, or t
  modified_base (343)..(343): a, c, t, g, unknown or other
  misc_feature (343)..(343): n is a, c, g, or t
  modified_base (495)..(495): a, c, t, g, unknown or other
  misc_feature (495)..(495): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggtttcctgttgctattttagaaggtgtccagtgtgaggtgcagttggtggaatcgtgggggaaacttggtccagcctggggggtccctgaagctctcctgtgcagcctctggattcatatttagtaatcattggatgagttggtccncaggctccgagggcgggctggagtgggtgccatataacncgagtgaactagaaaagctatgtgactctgtgaagggcctattcaccgtctaccgagacgaacaacgccaaagtaacttcactaggttattgactaaatgaacagcctagagacgtcgaagacgacgacaagtatattattagagtaaaagntactattacgagtagtggtagacgacggtacgggtgtacg

SEQ ID NO: 2435 - DNA, 525 bp, Homo sapiens
  misc_feature: GYAE6OF02FXOG7.38.23.C01.1.454.CMB.1.raw
  modified_base (378)..(378): a, c, t, g, unknown or other
  misc_feature (378)..(378): n is a, c, g, or t
  modified_base (482)..(482): a, c, t, g, unknown or other
  misc_feature (482)..(482): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgcaggctccgaggggacggggctggagtgggtggccactataaaccacgatggaactgaaaaagctagtgtgactntgtgaagggccatcacgtctcagacgacaacgcaagaattcactgtatttgctaaatgaacagcctgagagtcgaagacacgcaatatattattagtataaagntacattcgattagtggtagacggtacggtacgggtggactacg

SEQ ID NO: 2436 - DNA, 527 bp, Homo sapiens
  misc_feature: GYAE6OF02F8XJE.38.23.C01.1.454.CMB.1.raw
  modified_base (524)..(524): a, c, t, g, unknown or other
  misc_feature (524)..(524): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccaggggacggggctgggagtggggtggccactataaaccacgatggaactgaaaaagctatgtggactctgtgaagggccgattcaccgtctccagagacaacgccaagaatcactgttatttgactaaatgaacagcctgagagtcgaagacacggccatatattattgtagtaaagatacattcgatagtggtggcgacggtagggtggntag

SEQ ID NO: 2437 - DNA, 652 bp, Homo sapiens
  misc_feature: GYAE6OF02G9VJE.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggtttccttgttgctatttagaaggtgtccagtgtgaggtgcagttggtggaatcgtgggggaaacttggtccagcctggggggtccctgaagctctcctgtgcagcctctggattcatatttagtaatcattggatgagttggccgccaggctcgagggcgggctggagtgggtggccactactaaaccacgatacgggaactaggaaaaagctagtgtggaactcgtagtaggaacgggccgtagttccgaccgtcctaccgaggacgaaccgaacgacccgaaagtaaacttcgaacgttagttaactttcgaactaaagtacgaaacctacgcccgtaggaacggagtaccgaaacggtaaccgaaccgggtacccaaattaacgttaactttagtttaggttaacggtaaaaacgtacttaacctaagtttaccgtaagttaacggttagggttacgggtaccgggtaaccgggttacgggggtggtaccg

SEQ ID NO: 2438 - DNA, 643 bp, Homo sapiens
  misc_feature: GYAE6OF02I5RIH.38.23.C01.1.454.CMB.1.raw
  modified_base (279)..(279): a, c, t, g, unknown or other
  misc_feature (279)..(279): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttccttgttgctatttagaaggtgtccagtgtgaggttcagttggtggaatcgtgggggaaacttggtccagccgtgggggtccctgaagctctcctgtgcagcctctggattcatattaangataatgcatgcacgtggtccgacaagctaccgagggaaggccgtaggacgtgggtctacgaagtgttagtaggaactagtggtaccagtacgctagtgacgactcgtgtaggaacgggccgtattacaacactcctaccgaagacgaacaacgaccaaagacgctaccctagtactctgaacctaaatcgaactacgtctacggagtacccgtggtaacggaacctacgggtacccttttagtaacgttttccgtacggttaacgtaaccggtaaaaaccggggttccccccggttaaggttaccgggtaaccgtaaacggttaaccggtaccgtttaaacgggtaaccgggtttttacccgg

SEQ ID NO: 2439 - DNA, 654 bp, Homo sapiens
  misc_feature: GYAE6OF02I0RVP.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctgggggtccctgaagctctcctgtgcagcctctggattcatatttagtaatcattggatgagttgggtccgccaggctccagggacggggctgggagtgggtggccactataaaccagatggaactagaaaaagactatgtagggactcgtggtagaagggccgtaagttccaccggtcctaccaaggacgacaaaccggacaaacggtaattcacttgttactttgacctaaagttcgaaactacgacccgttagaacgaagttaccggaaacgtaccgaacccggggaaccctaagttaacttaagttttactttaacggttaaggttaaaaaacggtactttaacgtaaacgtttaccggtaattaacgtttggggtacgggtacggtaaccgggttacgggggttacggtaaccgg

SEQ ID NO: 2440 - DNA, 547 bp, Homo sapiens
  misc_feature: GYAE6OF02G1B9E.38.23.C01.1.454.CMB.1.raw
  modified_base (404)..(404): a, c, t, g, unknown or other
  misc_feature (404)..(404): n is a, c, g, or t
tcagtcgatcacgtcacgaccggtgctcgatttagtacacgtgattagggattgggggaggctacaacaggcaggcaggggcagcaagatggtgttgcagacccaggtcttcatttctctggttgctctggatctctggagcctacggggacagtcgtgatgacccagtctccagactcctggactgtgtctctgggcgagaggccacatcaactgccaacgtccagccagtacgtcttttgtcagctccaagaatatgagttcgtagcttggtaccagcaagaagcacgacacgtacccctaagttcgctcatttatggtcatctacgtcggtcgtccgggtcctcgaccgtattcagcggcagcggatcgtgggacagactttcactctcacactcagtacnctcgcagactagaagtatgtggacttagtttattacgtgtactaggactaattagttataggttactccgtcggtctccgtacgttccgggacggtagggacccgtaagggtcggagtacgtacgaacggtcgtaacgtcggg

SEQ ID NO: 2441 - DNA, 580 bp, Homo sapiens
  misc_feature: GYAE6OF02ID21L.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctggaagctctcctgtgcagcctctggattcatatttagtaatcattggatgagttgggtccgcaggcctcgagggcgggctggagtgggtggccactataaaccacgagtggaactagaaaaagactatgtaggactcgtggtaggaagggccgatttcgacccgtctcccgaagacgaaccaaacgaccaaagtaacttcaacttgttaatttgactaaatgaaaccagcctagaagagtacgaagacacggccaattatattagttagtaagtaaaagtatactaattcgaattagtgggtacggccggtaacggttacggggtgtaaccg

SEQ ID NO: 2442 - DNA, 863 bp, Homo sapiens
  misc_feature: GYAE6OF02IRI7D.38.23.C01.1.454.CMB.1.raw
tcagtcgatcacgtcacgaccggtgctcgatttagtacacgtgattagggattggggagggtctcagagaggagccttagccctggactccaaggcctttgcacttggtgatcagcactgagcacagaggactcaccatggattggggctgagctgggtttccttgttgctattttagaaggtgtccagtgtgaggtgcagtggtggaatctgggggaaacttggtccgagccgtggggggtcccctggaagctctcctgtgcagcctctggacttcatatttacgtaatctattgggtatggtaggttgggtcccgccgtaaggtcctaccggaacgggggtaccgggggtctaggggtaacgggttcggggttcgggaccgtaaccgttaaacgtaaaaccccgtacggtaaggttaacggggaaaacccgttaagggtaaaaaaaaccggtcttaaacggttagggtttacgggtaacctttacccggttagggtaacggggtaaaccgggggacccgtaaacgttttacccgaaccccgggttttacccgtcccgtaaacgggtaacggtaaaccccgaaaccgggaacccgaaaacggttaaaccttaccgtaaacccggtttgttttaactttaccgggaacctaaaagtttaccgaaaacgttaccgcccgtttaaagggacggtaaacgttacccgggaaacgggaaaccgttaaccggggacccttaaagttaagtttaaactttacgtttaaggtttaaacggtaaaaggttaactaccgttaagtttaccgtaaccgttaaggttcggggttaacggtaccgggtaaccgggtttacggggtaccggtaacg

SEQ ID NO: 2443 - DNA, 527 bp, Homo sapiens
  misc_feature: GYAE6OF02FS5CZ.38.23.C01.1.454.CMB.1.raw
  modified_base (419)..(419): a, c, t, g, unknown or other
  misc_feature (419)..(419): n is a, c, g, or t
  modified_base (434)..(434): a, c, t, g, unknown or other
  misc_feature (434)..(434): n is a, c, g, or t
  modified_base (439)..(439): a, c, t, g, unknown or other
  misc_feature (439)..(439): n is a, c, g, or t
  modified_base (443)..(443): a, c, t, g, unknown or other
  misc_feature (443)..(443): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttctttgtcagctccaagaatatgagttcgttagtcttggtaccagcagaaagcaacgacagtcccctaagttgctcatttattgtcatctacgtcgggtcgtcccgggtcctcgaccgattcagcggcgagcggatcgtggactagatttcactctcaccatcacgcagcctgcagactgaacgatgnggactagtttacttntcgtnacgntaatattagtggtacgtctcggcttcgtaccgtttcgggacggtacggaaccggagggttggacggtatcgacgtacgtaacgg

SEQ ID NO: 2444 - DNA, 662 bp, Homo sapiens
  misc_feature: GYAE6OF02J2E4R.38.23.C01.1.454.CMB.1.raw
  modified_base (151)..(151): a, c, t, g, unknown or other
  misc_feature (151)..(151): n is a, c, g, or t
  modified_base (453)..(453): a, c, t, g, unknown or other
  misc_feature (453)..(453): n is a, c, g, or t
  modified_base (639)..(639): a, c, t, g, unknown or other
  misc_feature (639)..(639): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacgggganatcgtgactcgacccagtctccagtacctcccgtggctgtcgtcgtcgtgggcgaggacggcccaacatacctaactgaccaacgtccagtccagtacgttcttttcggtcacgtcctaaccgaaagtaattagtggtacgttacgttacggacgtttacggaaccagacgaagtaaacgaccgaacgtaacgtaccgttaccccgttaaggttcgtacttacttacgtttacgtcggtactactcgtacgtcgggtccggtccggtacctgacgtacgtcgagcggcacggtcgtatcggnggtacactacgttcacctcaccacgtctacgacgcgtacgcctagacgtaagtacgttaggactgtacggtatacgttagttacgtacgtacgtactaacggttactaacttagtttcgtacggtaccttccgtcggtaccgttccgtagggttaccgggacggtaacggaacgtaggtcggtaanacgtaccggtacggtacggtacg

SEQ ID NO: 2445 - DNA, 659 bp, Homo sapiens
  misc_feature: GYAE6OF02JD06E.38.23.C01.1.454.CMB.1.raw
  modified_base (368)..(368): a, c, t, g, unknown or other
  misc_feature (368)..(368): n is a, c, g, or t
tcagtcgatcacgtcacgaccggtgctcgatttagtacacgtgattagggattggggagggtcgtcagagaggaggccttagccctggactccaaggcctttgcacttggtgatcagcactgagcacagaggactcaccatggaattggggctgagctgggtttccttgttgctattttagaaggtgtccagtgtgaggtgcagttggtggatctgggggaaacttgggtcagcctggggggtcccgtgaagctcgtctgtgcagcctcgtggattcgacttatttagtaattcaattggatgaggttgggtccgccgaggctccgaggggacgggggctgggagtggggtggccaacgtataaaccnggactagggaactagaaaaagactatgttacggaactctaggtgaagggtcccgattcgaccgttactccgagacgtaacgacgacaacggaattacgaactagttaatttcggaactaaatacggaaactaggaccctagaacggacgttacggaaagtaccgtaacggacctaacttaataacgtttattagtaacggtttaaaaaggactttaacgaaagttttccgaaagttacggttacgggttaacgggacgggtttaaccggtacggggggttaccgggtaacg

SEQ ID NO: 2446 - DNA, 584 bp, Homo sapiens
  misc_feature: GYAE6OF02G6IP6.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgaggacggccaccagtcaactgacaagtccagccagagttctttagtcagctccaagatatgagttcgttagcttggtaccagcagaaagcacggacacgtcccctaagtcgctactatttatggtccatcttacgtcgggtcggttcccggggtcccttcggaccgtacttcgacgcggctaggcggtatcgtggggacctaggtactttcgacttctaccgacatccgaatccgtagccctagctaacggacagtaagtcgtagtcgtactagttttaataacccgtgtacgagtaaccttaagtattagtagtacgttcctcggtactcgtacgtttccgggagtaacggtacgtaagggtggactacgtacgtagtcgtaacgg

SEQ ID NO: 2447 - DNA, 647 bp, Homo sapiens
  misc_feature: GYAE6OF02IVUFY.38.23.C01.1.454.CMB.1.raw
  modified_base (591)..(591): a, c, t, g, unknown or other
  misc_feature (591)..(591): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctggtttccttgtgctatttagaggtgtcagtgtgaggtgcagttggtggaatcgtgggggaacttggccagccgtgggggtccctgagctctctgtgcagcctctggattcattatttaagtatcattggatgtaggttgggtccgcaggctccgaggggacgggcgtgggaggtgggtcggcctaacgtaacgtaaaccaggtataggaaactagaaaaagtactaagtgtacggtactcgtagggtaggaacggggtccgtaacgttaccgtacccgggtactacccgaaggaacgtaaccgaaccggtacccaaaggtaactttaccgaacgttgttaacgtttacgaaccgtaaatacgaaactacggccgtaggtaaggacgtacggaaacgtaacgacggacctaattaagtagtttataggtaataaaaggnttacgaatttacgagtaagttcgggtcggacgtaacggtacggggtcgacttacgg

SEQ ID NO: 2448 - DNA, 548 bp, Homo sapiens
  misc_feature: GYAE6OF02GYZBM.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgccaggctccgagggacggggctggagtgggtggccactataaaccacgatggaactaggaaaaagactaatgtaggactcgtgtggaacgggcgattcaccgtctcagacgacaacgccaagaacttcaacttgtatttgactaaatgaacagcctagagagtacgaagacgacggaccatatattatagtagtaaagtatacagttacgattacgtggtagacgacggttacgggtgtacg

SEQ ID NO: 2449 - DNA, 544 bp, Homo sapiens
  misc_feature: GYAE6OF02GWATW.38.23.C01.1.454.CMB.1.raw
  modified_base (504)..(504): a, c, t, g, unknown or other
  misc_feature (504)..(504): n is a, c, g, or t
  modified_base (539)..(539): a, c, t, g, unknown or other
  misc_feature (539)..(539): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcattatttagtaatcattggatgagttgggccgcaggctccgagggacgggctggagtgggtgccatataaaccagataggaactagaaaaagctatgtaggaactcgtgtaggaacgggccgattcgaccgtctccgagacgacaacgaccaagaactacactagtatttgacaaatgaacagcctagagagtacgaagacgacggccaatatattattagtagtaaagntactattacgatagtggtggacggacggtacgggnggtac

SEQ ID NO: 2450 - DNA, 580 bp, Homo sapiens
  misc_feature: GYAE6OF02ILDK6.38.23.C01.1.454.CMB.1.raw
  modified_base (399)..(399): a, c, t, g, unknown or other
  misc_feature (399)..(399): n is a, c, g, or t
  modified_base (433)..(433): a, c, t, g, unknown or other
  misc_feature (433)..(433): n is a, c, g, or t
  modified_base (453)..(453): a, c, t, g, unknown or other
  misc_feature (453)..(453): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagacctccctggctgtgtctcgtgggcgaggacgggcccacatcaaacgtgacaagtccagccagtagttccttttgtacagtctaccaagtaatagtgtagttcgtagtcttaggtaccagcaagaaacgcacgacacgtcccctaagttcgctctatttagttggtctatctacgtcgggtcggtcccgggtcctgtaccgtattcgacggcgacgtagcgtatcgnggacagtacttcgactctacacctatcgacgacncgtcctgctagactagaagngtgtcggtactagtttatcgtagtctagtactaattagtagttacggtacgtccgtcgtacgtccgtacgtttcgggaccgggtacggtacgtaacgggtggagtaccgtagtaacggagtaaccgg

SEQ ID NO: 2451 - DNA, 545 bp, Homo sapiens
  misc_feature: GYAE6OF02GKJSK.38.23.C01.1.454.CMB.1.raw
  modified_base (411)..(411): a, c, t, g, unknown or other
  misc_feature (411)..(411): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagttcttttgtcagctccaagaatatgagttcgttagcttggtaccagcagaaagcacgacagtcccctaagttgctcatttattggtcatctactcgggtcgtccgggtccctgtaccgattcaggcgcagcgatcgtgggacagatttcactctcaccatcagcagcctgcagctagaagngtgtggactagtttacttacgtcgttcacgtcaaattacgtttaatcggttagtcccgtcggtacttccgtacgtttcgggacggtacggggtacccaaggggttcggaagtactaccgtaagtccggtaacgg

SEQ ID NO: 2452 - DNA, 690 bp, Homo sapiens
  misc_feature: GYAE6OF02GOELP.38.23.C01.1.454.CMB.1.raw
  modified_base (651)..(651): a, c, t, g, unknown or other
  misc_feature (651)..(651): n is a, c, g, or t
  modified_base (684)..(684): a, c, t, g, unknown or other
  misc_feature (684)..(684): n is a, c, g, or t
tcagtcgatcacgtcacgaccggtgctcgatttagtacacgtgattagggattggggagggtctcagagaggagccttagccctggactccaaggcctttgcacttggtgatcagcactgagcacagaggactcaccatggaattggggctgagcgtgggttttcctgttgctatttagaggtgtccagtgtgaggtgcaggttggtggaatcgtagggggtaaacttggtcagccgtggggggtccctggaagctctcctgtgcagcctctggatcgattactttagtaatctacgttggattgtaggttcggggtcccgtccgacggtcctccggaggggggaccggggcgtgggacggtggggtcggccacggtaactaaaccgacggactacgggaacctagaaaaagcttaaagtggtacggacttgtcgggtaaggacggggtacccgtagtttacccgaccgttccgtaccgagtaacgaacgaaaccgaccgtaaaaggtaaccttaccgaaacgtttagtttaccttaagtaacctaaagttacgaaacgcgttacctggaacgtacggttacgaaacgtaccgaccggtataagttacgttaatttagttaggttaagtaaacgattacgtatttaacgtnttaagttgggtacggacgtaacgggttccgggnggtacc

SEQ ID NO: 2453 - DNA, 551 bp, Homo sapiens
  misc_feature: GYAE6OF02HRT8A.38.23.C01.1.454.CMB.1.raw
  modified_base (513)..(513): a, c, t, g, unknown or other
  misc_feature (513)..(513): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttcgggtccgcaggctccgaggggacggggctgggagtgggtggccacgtactaaaccacgatggaactagaaaaagactaatggtaggactcgtgtggaaggggccgattcgaaccgtctaccagacgacaaacgccaaagaactcacttgtatttcataaatgaacagcctagacgagtcgaagacgacggaccatatatattgtagtaaagntacattacgattatgggtgcggacggtacgggtgtacg

SEQ ID NO: 2454 - DNA, 537 bp, Homo sapiens
  misc_feature: GYAE6OF02F8NL7.38.23.C01.1.454.CMB.1.raw
  modified_base (416)..(416): a, c, t, g, unknown or other
  misc_feature (416)..(416): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagagtcttttgtcagctccaagaatatgagttcgttagcttggtaccagcagaaagcacgacagtcccctaagttcgctcatttattggtcatctactgggtgtccgggtccctgaccgattcagcggcagcggatcgtgggacagtactttcactctcaccatcagcagcctgcagactgaagatgtgntagttattactgtacagtactaattattaagtggttacttccgtacggtccttcgtaccgttttccggggacggtacggggaacctaaggggtcgggaagagtaccgaaggacgtaaccgg

SEQ ID NO: 2455 - DNA, 651 bp, Homo sapiens
  misc_feature: GYAE6OF02HUU8L.38.23.C01.1.454.CMB.1.raw
  modified_base (292)..(292): a, c, t, g, unknown or other
  misc_feature (292)..(292): n is a, c, g, or t
  modified_base (591)..(591): a, c, t, g, unknown or other
  misc_feature (591)..(591): n is a, c, g, or t
tcagtcgatcacgtcacgaccggtgctcgatttagtacacgtgattagggattggggaggtacgtccaagagacggagccttagccctcggactccaaggcctttgcacttggtgatcagcactgagcactagaggactcaccatggaattggggctgacgctcgggttttccttgttgctatttagaaggtgtccagtgtgaggtgcagttggtggaatcgtgggggaaacttggtccagcgtgggggtcctgagctctcctgtgcagtcctctgattcatatttagtatntattggatggagttcggtccgcgaggctccgagggcgggtcgtgggagtcgggtacggacctacgtaactaaccgacgagtacggaaacgtaaggaaaacgaacgtagtaggtacggtactcgttaggtacggaacgggccgtaattccgaacccgtctaccgaaggacgaaccgacgaccaagtaacttcaacttggttaacttggaaacctaagtacgaacgtacgtaccgtagaacgtacgtacgaagtacccgacggtacctaagttactagttttactaggttaagaaaacgtnttacccgaagttaccggtaatggttcgggacggttaccggtacgggtttaggggcgtacg

SEQ ID NO: 2456 - DNA, 633 bp, Homo sapiens
  misc_feature: GYAE6OF02JTPKM.38.23.C01.1.454.CMB.1.raw
  modified_base (452)..(452): a, c, t, g, unknown or other
  misc_feature (452)..(452): n is a, c, g, or t
  modified_base (502)..(502): a, c, t, g, unknown or other
  misc_feature (502)..(502): n is a, c, g, or t
  modified_base (514)..(514): a, c, t, g, unknown or other
  misc_feature (514)..(514): n is a, c, g, or t
tcagtcgatcacgtcacgaccggtgctcgatttagtacacgtgattagggagttggggagggtcgtcagagaggaggccttagccctcggacgtccaacggcctttgcacttggtgagtcagcactgagcacagaggactcaccatggaattggggctgagctgggttttccttgttgctatttgaaggtgtccagtgtgaggtgcaggttggtggatgtgggggaaacttggtacagccgtggggggtccctggaacgtctccgtcctgtgcaacggccttctggactttcgattactttagtaactcgtatttgggatacgaggtttcgggccgcgtaggcttccgaggggacggggtctgggaaggtggggtcggacccaacgtagttaaacccgacgagtacggtaacaggaaaaagtcaagtgtcggaatcgaggtgtaaggggccngtacacgtcgtaccaggtacgacgacgaccgtaagaacttcacgttattnttaggactaagngtaccagcctgagtacgtagaactagaacgcgaattacgatttagttacgtaagttaaaggattacctagtttaagactttaggtcgggttaggacggtaaccggttgggtaggtacgg

SEQ ID NO: 2457 - DNA, 542 bp, Homo sapiens
  misc_feature: GYAE6OF02FSJKL.38.23.C01.1.454.CMB.1.raw
  modified_base (328)..(328): a, c, t, g, unknown or other
  misc_feature (328)..(328): n is a, c, g, or t
  modified_base (421)..(421): a, c, t, g, unknown or other
  misc_feature (421)..(421): n is a, c, g, or t
  modified_base (457)..(457): a, c, t, g, unknown or other
  misc_feature (457)..(457): n is a, c, g, or t
  modified_base (497)..(497): a, c, t, g, unknown or other
  misc_feature (497)..(497): n is a, c, g, or t
  modified_base (538)..(538): a, c, t, g, unknown or other
  misc_feature (538)..(538): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagcctggggggtccctgaagctctcctgtgcagcctctggattcatatttagtaatcattggatgagttgggtccgccaggctccgaggggcgggntgggagtgggtgccactataaaccagatggaactagaaaagactatgtaggactcgtgtagaagggccgattcaccgtctccagacgacaacnccgaaagaacttcactgtatttagactaaatgaacngccagagagtgaagacgacgcatatattatgtagtaaagntactaagttacgattagtgggtacggcggaacggtcgggtntacg

SEQ ID NO: 2458 - DNA, 551 bp, Homo sapiens
  misc_feature: GYAE6OF02F5V4I.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtgcagcctctggattcatatttagtaatcattggatgagttgggtccgccaggctccgaggggacgggctgggagtgggtggccactataaaccagatggaactagaaaagactatgtgactctggtgaagggcattcaccgtctcagagacacgaccaagactcattgtatttgactaaatcgaacacgcctagagtagtcgaagaccaacggcctaattattacttattagtagttaaaagatactaattacgtaatagtcgggtggacggtacggttacgggtgtacg

SEQ ID NO: 2459 - DNA, 861 bp, Homo sapiens
  misc_feature: GYAE6OF02GMS5O.38.23.C01.1.454.CMB.1.raw
  modified_base (170)..(170): a, c, t, g, unknown or other
  misc_feature (170)..(170): n is a, c, g, or t
  modified_base (755)..(755): a, c, t, g, unknown or other
  misc_feature (755)..(755): n is a, c, g, or t
tcagtcgatcacgtcacgaccggtgctcgatttagtacacgtgattagggagttgggggagctacaacaggcaggcaggggcagcaagatggtgttgcaggacccaggtcttcatttctctgttgcctctggatctctggagcctacggggacagtcgtgatcgaacccngtctccagtacctccctggcctgtcgtccttactggggcgaacggcgggccaaccctagtccaaaccgttgaccgtaaacggtaccccaaggcccgtaaaggacgttttccgtttttcggttaccgaacggtcccttacccgaaaggtaaatacgttaacggtacggtttaccggtttaacggttccgtttacgggttaacccgtaacggtaccgtaaaggtaaaccggaaccgtaaccggtaaccgtaaaccgttaccccccgttaaaggttccggtacctttaaccgtaatttttaacggttacggttaaccttaacgtccgtttaaccggttccgggtttacggttccccggggttcccttaccggtaccgtacttacgacggtccgggtacacgggtccgggtaacgttccggtacgggacgtacggtaaccgtttcgtaaccgttccgaccgttacccgaacttaccgaacggtaccgtacgtccgtagaccgtaacggacctagggtaaacacggttcggtcggtacgttaacgtttacgttaaccgttgttaacgcgtaacttaacgtagtttaacgngttaacccgtcgttaaccgtcgtttaaccgtacgggttccgggttaaccggaacgggttacgtaacgggttacgggaacggtaactaccggtacgacggttaacgg

SEQ ID NO: 2460 - DNA, 715 bp, Homo sapiens
  misc_feature: GYAE6OF02JYSKI.38.23.C01.1.454.CMB.1.raw
  modified_base (186)..(186): a, c, t, g, unknown or other
  misc_feature (186)..(186): n is a, c, g, or t
  modified_base (290)..(290): a, c, t, g, unknown or other
  misc_feature (290)..(290): n is a, c, g, or t
  modified_base (398)..(398): a, c, t, g, unknown or other
  misc_feature (398)..(398): n is a, c, g, or t
tcagtcgatcacgtcacgaccggtgctcgatttagtacacgtgattagggattgggggaggctacaacaggcaggcaggggcagcaagatggtgttgcagacccaggtcttcatttctctgttgctctggatctctggagcctacggggacatcgtgatgacccagtctccagcctcctggctgtntctctgggcgagacgggccaccataccaactgcaagtccacgccagtagttctttttggtcagtcctaccaagtaatatgtagttcgttagtcgttaggtaccnggcaagaacgcaacgacacgtacccaagttgctactatttagttcggtctataccgtagttccggggtcgttcccggggtaccctggtacctattccggaggtccggnacgggtacggtcttcgggacggggtacctaggttactttacccgaccttactaccgtaaccctgtaccaaggcccgtacggtaccctagggacccttaaggaccgttagaaacggcgtttacggtcggtaaccggttatttttaacttacgttacgtttaacccgacggttattaaagttagttttaacgttaaccgggttcgttaccggtacccggtcgtacccgtttacgggtttaccgggggaacccggttagggggttaacacgggggtttacggacggtttaacgtaaccggtaacggtcccggttaacggg

SEQ ID NO: 2461 - DNA, 591 bp, Homo sapiens
  misc_feature: GYAE6OF02FR3K1.38.23.C01.1.454.CMB.1.raw
  modified_base (439)..(439): a, c, t, g, unknown or other
  misc_feature (439)..(439): n is a, c, g, or t
  modified_base (488)..(488): a, c, t, g, unknown or other
  misc_feature (488)..(488): n is a, c, g, or t
tcagtcgatcacgtcacgaccggtgctcgatttagtacacgtgattagggattgggggagctacaacaggcaggcagggggcagcaagatggtgttgcagacccaggtcttcatttctctgttgctctggatctctggagcctacggggacatcgtgatgacccagtctccagactccctggctgtgtctctgggcgagacgggccaccatcaactgcaagtccagccagtagttcttttgtcacgctccaagaatatagtagttcgttagcttggtaccagcagaaagcacgacacgtcccctaagtcgctactatttattggtcattctacgttcgggtcggttcccgggtcctacggtaccgtacttcgacgcggtacaggcggactcgtagggacagtactttcgtaacctcgtacacctactcacgcacgtccncgacagacctagaagtctggtacggctttaagtttattacgtgttacgngtactaattattagttggtacttaccgtcggtcttacgttacgtttccgggacgggtacggtaaccggtagggtcggaacgtacgtacgtaacgacgtaacgg

SEQ ID NO: 2462 - DNA, 687 bp, Homo sapiens
  misc_feature: GYAE6OF02HZOFI.38.23.C01.1.454.CMB.1.raw
  modified_base (227)..(227): a, c, t, g, unknown or other
  misc_feature (227)..(227): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagaggccacatcaactgacaagtcagccagngttctttgtcagctaccaagatatcgtagttcgttagtcttacggtaccagacaaggaaacgcgaacgacgtacgtacccctaagttcgtctactatttagttggtctatcctacgtcggggtcgtcccgggtccctcggtaccgtagttcgacggcggcgaacggcggtagttccggtaggggtaactaggttactttacccgacttcctaccgaacctactaccgaggtaccacggtccctagaccgtaacggactacggaaagtgtacgggtcggttaacttaaggttttaacttaccgttacgtaccgaacgtacgttaaacgttagtttaccggttagggttaacccggttccgttaccggtaccgttaaccggttccggttttaccggggacggggtaaccgggtaaccggtaaggggtacggtaacgtaacggtacgaacggtcggtaaccgg

SEQ ID NO: 2463 - DNA, 789 bp, Homo sapiens
  misc_feature: GYAE6OF02GKJW7.38.23.C01.1.454.CMB.1.raw
  modified_base (650)..(650): a, c, t, g, unknown or other
  misc_feature (650)..(650): n is a, c, g, or t
  modified_base (782)..(782): a, c, t, g, unknown or other
  misc_feature (782)..(782): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaagttggggctgagtcgttgggtttttccttggttgtcttattttagaggttgtccagtgtgaggtgcgtaggttggtaggagtcggtagggggtaaaccgtttgggtaccacggtccggttcggggggtccctaggaacgtcctctccgtgtcgcacgtcctcgtaggtattcgtatttagttagtaatctagttggtagtggtacggttcgggtcccgccggacggtcccgtaccgggacgggggaccgggtcggtagggtcgggttcgggtacggtaccctaacgttaaaccgtaaacccggtaacgtaacggtaacggtaaaccgtaaaaggtaaaaccgtacgttacggttacggttacggttacgttaccggttagggtaaccgggtaaccgggtccgttaccgttacccgaccccggtttcgaaaccgtaacggaccgtaaacccgaaccgtaacgtaaacggttaccttaacgttcgttaagttacttaagaaacgtaaacncggtaaccgacgtacgtagacggtacgaacggacgaccgtactattaattaagttagttagtaggtaaaacttaagttaccttagttaacgttcggtagtacgtggggtaaccgccgggttagggtacggtntttacgg

SEQ ID NO: 2464 - DNA, 590 bp, Homo sapiens
  misc_feature: GYAE6OF02JHQ4L.38.23.C01.1.454.CMB.1.raw
  modified_base (306)..(306): a, c, t, g, unknown or other
  misc_feature (306)..(306): n is a, c, g, or t
  modified_base (351)..(351): a, c, t, g, unknown or other
  misc_feature (351)..(351): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgagctctcctgtgcagcctctggattcatatttagaatcattggatgaggttgggccncgaggctccgaggggacggggctgggaggtgggtggccacgtaanaaacccgacgaagtggaactaggaaaaaagctagtggtgggaacttcgtaggtaggaacggggcgtattccaccgtctccgaagacgaacaaacgccaaagtaattccacgttagtatttgactaaatgaactagacctagaacgtagtacgaagaccgaacggcctaatattattattagtagtaaagatactagttacgaattagtgggtacggtcggtacggttacggggtgtacg

SEQ ID NO: 2465 - DNA, 557 bp, Homo sapiens
  misc_feature: GYAE6OF02FJX8U.38.23.C01.1.454.CMB.1.raw
  modified_base (451)..(451): a, c, t, g, unknown or other
  misc_feature (451)..(451): n is a, c, g, or t
  modified_base (460)..(460): a, c, t, g, unknown or other
  misc_feature (460)..(460): n is a, c, g, or t
  modified_base (510)..(510): a, c, t, g, unknown or other
  misc_feature (510)..(510): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaacttggtccagccgtggggggtccctgagctctcctgtgcagcctcgtggattcattatttacgtaattcattggatgtagttgggtccgccaggctccgaggggcgggctggaggtgggtgccactataaaccacgatacggaactagaaaaagactagtagcggaactctagtggaagggccgattccaccgtcaccagacgacaacgcaagatcacttgtattcganaatagaacngcctagagagtacggaagacgacgactatatactttatagtagtaaaacntactagttcgagttacgtggtacggacggtaacggtcggtaggtacg

SEQ ID NO: 2466 - DNA, 647 bp, Homo sapiens
  misc_feature: GYAE6OF02I1RZK.38.23.C01.1.454.CMB.1.raw
  modified_base (386)..(386): a, c, t, g, unknown or other
  misc_feature (386)..(386): n is a, c, g, or t
tcagtcgatcacgtcacgaccggtgctcgatttagtacacgtgattagggattgggggtctcagagaggagccttagccctggactccaaggtctttgcacttggtgatcagcactgagcacagaggactcaccatggaattggggctgagctgggttttccttgttgctattttagaaggtgtccagtgtgaggtgcagttggtggaatcgtagggggaaacttggtcccagccgtggggggtccctggaacgctcctcctgtgcagcctctggattcattatttagtaatcattggatgtagtttgggtccgccgaggctccgagggtacggggctgggaggtggggtggccacgtataaaccacgataggaactaggaaaaanactatgtcgggactcgtgtggaagggccgtattcgtaccgtctaccaaggacgacgaacgaccaagtaacttacacgttgttatttagactaaatacgaaaccacgtaccgtagaagtacgtacgaaacggaccgaacggccaacgttaattaatttgtttaggttaagttaaaacggtaacttactaacgtttacgtaagtttaggttagggttacgggtaccggtaaccggggttacgggggttcggtaccgttacggg

SEQ ID NO: 2467 - DNA, 602 bp, Homo sapiens
  misc_feature: GYAE6OF02GDRTF.38.23.C01.1.454.CMB.1.raw
  modified_base (313)..(313): a, c, t, g, unknown or other
  misc_feature (313)..(313): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctcctgtcgcagcctctggattcattatttagtaatctattggatggtagttgggtccnccgaggcctccggaggggacgggctgggaggtgggtgcccaatacgtaaaccacgtagtaggaactaaggaaaaacgtactaagtggtacgacttcgaggtaggaacgggcctattccgaccgtctaccgagacgacaacgaccaaagactcgacttattatttcgaacctaaatcgaaacacgtaccgtagacgtagtacgaacgacgaccgactatattattagttagtaagtaaagtcttaacgtattacgtataggttggtacggcgtacgggttaggtagtacg

SEQ ID NO: 2468 - DNA, 702 bp, Homo sapiens
  misc_feature: GYAE6OF02JHD3S.38.23.C01.1.454.CMB.1.raw
  modified_base (353)..(353): a, c, t, g, unknown or other
  misc_feature (353)..(353): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggtttccttgttgctattttagaaggtgtccagtgtgaggtgcaggttggtggaatcgtgggggaaacttggtccagcctggggggtccctgaagctctcctgtcgcagcctctggattcatatttagtaatctattggatgagttgggtccgcaggctccgaggggcgggctgggagtgggtgccactataaaccncgatggaaactagaaaaagctagtggtagactcgtgtggaaacggggtcctattccgaccgtctaccgagacgtaacaacgaccgtaaaggtaacttaccacgttacgtaattttacgactaaaacgtacgaaaccgtaacggtacccgtaggtaacggtaacgggttaaccgaaaggaaccgaacccggggtaccctaaagtttaacgttaacttttaacgtttacgggttaaacggttaaaaaacggtaacgttaacgttaacgtttaaccgtaacgtttaacggttacggggttaacggggtaccgggtttaaccggggttaaccgggggttacgggttaaccggg

SEQ ID NO: 2469 - DNA, 534 bp, Homo sapiens
  misc_feature: GYAE6OF02GBPKV.38.23.C01.1.454.CMB.1.raw
  modified_base (528)..(528): a, c, t, g, unknown or other
  misc_feature (528)..(528): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgcaggctccgaggggacggggctgggagtgggtggccagtataaaccgagatgggaactgaaaaagctatgtggactctgtgaagggccgattcaccgtctccagagacaacgccaagaattcatgtatttgacaaatgaacagcctagagagtacgaagacgacgccaatatattattagtagtaaaagatacattcgattagtggtggcgacggttagggnggtacg

SEQ ID NO: 2470 - DNA, 579 bp, Homo sapiens
  misc_feature: GYAE6OF02F8F9S.38.23.C01.1.454.CMB.1.raw
  modified_base (305)..(305): a, c, t, g, unknown or other
  misc_feature (305)..(305): n is a, c, g, or t
  modified_base (335)..(335): a, c, t, g, unknown or other
  misc_feature (335)..(335): n is a, c, g, or t
  modified_base (349)..(349): a, c, t, g, unknown or other
  misc_feature (349)..(349): n is a, c, g, or t
  modified_base (454)..(454): a, c, t, g, unknown or other
  misc_feature (454)..(454): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatctgggggaaacttggtccagcctggggggtccctgaagctctcctgtgcagcctctggattcatatttagtaatcattggatgagttgggtccncaggctccgagggacgggctgggagtgggngccactataaaccngatggaactagaaaagctatgtacgactcgtgtaggaacgggccatcgaccgtctaccagagaccaacgccaaagaacttcgacttagttatttagactaaagtnaaacgagccgtagagtagtacggaaacgaccgaacggccaagtattaattacgttagttaagtaaacgtatacgtaattacgtaattacgtagggttacggacggtaacgggtacgggtgtaccg

SEQ ID NO: 2471 - DNA, 659 bp, Homo sapiens
  misc_feature: GYAE6OF02H7EK9.38.23.C01.1.454.CMB.1.raw
  modified_base (312)..(312): a, c, t, g, unknown or other
  misc_feature (312)..(312): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcaggttgggtggaatcgtgggggaaacttggtccagccgtggggggtccctgaagctctcctgtgcacgcctctggtattcattatttagtaatcattggatgtagttgggtccnccgagggtctccgaggggacgggctgggagtggggcgaccactaagtaaaccgacgagtagggaactaggaaaaacgtactaagtggaggtacttcgtaggtacggaacggggcccgtaattccgacccgtctaccgaagaacgactaaacgccaaagtaacttacaacttagttaagtttgtaacaaagttacgaacgaacggtcctagggaaggtacgtacggaaacgaccggacgtcctaaatattaagtttacgttagttaggttaaaaaggtcttaactagtttacgtaacgttaggttggtaccgggtacggtaccgggttacggggtacggactttacgg

SEQ ID NO: 2472 - DNA, 603 bp, Homo sapiens
  misc_feature: GYAE6OF02FYIZP.38.23.C01.1.454.CMB.1.raw
  modified_base (293)..(293): a, c, t, g, unknown or other
  misc_feature (293)..(293): n is a, c, g, or t
  modified_base (490)..(490): a, c, t, g, unknown or other
  misc_feature (490)..(490): n is a, c, g, or t
  modified_base (599)..(599): a, c, t, g, unknown or other
  misc_feature (599)..(599): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctggttttccttgttgctattttagaaggtgtccagtgtgaggtgcagttggtggaatctgggggaaacttggtccagcctggggggtccctgagctctcctgtgcagcctctggattcattatttagtaatctattggntggtaggttggggtcccgccgaggcctccgagggggacggggcgtgggaggtggggtcggccgactaactaaaccacgatcggaaactaggaaaaagacgtatgtaggactcgtgtaggaacgggcgtattcgaccgtctccaagacgacaacgaccaaagtaattccacgttgtactttgaactaaagtacgaaanacgtacctggacgtacgtacgaagaccgtaccggacctaattattattattaggtaagtaaatattacgtaattacgattagtgggtacggtacggacgggttacgggngtcg

SEQ ID NO: 2473 - DNA, 578 bp, Homo sapiens
  misc_feature: GYAE6OF02I4RGP.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggtttttccttgttgctattttaggaaggtgtccagtgtgaggtgcagttggtggaatcgtgggggaaacttggtccagccgtggggggtccctgaacgctctcctgtgcacgcctctggacttcgattatttagtaatcattggatgtagttgggtcccgcgaggctccgagggacgggcgtggagtgggtgaccactactaaaccacgataggaactagaaaagactatggtgactcgtgtaggacggcctattcgacccgtctccgagacgaccgaaacgccgaaagacttaccgattagttatttacgactaatacgaacagtcctaggagaggtacgaagtaccgacggacctaatatatttagtacgtagtaaagtctactatacgattagtggtacggtcgtaggtacggtgctagg

SEQ ID NO: 2474 - DNA, 810 bp, Homo sapiens
  misc_feature: GYAE6OF02JOL4M.38.23.C01.1.454.CMB.1.raw
tcagtcgatcacgtcacgaccggtgctcgatttagtacacgtgattagggagttggggagggtcgtcagagaggagccttagccctggactccaaggcctttgcacttggtgatcagcactgagcacagaggactcaccatggaattgggctgagctgggttttccttgttgctattttagaaggtgtccagtgtgaggtgcagttggtggaatcgtgggggaaacttggtccagccgtggggggtccctagaagcctcgtcctgtgcgagcctcgtggacttcgatactttagtaatcgtaagttggatacggtaggtttcgggtcccgtccgaacggtccgtaccgtaaggggggacccgggggtcttcggggaggttcggggtcggggacccctaacgttaacgtaaaacccgaccggtagttacgggaaactagggaaaaaacgtagtacgtcggtacggtaccgttacgttgggtaggtaacggggtcctaaacgtttcccgaacccggttccgtaccgacggtaaccgaaccgtaaccgaccgtaaacggtaacgttaccgacctttaaggtttaccgtttacgaaaccggtaaaacgttacggaaacccgtaacgttacccgttaaggtaaaccggtaacgggttaacgggaaaccgggtacccgaaacccggggttacaacgttttaaggtaaccttttagttaacgggtaagttaaaaacggtcttaacggtaacttaaccggttaagttaaccggttggggtaccgtaaccgggtaaccgggtttacggggacgggttac

SEQ ID NO: 2475 - DNA, 540 bp, Homo sapiens
  misc_feature: GYAE6OF02GGZVY.38.23.C01.1.454.CMB.1.raw
  modified_base (305)..(305): a, c, t, g, unknown or other
  misc_feature (305)..(305): n is a, c, g, or t
  modified_base (350)..(350): a, c, t, g, unknown or other
  misc_feature (350)..(350): n is a, c, g, or t
  modified_base (408)..(408): a, c, t, g, unknown or other
  misc_feature (408)..(408): n is a, c, g, or t
  modified_base (447)..(447): a, c, t, g, unknown or other
  misc_feature (447)..(447): n is a, c, g, or t
  modified_base (498)..(498): a, c, t, g, unknown or other
  misc_feature (498)..(498): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagaatcattggatgagttgggtccncaggctccgaggggacgggctggagtgggtggccactataaaccncgatggaaactgaaaaagctatgtggactctgtgaagggccattcaccgtctccaganacaacgccaaagaattcactgtatttgacaaatcgaaanagcctagagtagtacgaagacaacggccaagtatattattgtagtaaaagntacaattcgattacgtggtacggcgacggttacgggtgtacg

SEQ ID NO: 2476 - DNA, 743 bp, Homo sapiens
  misc_feature: GYAE6OF02I5P41.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagtccgtggggggtccctgaagtctctcctgtgcagcctctggattcattatttagtaatctatgatgagttgggtccgcgaggcgtccgaggggacgggtcgtgggaggtcggggtgaccaacgtaactaaacccgagagtacggtaaactaggaaaaacgtactagtaggtacggtacttcgtcggtaggaacggggtaccgtagttacccgacccggttacctaccgtaaggaacggacctaaaccggacccgtaaaggtaacgttactaaccgttagtttacgtttacgaacctaaaagtttacgaaccgtaaacggccgttaaggacggtaaaccggttaacggaaacgtaaaccggtaaccggaccttaaagttaacgtttaagtttaagtttaacggtaaagttaaaaaggtaacttaccgttaagtttaaccgttaaagtttacgggttaacggggttaccgggttacccgggtaaccggggtttaccgggggtaggtaacccg

SEQ ID NO: 2477 - DNA, 668 bp, Homo sapiens
  misc_feature: GYAE6OF02F5GZ5.38.23.C01.1.454.CMB.1.raw
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagctgggttttccttgttgctatttagaaggtgtcagtgtgaggtgcagttggtggaatcgtgggggtaaacttgggtccacggccgtggggggtccctggaagctctcctgcgcacgcctcgtggtacttcaaacttacaaaaattagtgggatcgcacgttcgggtcccgccgacggcctccgacggacgaaggggcgtagggtagggtgggtggactaaagtatactacgtatagtgtagtaggttaaagtttaaacgacttagtgacggtacgtcggagacgggtactactccaacctatcccgtacaagacgtaactaactaccgaagacgtacactacctattacgttacataaacgtacgaactaggtccggtagggacgtcggacggaaccgtacggtaccggcttacggtacttacgttacgtacggttacgaaccggtaaaccgtaccccgggtaccctaccggttaacggggttacggggtacggggttacgttacggtaccggg

SEQ ID NO: 2478 - DNA, 494 bp, Homo sapiens
  misc_feature: GYAE6OF02GSQIA.38.23.C01.1.454.CMB.1.raw
  modified_base (103)..(103): a, c, t, g, unknown or other
  misc_feature (103)..(103): n is a, c, g, or t
  modified_base (235)..(235): a, c, t, g, unknown or other
  misc_feature (235)..(235): n is a, c, g, or t
  modified_base (333)..(333): a, c, t, g, unknown or other
  misc_feature (333)..(333): n is a, c, g, or t
  modified_base (413)..(413): a, c, t, g, unknown or other
  misc_feature (413)..(413): n is a, c, g, or t
  modified_base (456)..(456): a, c, t, g, unknown or other
  misc_feature (456)..(456): n is a, c, g, or t
  modified_base (461)..(461): a, c, t, g, unknown or other
  misc_feature (461)..(461): n is a, c, g, or t
  modified_base (464)..(464): a, c, t, g, unknown or other
  misc_feature (464)..(464): n is a, c, g, or t
  modified_base (468)..(494): a, c, t, g, unknown or other
  misc_feature (468)..(494): n is a, c, g, or t
tcagtcgatcacgtcacgaccggtgctcgatttagtacacgtgattagggattgggcacggtgggcatgtggcagttatgtcacatgatggaagaaaaaaatnttacgcagactccctgaagggtcgattcaccatctccagagacaattccaacaacaccctgtatttgcaaaatgaacagcctgagaactgaagacacggctatctattactgtgcgagagatcagtccgganacgaaatgaactacggtgtaaccttccagactactggggccagggaaccctggcaccgtctcctcagcctccaccaagggcccatcggtcttcccccnggccacccgtcctccaagacgccacctcgtgggggcacgagcggccctgggctgcctggtcaaggactactcccacggtnacgtcgtactgacgcggggctcgggacaaggtcgacaagtagngactncgntacnnnnnnnnnnnnnnnnnnnnnnnnnnn

SEQ ID NO: 2479 - DNA, 531 bp, Homo sapiens
  misc_feature: GYAE6OF02JKG0E.38.23.C01.1.454.CMB.1.raw
  modified_base (305)..(305): a, c, t, g, unknown or other
  misc_feature (305)..(305): n is a, c, g, or t
  modified_base (349)..(349): a, c, t, g, unknown or other
  misc_feature (349)..(349): n is a, c, g, or t
  modified_base (435)..(435): a, c, t, g, unknown or other
  misc_feature (435)..(435): n is a, c, g, or t
  modified_base (442)..(442): a, c, t, g, unknown or other
  misc_feature (442)..(442): n is a, c, g, or t
  modified_base (490)..(490): a, c, t, g, unknown or other
  misc_feature (490)..(490): n is a, c, g, or t
tcagtcgatcacgtcacgaccggtgctcgatttagtacacgtgattagggattgggggaggtctcagagaggagccttagccctggactccaaggcctttgcacttggtgatcagcactgagcacagaggactcaccatggaattggggctgagctgggtttccttgttgctatttagaaggtgtccagtgtgaggtgcagttggtggaatctgggggaaacttggtccagccgtggggggtccctgaacgcgtctcctgtgcagcctctggattcatatttagtatcatggatgagttgggccncgaggctccgagggcgggctggagtgggtgccactagtaaaccngatggaactagaaaaagtctagtgtagactcgtagtggaacgggctattccacgtctacagagacacgcaagatcattgtattganaatgaancgtactagagtagacgaagacacgacctatatattatagtagtaaagntactattacgatagtggtagtcggtaacggttgggtgtacg

SEQ ID NO: 2480 - DNA, 792 bp, Homo sapiens
  misc_feature: GYAE6OF02IHGYM.38.23.C01.1.454.CMB.1.raw
  modified_base (198)..(199): a, c, t, g, unknown or other
  misc_feature (198)..(199): n is a, c, g, or t
  modified_base (224)..(224): a, c, t, g, unknown or other
  misc_feature (224)..(224): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttcctgttgctattttagaaggtgtccagtgtgaggtnntagttggagatggtaggtatcgtcncgtcgggtcggggtcctagacgtcctcctcgtgtcgcgacgtccctgtaggttacttactaatttagtttaagtaatcgtttaaggttaggtagttagggttagggttttccgggtccccgaccggtacggtcccgtaccggggaacgggggtccgggtacgggttaggggtacggggttcgggggttaccggacccgtaacgttaaaaccgtaaaccccggacggtaacggtaacggtaaaaccgtaaaaggaaaaccgtacgtagttacgggacgtaacgttcgtagggtaacggaaccggggtccgtaacgttacccgtacccgttccgtaacggtaacgaacgaaaccgtaacccgaaccgtaaacgtaactactacgttacgtttacgttacgtaaactaagtaacgtaacgacgtaccgtaagtaacggtacggtaacgaacgaccgtaacccgacctaagtttaacttagtttacgttaaggttaagtaaagttacttacttacgttacgttaagttaggttacgggtcgggtaaccggtacgggttcgggtacggttacg

SEQ ID NO: 2481 - DNA, 596 bp, Homo sapiens
  misc_feature: GYAE6OF02GF0KH.38.23.C01.1.454.CMB.1.raw
  modified_base (487)..(487): a, c, t, g, unknown or other
  misc_feature (487)..(487): n is a, c, g, or t
  modified_base (547)..(547): a, c, t, g, unknown or other
  misc_feature (547)..(547): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctgaagctctccgtgtgcagcctctggattcattatttagtaatctattggatgtaggttcgggtccgccaggcctccgaggggacgggctgggagtgggtcggccacgtaagtaaaccacgaagtgggaaactagaaaaagacttagtggtaggtactcgtaggtaggaacgggccgtacgttcaacccgttcctaccgagacgacaaccgaccaagtaactacacttagtatttacganaaactagaacagcctaggagagagaacgacgacgactaatacttattagtagtagtaaanatactattacgagtacgtgggtacggacggtaacggtacggggtgtacg

SEQ ID NO: 2482 - DNA, 593 bp, Homo sapiens
  misc_feature: GYAE6OF02JZDE3.38.23.C01.1.454.CMB.1.raw
  modified_base (436)..(436): a, c, t, g, unknown or other
  misc_feature (436)..(436): n is a, c, g, or t
tcagtcgatcacgtcacgaccggtgctcgatttagtacacgtgattagggagttgggggagctacaacaggcaggcaggggcagcaagatggtgttgcagacccaggtcttcatttctctgttgctctggatctctggagcctacggggacatcgtgatgacccagtctccagacctccctggctgtgtctctgggacagagggccaccgatcaactgcaagtccagccagagttcttttgtcagctccaagaatgtagagtttcgttagcttggtaccagctagaaacgtccaacggacacgtaccctaaggttgctactatttagtggtctatctacgtcgggtcgtccgggtcctggacgacttcgagcggcacgcggatcggtacgggactagtactttacactccgtacaccgatccgagtacacgctcgnacgactagacgtatcggtgtactagttacgtaacgtctatagtacttaagtacttagtcgttaacgtcctacggtccttacggtaccgtttcggggacggtaaccgggtaccgtacggggttacgaaggttaccgtaacgtacggggtcctaacggg

SEQ ID NO: 2483 - DNA, 577 bp, Homo sapiens
  misc_feature: GYAE6OF02HAHP1.38.23.C01.1.454.CMB.1.raw
  modified_base (283)..(283): a, c, t, g, unknown or other
  misc_feature (283)..(283): n is a, c, g, or t
  modified_base (362)..(362): a, c, t, g, unknown or other
  misc_feature (362)..(362): n is a, c, g, or t
  modified_base (426)..(426): a, c, t, g, unknown or other
  misc_feature (426)..(426): n is a, c, g, or t
  modified_base (572)..(572): a, c, t, g, unknown or other
  misc_feature (572)..(572): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctggtttccttgttgctatttagagtgtccagtgtgaggtgcagttggtggaatcgtgggggaacttggtccagccgtggggggtccctgaagctctcctgtgcagcctgtggattcattattagtaatntatggatgaggtttgggtccgacgaggctccgaggggggggacggcgtggaggtgggtcggcctaactacgtaaaccgngtagtacggaaactagaaaaacgctaagtgtacgactcgtagtaggacgggtcatcgaccgtcncgaagacgacaacgacaaagtactcgtacttgttattcgaactaaactagaacagtccgtagagtacgtacgaagaccgacgactatacttattatagtaagtaaatctactaagtagattagtgggagtacggtacggttacggngtacg

SEQ ID NO: 2484 - DNA, 655 bp, Homo sapiens
  misc_feature: GYAE6OF02IPZKQ.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtcagtgtgaggtgcagttggtggaatcgtagggggaaacttggtccagccgtggggggtccctggaagctctcctgtgcagcctctggattcattatttagtaatctattggatgtaggtttgggtcccgccgaggcctccggaggggtacggggcgtgggtacggtggggtcgggcctacgttaactaaacccgacggaatacgggtaaactaaggaaaaacgtactaagttggtacggtactcgttaggtaggaacggggtaccgtacgttcctacccgtcctaccgacggtaacgaaccgaacgaccgaaaggtaacttaccactttagttatttacgactaaattagaacgtagcctaggagtagtacgaagaccgacgaccaagttactatttagttagttaagtaaagtctatacttcgtaattaggttgggtacggtcggtaacgggttacgggtgtcgttacgg

SEQ ID NO: 2485 - DNA, 786 bp, Homo sapiens
  misc_feature: GYAE6OF02GBIBJ.38.23.C01.1.454.CMB.1.raw
tcagtcgatcacgtcacgaccggtgctcgatttagtacacgtgattagggattgggggaggtctcagagaggagccttagccctggactccaaggcctttgcacttggtgatcagcactgagcacagaggactcaccatggaagttggggctgagcgtggttttcctgttgctatttagaaggtgtccagtgtgaggtgcagttggtggaatcgtgggggaaacttggtccaggccgtggggggtccctggaagctctcctgtcgtcacgtcctcgtggtacttacatttaagtttaagtaatctattggatggtaggttcgggtccgcacggcctcggaggggacgggtcgtgggaggttgggtcggacctacgtaacgtaaaccacggtagtacggtaaacgtaagaaaaagtactaagtacggtagtactcgtaggtacggaacgggtaccgtacgttaccgtacccgttactaccgaagtaaccgaaccgtaacgaccctaaaggtaacttacgtaacgtttagttactttacgaaaccttaaacgtacgtaaaccgaaccgtccgttaacggtaacggtaacgggtaacggtaaacggaacccggtaaccgggtaacccttaaagttacgtttaaaaggttttacgttaagggtttaaaacggttaaaaaacgttaacgtttaaaccgtaacgttttaacgggtaaacttttaacgggttcggggttaaaccggggttaacccgggtaacgggggtttacggggggttacgttaacccggg

SEQ ID NO: 2486 - DNA, 622 bp, Homo sapiens
  misc_feature: GYAE6OF02ICXYS.38.23.C01.1.454.CMB.1.raw
  modified_base (272)..(272): a, c, t, g, unknown or other
  misc_feature (272)..(272): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggtgctgagctgggttttccttgttgctattttagaaggtgtccagtgtgagtgcagttggtggaatcgtgggggaaacttggtccagccgtggggggtccctgaagctctctgtgcagcctcgtggnttcatatttaagtaatctatggatgaggtttcgggtcctccgaggctccgaggggacggggcttggaggttgggtcgccgaactaagtaaacccaacgagtacggaactaaagaaaaacgtactaagtagtagactcgtcgtagggaacgggtcctaattccgaccgtctacccagacgaaacacggaaccaagtaaactcaacgttatagtttaggactaaagtacgaactacgcgtaagagaacggtaaccgaaggtaaccaccggtacgtaattaactttagtttaattaggtaacgtaaaagatacttagttacagttagttggaggtcgtaccgggtagggtacg

SEQ ID NO: 2487 - DNA, 591 bp, Homo sapiens
  misc_feature: GYAE6OF02F6579.38.23.C01.1.454.CMB.1.raw
  modified_base (307)..(307): a, c, t, g, unknown or other
  misc_feature (307)..(307): n is a, c, g, or t
  modified_base (336)..(336): a, c, t, g, unknown or other
  misc_feature (336)..(336): n is a, c, g, or t
  modified_base (352)..(352): a, c, t, g, unknown or other
  misc_feature (352)..(352): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtgggggtccctgaagctctcctgtgcagcctctggattcgatatttagaatcattggatgagttgggtccncaggcctcgagggacgggctggagtgggnggccactataaaccgngatggaactagaaaagactatgaggactctgtgaagggccattcaccgtctccagacacgaacgaccaaagacttacacttagttatttagactaaagtcgaacaacgtcctagagtagtacggaaagaccacggtaccaattactaatttacgttaggtaagtaaaacggtattacgtaagtttacgtaagttaggttagggtcgggtaacggtacggttaccgggggttgtaaccgg

SEQ ID NO: 2488 - DNA, 614 bp, Homo sapiens
  misc_feature: GYAE6OF02H5G39.38.23.C01.1.454.CMB.1.raw
  modified_base (282)..(282): a, c, t, g, unknown or other
  misc_feature (282)..(282): n is a, c, g, or t
  modified_base (333)..(333): a, c, t, g, unknown or other
  misc_feature (333)..(333): n is a, c, g, or t
  modified_base (394)..(394): a, c, t, g, unknown or other
  misc_feature (394)..(394): n is a, c, g, or t
  modified_base (497)..(497): a, c, t, g, unknown or other
  misc_feature (497)..(497): n is a, c, g, or t
  modified_base (509)..(509): a, c, t, g, unknown or other
  misc_feature (509)..(509): n is a, c, g, or t
  modified_base (517)..(517): a, c, t, g, unknown or other
  misc_feature (517)..(517): n is a, c, g, or t
  modified_base (560)..(560): a, c, t, g, unknown or other
  misc_feature (560)..(560): n is a, c, g, or t
tcagtcgatcacgtcacgaccggtgctcgatttagtacacgtgattagggattggggggtctcagagaggagccttagccctggactccaaggcctttgcacttggtgatcagcactgagcacagaggactcgaccatggaattggggctgagctgggttttccttgttgctattttagaaggtgtccagtgtgaggtgctaggttggtggaatcgtagggggaaacttggtccacggtccgtggggggtccctggaacgcctcgtacctgtgcgacgcctntggtacttcacttatttagtaatctagttggagtcggtacgttcgggtccncgtaggtcctccggaggggacggcgtagggaggtcggggtcgaccgacgtaactaaaccgngtagtacggaactaagaaaagctaagtggtacgactcgtgtacggaacggccgtattaccgacgtcctacgagacgaccaacgcaagtactcattgtactttnactaatagacancgtagagngtacgaagaccgacgtaccattatagttatagttaagtaaagntacgtagtacgtaagtgttcggtacgtaccggtacggtacgggtcgacttacgg

SEQ ID NO: 2489 - DNA, 548 bp, Homo sapiens
  misc_feature: GYAE6OF02IOSO1.38.23.C01.1.454.CMB.1.raw
  modified_base (307)..(307): a, c, t, g, unknown or other
  misc_feature (307)..(307): n is a, c, g, or t
  modified_base (323)..(323): a, c, t, g, unknown or other
  misc_feature (323)..(323): n is a, c, g, or t
  modified_base (373)..(373): a, c, t, g, unknown or other
  misc_feature (373)..(373): n is a, c, g, or t
  modified_base (379)..(379): a, c, t, g, unknown or other
  misc_feature (379)..(379): n is a, c, g, or t
  modified_base (510)..(510): a, c, t, g, unknown or other
  misc_feature (510)..(510): n is a, c, g, or t
tcagtcgatcacgtcacgaccggtgctcgatttagtacacgtgattagggattggggaggtctcagagaggagccttagccctggactccaatgcctttgcacttggtgatcagcactgagcacagaggactcaccatggaattgggctgagctggttttccttgttgctatttagaaggtgtccagtgtgaggtgctagttggtggaatcgtgggggtaacttggtccagccgtgggggtccctgagctctcctgtgcagcctctggattcattatttagtaatctattgatgagttggtccgccnggctccgagggcgggntggagtgggtgccactacaaccagatacggaactaagaaaagatagtagngtactntggtaggacggccgtattccgacctccgtaccagacaccgaacgacaagtactcaacttgttattcgactaagtagacaagtctagacgagtacgaagacaccggacatatattagttagtaagtaaacgntaactattagtatagtcggtagacgtacggtggtacgg

SEQ ID NO: 2490 - DNA, 534 bp, Homo sapiens
  misc_feature: GYAE6OF02FN0K8.38.23.C01.1.454.CMB.1.raw
  modified_base (428)..(428): a, c, t, g, unknown or other
  misc_feature (428)..(428): n is a, c, g, or t
  modified_base (433)..(433): a, c, t, g, unknown or other
  misc_feature (433)..(433): n is a, c, g, or t
  modified_base (435)..(435): a, c, t, g, unknown or other
  misc_feature (435)..(435): n is a, c, g, or t
  modified_base (491)..(491): a, c, t, g, unknown or other
  misc_feature (491)..(491): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagcctggggggtccctgaagctctcctgtgcagcctctggattcatatttagtaatcattggatgagttgggtccgcaggctccgagggacgggctgggagtgggtggccatactaaaccacgataggaactagaaaaagctaagtgtagactctagtgaaggccgatcacgtctcagagacaacgcaagaatcactntattnanaatgaacagccgtagacgagtacgaagacgacgaccaatatattactgtagtaaanctatacgttacgatagtgggtcgacgtacggtacgggtgtacg

SEQ ID NO: 2491 - DNA, 824 bp, Homo sapiens
  misc_feature: GYAE6OF02G2QDE.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgtcttattttagaaggtgtccagtgtgaggtgctagttggtggaatcgtagggggaaacttggtccaggtccgtggggggtccctgaacgctctcctgtgcagcctctggtattcattatttagtaatctagttggatggtaggttcgggtccgccgacggtccgtaccgggacgggggaccggggtcggtaggggacgggttcgggggtcgaccgtaaccgtaaacgtaaaacccggaacggtaacgtaacgggtaaaaccgtaaaggtaaaaaaccggtactttaaggtagggtaacgggttacgtttaccgttagggtaacggggaaaccggggtacccgttaacgtttacccggtaacccggtttaccgtaaccccggtaaaggaaacccgaaacccgtaaaacccggtaaccgtaaaacggtaaacttacccggtacgtttagtttaaccgtttaacgaaacgttaaaagtacgtaaccgtacgtaccgttaaggaaacgttcgggtaaaccgtaaacgaccgtaacccggcttaaagttactaacgttttaagtaggttaaacgtaaaacgttactaccgttaagtttacgagtttaaggttcgggtaacggtaccgggtaaggggttaccggggttaggtacttaacggg

SEQ ID NO: 2492 - DNA, 818 bp, Homo sapiens
  misc_feature: GYAE6OF02GC6OR.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaagttggggctgagcgttgggtttttccttgttgcttattttagaaggtgtccagtgtgaggtgctaggttggtggaatcgtagggggtaaacgttcggtccgacggtccggttcggggggttcccctaggaacggtccttccgttccgtggtcgaccgtacgcccttcgtaggtactttacctaatttaattttaagttaattctaagttggtatggtacggtttcgggtcccgccgtacggccgttacccggagggggaccggggtcgtaggggaggttcggggtcggacccgtaacgtaacgtaaacccgaacggtagtaacgggaaacgtaaagaaaaaagttacgtagttaggtggtactacgtaggtaggtaggtcgggtaccgtacgtttacccgtaccgttccgtaccgaacggacgaaccgaaaccgaaccgtaaacggtaacttacgtaacgttaggtttaacgtttacgaaaccgtaagtaacgaaaccgtacggtaccgtacggtaagggtaacgttaaccggaacggaaaccggtaccggtaactaaagttaactttaagtttaacgttaggttaaacggttaaaacgtacttaacgttacgttaacgtaagttaaggtttccgggtagggtaacccggggtaacgggttaccgggtcggttaacgg

SEQ ID NO: 2493 - DNA, 633 bp, Homo sapiens
  misc_feature: GYAE6OF02FMYEZ.38.23.C01.1.454.CMB.1.raw
  modified_base (308)..(308): a, c, t, g, unknown or other
  misc_feature (308)..(308): n is a, c, g, or t
  modified_base (340)..(340): a, c, t, g, unknown or other
  misc_feature (340)..(340): n is a, c, g, or t
  modified_base (483)..(483): a, c, t, g, unknown or other
  misc_feature (483)..(483): n is a, c, g, or t
  modified_base (492)..(492): a, c, t, g, unknown or other
  misc_feature (492)..(492): n is a, c, g, or t
  modified_base (508)..(508): a, c, t, g, unknown or other
  misc_feature (508)..(508): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacatcgtgatgacccagtctccagactccctggctgtgtctcgtgggcgagacgggccaccatcaactgacaagtccagccgagtagttcttttgtacacgtctaccgaaagaattaattgtagttcgtttagcgttcggaccagcaagaagcacgacncgtaccctaagttcgactctatttcgttgtcnttactacgtcggtcgtccgggtcctcgaccgtattcgacgccggtacaggccggtagttccggtagggtaaccacggttaactttcaccgttcttaccaaccgtagtaccaggcctacgccgtcgtaccagacgtaggaagtntaggtcgtnttaagttacttacgtntaccgtagacttaaattacttagttacgggttacttccgttcggtaccttaaccgttccggtttacggggacgggttacgggaacggtaacggttgggtaacgtacgtacgtaccggctaacggg

SEQ ID NO: 2494 - DNA, 662 bp, Homo sapiens
  misc_feature: GYAE6OF02I95TZ.38.23.C01.1.454.CMB.1.raw
  modified_base (252)..(252): a, c, t, g, unknown or other
  misc_feature (252)..(252): n is a, c, g, or t
  modified_base (298)..(298): a, c, t, g, unknown or other
  misc_feature (298)..(298): n is a, c, g, or t
  modified_base (404)..(404): a, c, t, g, unknown or other
  misc_feature (404)..(404): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaagtgtccagtgtgagtgcagttggtggaatcgtggggaaacttggccagcgtgggggtccctgagctctcctgngcagcctctgattcattattacgtatcattggatgtagttgggccncgaggtcctccgtaggggacgggctgggaggtgggtcggacctaacgtaactaaaaccgacggtatacgggaaactaaggaaaactacttagtacgtggacttcgnggtacggaacgggtccgaacttccgaaccgtacgtacccgaaagaacgacccgtaaatcccgaaaaggtaacttccgtaacgttagtttaacttacggaactaaagtcgaaaacctcgtccgtaggaacgtacggtaacgaaggaccaacggcctagttaactacgtttagtagtaaacgtaaagtcttaagatttaaccgaagttaggtacgggtttacggaccggttaacgggttacgggggtactcgtttaacgg

SEQ ID NO: 2495 - DNA, 779 bp, Homo sapiens
  misc_feature: GYAE6OF02HJ712.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaagttggggctgagcttgggttttccttgttgcttatttagaggtgtcagtgtgaggtgctaggttggtggaatcgtagggggtaacttggtaccaggccgtggggggtccctagaacgtcttcgtccgtgtcgcacgtcctcgtggtattacattagtttaagtaatcgtagtttggattggtaggttcgggccgtccgtaggtccgtaccggcggggacggggctagggtacgggtgggtcggtacctacgtaaacgtaaaccgacggtaacgtaggtaaaactaaggtaaaaaaggtacgttagtgggtacggtacccttggtagggtaacgggaccgggtacccttaagttacccgtacccgttccgtaacccgaaggtaaccgaacccgaaaccggtaaccgaaacgttaacttcgtaaccgttagttaacgtttcgaaactaaacgttacggaactacggtaccgtaaggtaagtaacggtaacgaacggtaaccgaaccgggtacctaaagtttactttaagttttacgttaaggtttaagttaaaaccggttataaccgttaacgtttaacggtaagtttaggttacggggtacggtaaccgggtaccggggttacggggtacggtaaccg

SEQ ID NO: 2496 - DNA, 672 bp, Homo sapiens
  misc_feature: GYAE6OF02GRKHF.38.23.C01.1.454.CMB.1.raw
  modified_base (335)..(335): a, c, t, g, unknown or other
  misc_feature (335)..(335): n is a, c, g, or t
  modified_base (359)..(359): a, c, t, g, unknown or other
  misc_feature (359)..(359): n is a, c, g, or t
  modified_base (397)..(397): a, c, t, g, unknown or other
  misc_feature (397)..(397): n is a, c, g, or t
tcagtcgatcacgtcacgaccggtgctcgatttagtacacgtgattagggattgggggaggtctcagagaggagccttagccctggactccaaggccctttgcacttggtgatcagcactgagcacagaggactcaccatggaattggggctgagctgggttttccttgttgctattttagaaggtgtccagtgtgaggtgcagttggtggaatcgtgggggaaacttggtccaggccgtgggggtccctgagctctcctgtgcagcctctggattcatttattagtaatctattggattgtagttcgggtccgcaggcctccgaggggacgggngtgggaggtgggtggaccactaanaaccagacgtagaaacgtagaaaagtactagtgtacgntcgtgtaggacgggccgtatcgtacccgtctccgagaacgaccgaaaccgaccaaagtaacttccgtaacttagtttattaacggactaaagtacgaacacgaccgtagtaaggacttacggaaacggaccgaaccgggtactaaagttaagtttagtttaacttagggtttaaaaccgtaaaagggtacctttaaacgttacgttaacggtttaacttaagggtttacgggtcgggtaacccggggttaacggggttaggggtccggtaaacgg

SEQ ID NO: 2497 - DNA, 625 bp, Homo sapiens
  misc_feature: GYAE6OF02F9WVO.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttcctgttgctattttagaaggtgtccagtgtgaggtgcagttggtggaatcgtgggggaaacttggtccagccgtgggggtccctgaagctctcctgtgcagcctcgtggattcattatttagtaatcattggatgagttcgggtccgcgaggcctccggaggggacggggcgtgggaggttgggtcggccctaactaacgtaaacccgacggtacgtagggaaactaagaaaaaagtctaagtgtacggaactcgtaggtaggaacgggcgtattaccgacccgtctaccgagaacgtaacaaccgaccaaagtaacttacgaacgttagttatttagactaaagtacgaacacgtcctagacgaagtacgaacgacgaccgactaagtattaattagttagtaagtaaaagtatactaacgttacgagttagtggtacggacggtacggttacgggtgtacg

SEQ ID NO: 2498 - DNA, 696 bp, Homo sapiens
  misc_feature: GYAE6OF02HSV8Q.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcaggttggtggaatcgtgggggtaaacttggtccaggccgtcggggggtccctaggaagctctcctgtgcacgcctcgtggtattcgattattagtaatctagttggatgtaggttcgggtccgaccgacggtccgtaccggagggggaccggggcgtgggtagggtcgggtacggaccctaacgtaactaaaccgaacgtagtacggtaaacgtaacggtaaaaacgtacgtaagtacggtcggtaacttcgtacggtaggtaacgggaccgtacttcccgacccgtctaccgagaaccgaacgaaaccgaccgaaagtaactacctagttagttacgttacgaactaaagtcgaacgacgtaccgtagacgtagtaaccggaacgaccgaacggactaagttaactaagtttacgttaggtaaagtaaaggtcttaacgtacgttacgaagttcgtagggtacgggtaccggtaacgggttacgggacgttacgg

SEQ ID NO: 2499 - DNA, 736 bp, Homo sapiens
  misc_feature: GYAE6OF02JHML2.38.23.C01.1.454.CMB.1.raw
  modified_base (154)..(154): a, c, t, g, unknown or other
  misc_feature (154)..(154): n is a, c, g, or t
tcagtcgatcacgtcacgaccggtgctcgatttagtacacgtgattagggagttggggaggtcgtcagagaggagccttagccctggactccaaggccttgcacttggtgatcagcactgagcacagaggactcaccatggaattgggctgagntggtttcctgttgcttatttagaagtgtccagtcgtgaggtgcgtagttggtgaatcgtaggggtaaacttggtccagccgtgggggtccctgaacgcgtactccgtgtgcgagtccgtgtaggtattaccgtataagtttagtaactacgtaagttggaacgttagtaacggtttcggggtaccctaccgtaggtccgtacccgagggggtaaccgggtccgttagggacgggttggggccggtacccgtaacgttaacgtaaacccgaggtaacgtaacgggaacttaacggaaaaaacgtcgtaaagttacgggtagtaaccgtcgtaggtaacggaaccggggtccgtaacgtttaccgaaccccgtttacgtacccgtaaacgacggaaaccgttaaccgaacgtaaaccggtaagttaccacgttacgttaagttacgtaataaacgtaagaacctcgctacgtacgaaggtccgaaacgtccgaacgtacgtaactagtagttacgttcgtaacgtaaaagtccctagtcgtacgtaatacggttaggaaccgcggttaaccggtagttcggtac

SEQ ID NO: 2500 - DNA, 1014 bp, Homo sapiens
  misc_feature: GYAE6OF02ICJZM.38.23.C01.1.454.CMB.1.raw
  modified_base (198)..(198): a, c, t, g, unknown or other
  misc_feature (198)..(198): n is a, c, g, or t
  modified_base (207)..(207): a, c, t, g, unknown or other
  misc_feature (207)..(207): n is a, c, g, or t
  modified_base (210)..(210): a, c, t, g, unknown or other
  misc_feature (210)..(210): n is a, c, g, or t
tcagtcgatcacgtcacgaccggtgctcgattttagtacacgtgattagggattggggggtctcagaggaggaggccttacgccctcggactccaaggtccctttggctaccttggttggatcagcactgagacacagaggactcaccatggaagttgggctgagcttgggttttccttgttgcttattttaggagtntcagtgtgnggngcgtagtttgggtaggaacgtcggttagggggtaaacgtttgggtccgtacggccgggttcgggggggttccccgttagaacggtccgttaccttccccgttggttcggcgtaaccggtcccttccggttgggtaacgttttcctaagttttaaagtttttaaggttaactttacgtttaacgtttaggttaacgtttacggttaacggggttttcccgggggttaccccgtaacccgggaccgggggttacccggttaccggggtaacggggggtaccggggggttacgggttcgggggtacgggtttacgggggttacggttacccgtaacgttaaaccggtaaaacccgtaaggtaacgttacggtaaaacgttaacgggaaaaacgttaaccttaggttacggtaacgggtacctttacggttacggttagggtaaacggggtacccgtttacgtttacccgtacccgttaccctaccgtaaccggtaacgaacccggtaaacgacccgtaaaacgtaacgtttacccgtaacgtttacgtttaacgtttacgtaacgtaaacgttaacgtaaacctaccgggtaaccgttaacgggtaacgttaccgggtaaacgtaaacggtaaccggttaacccgaaccgttaaacgttaacgttttaacgtttaacgttaagttttaaacggtttaaaacgtcgtttaaacctttaaggttaacgttaaaggttaggtttaacgggtacgggtttaacccgggttaacggggtttaaccggggttacgggttaccgttttaacggg

SEQ ID NO: 2501 - DNA, 689 bp, Homo sapiens
  misc_feature: GYAE6OF02HPQY7.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctatttagaaggtgtccagtgtgaggtgcagttggtggaatcgtggggaaacttggtccgagccgtgggggtccctgaagctctcctgtgcacgcctcgtggtattcaattatttaagtaatctagttggatgtaggttcgggtccgccgtacggcgtaccggagggggcgggcgtaggggagggtcggggtacggacccgtaaccgtaacgtaaaccgacgtagtacggtaaacgtaagaaaaacgtacttagtacggtacggacttacgtcggtaggtaacgggccgtaacgtttcccgacccgtctacgaagacgaaccgtaacgaccgtaaagtacttccattagttaattcgtaacaaatacgtaacacgtccgtagaggtacgtaacggaacgtaccgacgtactaacttaagttatttacgttaggttaaaggtaaaacgtcttataaccgttacgttaagttcggttagggaccgggtaaccggtttacggggtacccggggtgtaaccgg

SEQ ID NO: 2502 - DNA, 726 bp, Homo sapiens
  misc_feature: GYAE6OF02FI0VL.38.23.C01.1.454.CMB.1.raw
  modified_base (666)..(666): a, c, t, g, unknown or other
  misc_feature (666)..(666): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagagactcaccatggaattggggctgagcttggtttccttgttgcttatttagaaggtgtccagtgtgaggtgcagttggtggaatcgtggggaacttggtccagccgtgggggtccctgagctctcctgtcgcacgcctctggtacttcacttaagttacgtaactctagttggataggtagtttcgggtccgcgacggtctccgaggggtaccgggtctgggaggttcgggtcggtaccccaacgtaaccgtaaaacccgacggtagttaacgggtaaacctaaaggaaaaacgttaccgtagttacggtacgtaaccttcggtacggttacgggaacgggtacccgtacgtttaaccccgaccgttacccgtaccgaacgaacggaaccctaaacccggtaacccgaaacgttaaccttaccgacgtttacgttacgtttacgaacctaaacgtacgaaccgaacggtcgttacgaaggtaacgttacgaacgaccgaaccgtactaattacgtaattacgttagtaacgttaaaacgntacctaagttaccgaagttacgtgggttaccgggcggtaacggttacgggttgtaacccg

SEQ ID NO: 2503 - DNA, 611 bp, Homo sapiens
  misc_feature: GYAE6OF02FK5WJ.38.23.C01.1.454.CMB.1.raw
  modified_base (229)..(229): a, c, t, g, unknown or other
  misc_feature (229)..(229): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctctgggcgagagggccaccatcaactgcaagtccagccagngtcttttgtcagtctccaagaatatgagttcgttagcttggtaccagtcagtaaagcacgacacgtcccctaagttcgctctatttagtggtacatctacgtcgggtcggtcccgggtcctcggaccgtattccgagccggacaggacgactcgtgggacagactttcacttctaccacctactcaacgcacgtccgtcgtacacgtactaggaagtcgtaggtacggacgttaagttttacttaactcgttaacagttacctaaagtttagttacgttagggttacgttacccgtcggtaccgttcgtaaccgtttcgggggccggtaacgggacccgttaaggggtcggtaaacgtacggtaacgaacggtccgtaacgg

SEQ ID NO: 2504 - DNA, 702 bp, Homo sapiens
  misc_feature: GYAE6OF02GBAR1.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatctgggggaaacttggtccagccgtggggggtccctgaagctctcctgtgcagcctctggattcatattttagtaatctattggatgaggttgggtccgccgaggctccgagggacggggcgtggaggtggggtggccactaactaaaaccgacgagtggaaacctaagaaaaagactaagtcgtaggtactcgtggtaggaacgggccgtaagttccgacccgtcgtaccaagaacgaaccgaacgaccaaagtaacttaccacttacgttaagtttacgactaaaagtacgaaacgacgtaccgtagaagacggtaaccgaaacggtaaccgaacgggtaaccctaaacgttaacgttaagtttaacgtttaggttaaaggttaaaaacggtaacttaaccgttaaacgttaaccgttaagttaacgtttacggggtacgggtaacccgggtaacggggtttaacccgggggttgggtaccggtttaacgg

SEQ ID NO: 2505 - DNA, 706 bp, Homo sapiens
  misc_feature: GYAE6OF02GHZPV.38.23.C01.1.454.CMB.1.raw
tcagtcgatcacgtcacgaccggtgctcgatttagtacacgtgattagggattgggggagctacaacaggcaggcagggcagcaagatggtgttgcagacccaggtcttcatttctctgttgctctggatctctgagccgtacgggacatcgtgatgacccagtctccagactccctggctgtgtctctaggcgagaggccacatcaacgtgacaagtccagccagtagttcttttcgtcagtcctaccgaagaattaatgtagttaccgtttagctttaggtaccctagacctaagaacgacaaccgtacgacgttccccctaagttcgacttacttactttagttggtactattactacgttcggggtcgttcccgggtccctaggtaccgtattaccgaggcggacgtaggccgtaagtcgtacgggtaccaggtactttaccaaccttccgtaaccaccgtaatccgaagcctaacggtcctcgaccgaacggtacgttaacgaacgtacgtaggtttaccgggaactttaacggttttaactttaccggtacgttaaccgtacgtaccgttaatttagtttaacggttaaccgttacggttcccttacggttaccgttaccgttaaccggtttcgggtaaccgggtaccggtaacgtaaccgggttagaccggtaacgttcgaaacggtcgttaaaccggg

SEQ ID NO: 2506 - DNA, 773 bp, Homo sapiens
  misc_feature: GYAE6OF02IC3MX.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagcctacggggacatcgtgatgacccagtctccagactccctggctgtgtctcgtgggcgagacgggccacatcaacgtgacagtccagccagtacgttcttttgtcagtctaccaaagtaacttagtggtaagtttcgtaacgtcgtttacggtaaccagacgaaaggtaaagccgaaccggtaactaaccggttacccccgttaaaggttcgtaccttacgttaagtttttaacgttcggtacctaacgttccgttaaccggttcggggttccgggttaccccggggttccccgtaggtaacccggtacttaccgaacggtccggacgtacgggaccggtacttcgggtacgggaactaacggttacttttacaccgttacctaaccaacctaactacgtaacggccgtaacgccgttagaaccgtaaggaaccgtaggaaacgtcgtaggtacggttacgtttaacggttttacttacgtagtaaccgtaagtaaaccttaaagttacgtttaaggttacggttaccgttcccgttacggtccttaaccggttaccggtttaccggggaccgggtaaacgggtaacggttaagggtacggtaacggtaacgtacgtaaccggtcggtaaccgg

SEQ ID NO: 2507 - DNA, 789 bp, Homo sapiens
  misc_feature: GYAE6OF02FYOYX.38.23.C01.1.454.CMB.1.raw
  modified_base (783)..(783): a, c, t, g, unknown or other
  misc_feature (783)..(783): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggattgggctgagcttgggttttccttgttgtcttattttagaaggtgtccagtgtgaggtgcgtaggttggtggaattcggtagggggtaaactttggtccaggtccggttcggggggtccctggacggtaccttccgttcccgttggtcgccgtacggtcccttccgttagggtactttcccgtaacccgttttcgtaggttcggttacttttaggacttacgttacgtaaccggttcgggggttacccccgtaccggtacgggtccccgtacccgggtaagggggggtaaacgggggtcccgtagggggtacggggtttaccggggttacccttacgtacgttacccgttaagttttaaggttaacggttaagtttaacggttaaccggtactaaaccttaagttaacctaaccgttaaccggacgtaacgaaccgtttacgaacgggttacgggaaccgggggtaccctaacgtttacccgaaaccttacttcccgtaaccgaaggaccctaaccgaaaccgaccgaaaagcccttacgtaacgttgtactcggaatacaaagtcgaaactcgctaaggacgaccggcgagcctacgctggtacttagttcgagtcgaggacgaacttcctaagtgttacngttaac

SEQ ID NO: 2508 - DNA, 758 bp, Homo sapiens
  misc_feature: GYAE6OF02JN505.38.23.C01.1.454.CMB.1.raw
  modified_base (248)..(248): a, c, t, g, unknown or other
  misc_feature (248)..(248): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgttgggttttccttgttgacttattttagaaggtgtccagtgtgaggtgctagttggtgtaatcgtaggggaacttggcagccgtgggggcctganctctcctgtgcagtcctctggattcaattatttagtaatctattggaatgtaggttacggtccgccgtaggtccttaccggaggggtaccggggtcgtagggacggttggggtcgtccaaccttaacgtaaaaccgtacggtaacgtaggggaaaaccttaaggggaaaaaactaccgttaagtacgggttacggtacccttagttacggtacggggaaacgggtcccgttaacgtttcccgaaacccgggttccttacccggaaggtaaacggaacccgtaaccgtaacccgtaaaaggtaacctttaccgaacgtttggttaatttacgaaacgttaaagtaacgaacctacggtcccgtaacggtaagtaccgtaacgaaacggaccgtaccgggaacttaacgtaatttaacgtttatttaggtaaacgtaagtaacccttggttaaactttcgaaagttacggtacgggttaggacccggttaagggtaaccgggtggacttagg

SEQ ID NO: 2509 - DNA, 684 bp, Homo sapiens
  misc_feature: GYAE6OF02F08PQ.38.23.C01.1.454.CMB.1.raw
  modified_base (197)..(197): a, c, t, g, unknown or other
  misc_feature (197)..(197): n is a, c, g, or t
  modified_base (265)..(265): a, c, t, g, unknown or other
  misc_feature (265)..(265): n is a, c, g, or t
  modified_base (346)..(346): a, c, t, g, unknown or other
  misc_feature (346)..(346): n is a, c, g, or t
tcagtcgatcacgtcacgaccggtgctcgatttagtacacgtgattagggattggggaggtctcagagaggagccttagccctggactccaaggcctttgcactggtgatcagcactgagcacagaggactcaccatgaattggggctgagctgggttttccttgttgctattttagaaggtgtccagtgtgaggtncagttggtggaatcgtgggggaaacttggtccagccgtgggggtcctgaagctctcctgtgcagctcnggattcagtatttagtaatctattggatgaggttaggtccgccaggcttccgagggacgggctggaggtgggtggccatanaaaccacgagtcggaaacttgaaaaaacgtgtaactaggtacggtaactctacgggtagaaaggggtcctagtttaccgaaccgttctaccgagaacgaaccgtaaacgaccccaaagtaattcccgtaacttcggtttattaggaaccctaaaagttacgaaacctcggtaacccttaggaaacggtacgtaacggtaaacggaaaccgaccgggtaacccttaaggtaatttaagttaccgtttagtaagtttaaaaacggactttaacggacttttaaccggaattacgttacgggtaccgggtacctaacggggtttacggtacccgggttaag

SEQ ID NO: 2510 - DNA, 820 bp, Homo sapiens
  misc_feature: GYAE6OF02JR1FA.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaagttggggctggagtcgttgggttttccgttgttgtcttattttaggaaggtcgtactagtcgtggtaggtgcgtaggttggtaggtattcggtaggggtaacgttcggtccgacggtccggtacggggggttcccgtaggtaacggtccgttccgttccgttggttcggtaccgtacgtcccgttacgtcggtacttactacgtttaagtttaacgttaactacctaggttacggtagttacgggttagggtttcggggtaccccgtacggtaccgggtacccggttaccgggaaccgggggtaccggggtacggttaggggtacgggtttggggtaccggtacccgtaaccgttaaaccgttaaaccggacgtacgtacggtaacgtaagtaaacgtacgtagtaggtcgtacgtagtaggacggtaggtaccgtacgtaccgtaccgtccgtacgtacggaacgtaccgaacgtacgtaaacgtaactaccgtacgttacggtttactagacgtaaactaacgacttacgaccgtaaggacggtcgtaacggaccgtaccgtaacggtacctaagttaccgttaattacggttaacgttaaggtaaacttcggtaacttacggtttacgaagttcggtcgggtacgtagggttaacccgggttggaccggttaacc

SEQ ID NO: 2511 - DNA, 777 bp, Homo sapiens
  misc_feature: GYAE6OF02ICLDP.38.23.C01.1.454.CMB.1.raw
  modified_base (131)..(131): a, c, t, g, unknown or other
  misc_feature (131)..(131): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctcgtggntctctggagcccgtacggggacatcgtgagtcgacccagtctccagacctcccgtggctgtgtcgtcgtgggcgaggacgggccacgatacaaccgtgaccagtccgagccaggtagttctttgtacagtacctacaaaggtaactatagtacgtttcggttagtcgttacggtaaccaggtacaagtaaacgcctacgaaccgtaccgttacccccgtaaggttcgaccttcttaaagttttcgttaggttactaaccgttaccttaaccgggttccggggtttcccgggtttcccggggtaccccgttaccgggtaacccgtcgttaccgtaacggtccgggacgacgggtacgtacgtcggtaggggtactacgggtactttaccgaccttaccgtacctaacctacgtcaacgccgaccgtccgtacgaccgagacccgttagaaacttcgtacgggtaggtacttaagggttttacctggttacgtactacggtaacttaagttcgttaaacgttgggttaccgttacccggttcgtaccggttccggtttaccggttaccggggtaccgggttaaccgggtaaaccggtacggggttaaggtaccggttacgtaaaccgggaccggttacgtaaaccggg

SEQ ID NO: 2512 - DNA, 733 bp, Homo sapiens
  misc_feature: GYAE6OF02FI4Q0.38.23.C01.1.454.CMB.1.raw
  modified_base (263)..(263): a, c, t, g, unknown or other
  misc_feature (263)..(263): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagcgtggtttctgttgctatttagaggtgtccagtgtgaggtgcagttggtggaatcgtgggggaacttggtcagccgtgggggtccctagagctctccgtgtgcacgcctcgnggattccaacttaactaaaaattgtagggactcggcacgtcgggtccgtccgaggcctccgaggcgaaggggctagggacggtggggtacggactaacgtatactacgagttagtaggtagttaacgggttaaaagttttaaagaacgttagtacgggtaccggtacttacccggtagggaaaccgggtccgtaacgttacccgaaccgtaacttacccgtaccgtaaacggaacgtaaaccttaaacgttaaccccgaaaggccgtaaccaacctaccgtttaacttaacggtttacaacctaaaacgttacgaaacccacgggtcccgtaaggggtacgccgttaggaaccggaacgtcggtactcggttactacgttacgtcggtacgaaccggtaaaccggtaacccggccgttaacggtacgggttaccgggggtacggtaacggtttcggttagggtcccgggg

SEQ ID NO: 2513 - DNA, 778 bp, Homo sapiens
  misc_feature: GYAE6OF02HF1PJ.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagcttgggttttccttgttgtcttagtttagaggtgtcctagtgtgaggtgctagttgtggatcgtagggtaacttggtccagcgtcggggtcctagagcgtctctgtgcacgtcctcgtcggtattcgtattacgtttaagtaactctagttggtataggtggttcgggtccaccgaggtcccgtaccggaacggggtcgggacggttcgggtagggtcgggtcggaccctaacgttaacgttaaaccggaacggtaacgtacggaaacgttaaaggtaaaaacggtctaaaggttcgtacggtacccgttagttcgggtacggaaacgggtaccgtacctttaaccggtacccggtttaacctaccgtaacggtaacgaaccgtaaccgtaaccgtaaaggttaaccttacgtaacgttacggtttagtttaacgtaaacctaaacgtaggaaaccgccggttacgtaaccgtaacggtaaggttacccggaaacggtaccgtaacccgggttacaacgtttaatttaccggtttaagtttgtaaacggtaaaaggttaccgtacttaacgtttacgtaatttcggacgggttacgaaccggggtttacgtacggggtacttacg

SEQ ID NO: 2514 - DNA, 927 bp, Homo sapiens
  misc_feature: GYAE6OF02FHHCC.38.23.C01.1.454.CMB.1.raw
  modified_base (197)..(197): a, c, t, g, unknown or other
  misc_feature (197)..(197): n is a, c, g, or t
tcagtcgatcacgtcacgaccggtgctcgatttagtacacgtgattagggtagttgggggtctcagagaggagccttagccctggactccaagcctttgcacttggtgatcagcactgagcacagagtactcaccatcggaattgggcttggacgacttgggttttccttagttcgctttacgtttttagaaggttntccctagttgtacgaggttgcgtaggttggtaggtaagtcgtagggggtaaacttcggtacctacggccggttcgggggtaccctaggaacgtccttccttccgtgtcgaccgtacgtccgtacgttaggtactttacgtaagtttacgtttttaagtaaccttcgtagttgggttaagttacggttacgggtttaccggggttacccgaccggtacgggtcccgttaccggtacggggggtaccggggtacgttaccgggggtaggttacgggggtccggtaaccttaaacccggttaacgttaaaacccgaacgtaacggttaacccgggtaaacgtaaccgggtaaaaacgttaccgttaggtacgggttaacgttaccgttaccggttacggtaaccgggtaaaccggggtcctttaacgttcccgtaacccgttccgtaacccgagggtaaacccaacccgggtaaaccccgtaaccggttaaaggtaaccctttaaccggtaccgttttaggtttaacgttagtaaccgttaaagaacgtaacccgtacgttaccgtaggtaacggtacgtaaccgaacggtaaccacccggtaactagttactttaaagtttcgttaacgtaacgttaaggtacccttaaccggttaattacccggtaagtttacgggtacgggtacccgggtttaacggaacccgggtttcggggttaaccgtctttacggg

SEQ ID NO: 2515 - DNA, 733 bp, Homo sapiens
  misc_feature: GYAE6OF02G74OJ.38.23.C01.1.454.CMB.1.raw
tcagtcgatcacgtcacgaccggtgctcgatttagtacacgtgattagggagttggggaggtctcagagaggagccttagccctggactccaaggcctttgcacttggtgatcagcactgagcacagaggactcaccatggtaattggggctgagctgggttttccttgttgctatttagaaggtgtccagtgtgaggtgcgagttggtggaagtcgtgggggaaacttggtccagcctgggggtccctgaacgctctccgtgtcgcacgcctcgtggacttcaattatttaagtactctaagttggatggtaggttcgggtccgcgacggtcgtccggaacggggtaccggggcgtgggaggttggggtacggcccgtaacgtaaacgtaaaccgacgtaggtacggaactaaggaaaaacgtacttaagtacggtacggtactcgttaggacggaacggggtacccgtacgtttacccgacccttcctaacccgaagggactaacccgaaacacccggaaataacctttccgaacgttagttaacgtttacgaacgttaaacgttgaaaccgtacgtaccgtacgtaacggtaacgtaacggaacgaccccgtaaaggtacccaagttaagttaacgttttaacgtaggttaaacggttaaaagacttaaccgtaagttacgtaattacggagggttccggtaccggtaacggggttccgggtaggtaccg

SEQ ID NO: 2516 - DNA, 895 bp, Homo sapiens
  misc_feature: GYAE6OF02GZYQ5.38.23.C01.1.454.CMB.1.raw
tcagtcgatcacgtcacgaccggtgctcgatttagtacacgtgattagggattggggagtctcagagaggagccttagccctggactccaaggcctttgcacttggtgatcagcactgagcacagagactcaccatggaattggggctgagcttgggttttccttgttgcttattttagaaggttgtcctagtgtgaggtgctaggttggtggtaagtcggtagggggtaaaccgtttgggtaccgacggtcccggttcggggggtcccctggaacgtccttccgttcccgtggtcgaccgtacgtccccgttcgttacggtactttacttaacgttttaacgttttaaaggttaaacttacgttaaggtttgggtaagttaggttaacggggttttccggggtaccccgccggtaacgggtcccgtaccgggaacggggggtaccggggtcggttagggtaggggttcggggtcggacccctaacgttaaccgtaaacccgaacggtaacgttaggaaacctaaggaaaaacgtacgttaagttaggtaggtaccgttacgttagggtacgggaaccggggtacccgttactttacccgaccccggtttccgaacccgaaggtaacccggaacccgtaaaccgaacccgtaaaagttaaccctttccgtaaacgtttagtttacgtttacgaaaccgttaaagtacggaacccgtacgtaccgttagggaacgttaacgaaccggtaacggaaccgtaaccggtactaaagtttaactttagttttagttaggtttaaacgtaaacgttatttaaccgttacgtttaaccgtaaggtttacggttacgggttaccggtaaccggggtttacggggtttacggggtagttaacgg

SEQ ID NO: 2517 - DNA, 747 bp, Homo sapiens
  misc_feature: GYAE6OF02G7F77.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacgggacatcgtgatgacccagtctccagacctccctggctgtcgtctcgtgggcgagacgggccaccatacaactgacaacgtccagccagtagttcttttgttacgacgccttaccaaagtaattacgtgtacgtttacgtaagttcgttacggtaccgagaccgaaaggaaacgccgaacgtaaccgaccggtttaacccccgtaaaggtttccaccgttaacttagtttttaacgttcggttactaacgttaccgttaccggttccggggttacggttccccgggttccctaccggtaccggtacttcggaacggccggtacgaacggtccgtaacgttcgggacggtaacgtacgtacgtttacaccgttcctactaccctataccgacgtcaccggtctacggacaacggtacttaagtaacgtacgtggtacggtaacgtttaacgttttcgtaacgttccgtaactaacgttacttaaagttacgtttacgggtacgggtttaccgtcccgtcggtttccttaaccgggttccgtttaaccggggggacggaacgggtaccgtaagggtcgtaaggaactacggtagaccgtacgg

SEQ ID NO: 2518 - DNA, 644 bp, Homo sapiens
  misc_feature: GYAE6OF02FGLHZ.38.23.C01.1.454.CMB.1.raw
  modified_base (403)..(403): a, c, t, g, unknown or other
  misc_feature (403)..(403): n is a, c, g, or t
  modified_base (543)..(543): a, c, t, g, unknown or other
  misc_feature (543)..(543): n is a, c, g, or t
  modified_base (553)..(553): a, c, t, g, unknown or other
  misc_feature (553)..(553): n is a, c, g, or t
  modified_base (559)..(559): a, c, t, g, unknown or other
  misc_feature (559)..(559): n is a, c, g, or t
  modified_base (604)..(604): a, c, t, g, unknown or other
  misc_feature (604)..(604): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctggtttccttgttgcttatttagaaggtgtccagtgtgaggtgctagttcggtggaatcgtaggggtaacttggtccagtccgtgggggtccctgagtcctctccgtgtcgctacgcctcgtggtattccgaatttagttagtaatccgtaagttcggaattcggtaggtttcgggtcccgccgtaggtcctccggaggggccggggtctaggggaggttcgggtcgaccgtacgtaacgtaaacccgngtaagtcggtaaacgtaagtaaaaacgcttaagtaggtacgtaacttccgtaggtacggaacggtccggtaatttcccgaccgtacgtccgaagtaacgacccgaaccgacctaaagactacgtacgttgtatttacganaacgtgaacncgtagngtagtacgagaacgacgacgtacattagtattagtgtaactaagntactattaacgtatagtcggtagacgtcggtaggtctacg

SEQ ID NO: 2519 - DNA, 827 bp, Homo sapiens
  misc_feature: GYAE6OF02I90LV.38.23.C01.1.454.CMB.1.raw
  modified_base (198)..(198): a, c, t, g, unknown or other
  misc_feature (198)..(198): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctggttttccttgttgctattttagaaggtgtccagtgtgaggtncagttggtggaatcgtggggaaactggtccagccgtgggggtccctgacgtcctctccgtgtcgcaacgtcctactaggactttccttaaccccgttttagcgtaacgtacttaactcggtaccctaagtaggtacggccgttcggggttccccgaccgacggtccgtaccggacggggtaccggtcggttagggacggttcggggttaccgtaccgtaacgttttaaccgttaccgtaaagttaaacgttaagggttacgggtttaccgtaaaccccgtaagttacccgtttaaccggaccgacggtaaccgttacccgttaccggtaacggggtaaccgggttcccccgggttaacctaaccccgtaaccgtccctaacccgtaagtaaacccggaaacgtaacctttaaccgaaaccgaaaccgtaactaaaccgttaaccgttaaccctagtaaaccgtaaacgtaacggaaacccgtacccgttaaggaccgaacggtacccggacgaacgtaccggactaacgtacgttaactacgtcggtaacggttagggaaaacgggccggtaacggggtcgttaccgtacccgggtacgggaccgtaacccgggtaccggttacccggg

SEQ ID NO: 2520 - DNA, 722 bp, Homo sapiens
  misc_feature: GYAE6OF02GJ8HJ.38.23.C01.1.454.CMB.1.raw
  modified_base (348)..(348): a, c, t, g, unknown or other
  misc_feature (348)..(348): n is a, c, g, or t
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctgagctgggttttcctgttgctatttagaaggtgtccagtgtgaggtgcagttggtggaatcgtagggggaaacttggtccgagccggtgggggtccctaggaagctctccgtgtgcgacgcctctggattcattatttagtaatcagttagatgtaggttgggtccgccgagccgtccggaggggaccggggcgtagggnggtggggtggacctacgtaactaaaccgacgagtacggtaaactaaggaaaaagactagtaggtaggtactgtacggtacggaagggtcccgtaacttccgacccgttctaccgaaggacgaacgaacgtacaaagtaacttcaacttgttaagtttacgactaaagttacgaaccgtagtaccgtaggtaagtaccgggtaagaaaccggtaacccgaaaccggtaacctaagtttaaacgttaacgtttaatttacgggtaaaagttaaaacggtacttaacgttaaacgtttaccggttaaagtttacgggtacgggtttacgggaacccgggttaaacggggtacgggggttacggtaacctttaacggg

SEQ ID NO: 2521 - DNA, 870 bp, Homo sapiens
  misc_feature: GYAE6OF02HG8MV.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattgggctgagctgggtttcctgttgcttattttaaaggtgtccagtgtgaagtgcagctggtggagtcgtgggggaggtcttgggtacacggcccgtgggcctacggtcccctggacgtacttcctaccgtgtcgcgtacgtcccttcgtagtacttcgagttcttttagattaggtaactttagcggactagtcggaccgtacggttagggaccttcccggggaacaaacggtcccgtaccgggaaacgggggaacggggttcccgtaggggaacggtttcggggtacctacggtaggtttaacgttttaagggttaacgggtaaacgtaggggttaggggtaaacggacggttaaggtacctttaagggtcggtaccggtaccgtttacgtacgggtaacggggtaaaccggggtacccttaacgttaccggaacggcccttaaacgtcccgttaccgtaaaggaaccggtaaaccaaaaccccgggactaaaaccggtttaaacccgtttcccgtagtttaaaccctaaaccgttaaacgtaaaacgtttaacggaaacccttaggttaacccgttaagaaaccgggttacggtaaccgttaaccgggggaaaccggtaaacccggttaccgggggttaccccttttaaggtttaaacgtttacggtttacggtaaaacggtttaaaaccgtaaaagggttttttatttacgggtttaaaagggg

SEQ ID NO: 2522 - DNA, 681 bp, Homo sapiens
  misc_feature: GYAE6OF02HGIUP.38.23.C01.1.454.CMB.1.raw
  modified_base (266)..(266): a, c, t, g, unknown or other
  misc_feature (266)..(266): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagcgtggttttccttgttgcttattttagaaggtgtcagtgtgaggtgcagttggtggaagtcgtgggggaaacttggtccgagccgtgggggtcctgaacgctctccgtgtgcncgcctgtggtattcattagtttagtaactctagttaggagtggtaggttcgggtaccgccggacggtccgtaccggagggggtacggggtcgtagggacggttcggggtcggaccgtaacgtaacgtaaaaccgacggtaagtacggtaaacgtaagaaaaagtaccgttagtggtacggtactagtacggtaggacgggtaccgtagttcccgtaaccgtccgtacgaaggaacgtaaccgaaccgtaccaaagtaccttacgtacgttagttactttacgactaaagtacaacgcgtacgtaaggacgtagtaggaacgtaccgacgtacctaatactatttagtaaggtaactaaagcttacgtaagttagtagttacggttagggcggtacggtacggttcggggatacgg

SEQ ID NO: 2523 - DNA, 629 bp, Homo sapiens
  misc_feature: GYAE6OF02GJ5EG.38.23.C01.1.454.CMB.1.raw
  modified_base (263)..(263): a, c, t, g, unknown or other
  misc_feature (263)..(263): n is a, c, g, or t
  modified_base (291)..(291): a, c, t, g, unknown or other
  misc_feature (291)..(291): n is a, c, g, or t
  modified_base (348)..(348): a, c, t, g, unknown or other
  misc_feature (348)..(348): n is a, c, g, or t
  modified_base (356)..(356): a, c, t, g, unknown or other
  misc_feature (356)..(356): n is a, c, g, or t
  modified_base (399)..(399): a, c, t, g, unknown or other
  misc_feature (399)..(399): n is a, c, g, or t
  modified_base (454)..(454): a, c, t, g, unknown or other
  misc_feature (454)..(454): n is a, c, g, or t
  modified_base (490)..(490): a, c, t, g, unknown or other
  misc_feature (490)..(490): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtgggggaaacttggtccagccgtggggggtccctggacgctctcctgtncagcctctggattcattatttagtaatnagttggatggtagttcgggtccgccgaggctccgaggggacgggctgggaggtgggngcactaanaaaccacgtatacggaaactgaaaaacgctagtgtagcttcgngtaggaacgggccgtatacgacccgtctaccgaaggtacgaccaaacgacgaaanacttaccacttagttatttacgactaaatcgaaacncgaccgtaggaagtacgacggaaagaccgaccggtactaaagttaacttaatttagttaagtagggttaaaaagacttaaccgtaagtttaccgtaagttaggttcgggacggtacgtaaccgggtccgggtagtacgg

SEQ ID NO: 2524 - DNA, 854 bp, Homo sapiens
  misc_feature: GYAE6OF02HUC9C.38.23.C01.1.454.CMB.1.raw
tcagtcgatcacgtcacgaccggtgctcgatttagtacacgtgattagggattgggggtctcagagaggagccttagccctggactccaaggcctttgcacttggtgatcagcactgagcacagaggactcaccatggaattggggctggagtcgttgggttttcctgttgcttagttttagaggtgtccagtgtggaggtgcgtaggttgggtaggacgttcggtagggggtaaacttggtccgacggtccgggtggggggtccccttaggaacgtccttccgtcgtgtacgctacgtcctgttcggtattcctatttaagtttagtaattcgtaagtttggaacttgggtagttccggggtccaccgtacggtccgtaccgggacggggtaccgggtcgttgggaagggttcggggtaccgccttaacggttaaaccgtaaaccgtacggagttaccggggtaaaacttaacgggaaaaactacggttaagtgggttacggtaaccgtttagtcgggtaagggaccggtaccttacgttacccgtaaccgtccgtaaacgaggaaccgaaccgaacgaccgtaaagtaaccgttaccgtacgttagtttaacgttaccgaaagttaaacgttagaaacctaccggtacgtaaggacgggttaaccgtacggggttaaacccgaaccgggttaaccggtccctttaaaggttaaacgttttacttaaccgggttaaggtttaaaacggttaaaccgcgtttaaaccggtagtttacgggttaaaacttccggggttagggtacccggttaccgggtttaacccgggttaagggttaccgacggtttttaacgg

SEQ ID NO: 2525 - DNA, 1015 bp, Homo sapiens
  misc_feature: GYAE6OF02G66Z8.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccagtaggaagttggggctggagcgttgggttttccttgttgcttattttagaaggtcgtccagtgtgtaggtgcgtagttggtaggaagtcggtagggggtaaactttcgggtacccgtacgggtcccggttcgggggggtacccctaggaacggtcctttccgttccgttggtcgaccgacggtcccgttcgtcgggtactttcgaactttagtttaagttaacttactagtttagggtattagggttacggtttccggggtacccgtacccggtacgggtcccgttacccgggaaggggggtacccggggtcgttagggggtacgggttacggggtcgggtacccctaacggttaaacgtaaacccgaacggtaacgttaacggggtaaaacctaaggtaaaaaaccgggttaacgttacggttaagggttcgggtaacgttccgttaagggtacgggtaaaccggggtacccgttactttacccggtaaccccggtttaccttaaccgaacggtaaaccgtaaacccgtaacccggaaacgtaaaccgttaaacgtttaccgtacgtttaaacggtttacttttaaaccgaacgttaaaaccgtaacggtaaaaccgtacggtacccgggttaacggtaacggtaaccgggttaaacggaaaccggttaacccggggtaaacccgggtaaaccctttaaaccggtttaaatttaacggttttaacggtttttacgggttaaaaacggttaaacggttaaaccgttttaccggtttaaaccgtttacggtttaaacgttttaacggggtacggggttaaccgggttaacccggggggtttaaacccgggtttacgggggtaccgggtttaaaccccgg

SEQ ID NO: 2526 - DNA, 765 bp, Homo sapiens
  misc_feature: GYAE6OF02JX8VZ.38.23.C01.1.454.CMB.1.raw
  modified_base (741)..(741): a, c, t, g, unknown or other
  misc_feature (741)..(741): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggattgggctagagctgggtttccttgttgtactatttagaaggtgtcctaggtgtaggacggtgctaggttggtagggtatcggtagggggtaacttagggtccacggccggtccggggggtaccctggtaacgtcgtcctccggtgtacgccgtcgtaccgtctaggtacttacctaattactttagaattatacgttaagggattcgtagggttccggtaccgacggacggtcggtccgggtaagggggtccggggtacttggggtacggggttcgggtccggtaccgtaaacgttaaacgttaaaccgaacgtacggtaacgggtaacgtaaggtaaaaccgtataacgttaggtccggtaaagtccggtaggtacgggacgggtaaccgtacgttaccgccggttcggaccggtaacggtacgtaaaccgaacgtaaccgaagttaaccgtacgtacttaagggtttcttaaggtaaaccgacgttaaaaccggcgtaacgttaccgacggtaaggtaacgaacggtaacgtaccgtaaagccgtaattagttaacgtagttactaagtaacgtactattaacgtactaggtatcggnggtaaaccggtcggtacggtgtag

SEQ ID NO: 2527 - DNA, 840 bp, Homo sapiens
  misc_feature: GYAE6OF02IQJCF.38.23.C01.1.454.CMB.1.raw
tcagtcgatcacgtcacgaccggtgctcgatttagtacacgtgattagggattgggggaggtctcagagaggagccttagccctggactccaaggcctttgcacttggtgatcagcactgagcacagaggactcaccatggaagttggggctgagctgggttttccttgttgcttatttagaaggtgtcagtgtgagtgcagttggtaggaatcgtaggggtaaattcggtaccgagtccggtaggggggtcccctaggaacgtccttacgtcctggtcgcgaacgtcctacgtagggtactttacaagtttaatttacggtaaactcgttaagtttacgggagttaggagggtttacgggggtacccgtaccggaggtcccgtaccggaaggggggaaccggggtcgtaggggaaggttcggggttggacccaaacgttaactaaaaccgacgtagtaacggaacgtaaagaaaaagtacgtaatagggtacgtactaccgtaggtagaacgggtacccagtttaccacccggttatacccgaaagcgaaaccgaacggacccaaagtaacttaccgaactttagtaatttcgaaacgtaaacgttacgaaaacgttacgtacccgtaaggtaaaggtaaccggtttaacggaaaaaccgggtaccctaaacccgggggtaaccttaaaaggtttaacttaaaggtttttacgttaagggttaaaccggtttaaaaaaggttaacttaccggttaaagtttacgtaaaccggttttaatacgggggggtttacggtaacccgggtaaacccgggtttacgggggtaaccgttaaccggg

SEQ ID NO: 2528 - DNA, 816 bp, Homo sapiens
  misc_feature: GYAE6OF02FWSM7.38.23.C01.1.454.CMB.1.raw
tcagtcgatcacgtcacgaccggtgctcgatttagtacacgtgattagggattggggaggtctcagagaggagccttagccctggactccaaggcctttgcacttggtgatcagcactgagcacagaggactcaccatggaattgggctgagctgggttttccttgttgtctattttagaaggtgtccagtgtgagtgcagttggtggaatcgtggggaaacttggtccagccgtgggggtccctgaagctctcctgtcgcacgcctctggtattctattaatttagtaattcagtttggatggtaggttacgggtcccgccgaggtccgtccggacgggggacggggcgtgggaggtggggtccggaccgtaactaacgtaaaacccgaacgtagtacgggaaacgtaaggaaaaaacgtacgttaagttacggtaggtaactttcgttagggtacggaacggggtaccgtacgttaccgacccgttcccgtacccgaaggtaaccgaaaccgaaacccgggacccaaaggtaaaccttacgtaaccgtttaacggtttacttttacggaaccttaaaagtaaccggtaaaccgtaacccggtaaccgttaacggaggttaaacgggtaccggaaacgggaaacccgaacccgggtacctaaacgttaagtttaacgttttaacggtttaaggtttaacggtaaaaaacggttactttaacccgtaagtttttaacccggtaagtttaacgggtttcgggggttaaccgggtaacccgggtttaccgggggttaccgggttacggtttaacccgg

SEQ ID NO: 2529 - DNA, 740 bp, Homo sapiens
  misc_feature: GYAE6OF02F5NKT.38.23.C01.1.454.CMB.1.raw
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacgggacagtcgtgatcgacccgtagtccgtccaggacctcccgtggctggtgtcgtcgtgggcgaggacggccaccagtccaactcgacgaacgtcccgagcccgaagtacgttcttttgtctacgtcctacccgaagtaactagtacggttacgttacgtttacgtcgttaccggtaccgtaggacgaaagaaacgtaccaaccgaccgtaccggtacccttaaggttcgacgtacttacgtttagttgtactacgttcgtaccggttcgggtccggttccgggtccctacggtaccgtcgttaccgacggccggtacgacggcggtacgttccgggtacgggtacaacgtttacgtttacccaacgttccctaccgtaaccgtaaccgtcgtaaccgacccgacgtcccgtagtacccgaaggtaacggtaccgtaagtaggtcggtacgtacgtttaagttacgttaacggtgtacgtagtaccgtaattaacgttgttacggtacgttccggtacgtccgttaccgtacggtttaccggacgggtaacggtaaggtacggtaggtaacgtacgtaccggtacgtacggtacg

SEQ ID NO: 2530 - DNA, 695 bp, Homo sapiens
  misc_feature: GYAE6OF02JY3WI.38.23.C01.1.454.CMB.1.raw
  modified_base (186)..(186): a, c, t, g, unknown or other
  misc_feature (186)..(186): n is a, c, g, or t
  modified_base (200)..(200): a, c, t, g, unknown or other
  misc_feature (200)..(200): n is a, c, g, or t
  modified_base (534)..(534): a, c, t, g, unknown or other
  misc_feature (534)..(534): n is a, c, g, or t
  modified_base (591)..(591): a, c, t, g, unknown or other
  misc_feature (591)..(591): n is a, c, g, or t
tcagtcgatcacgtcacgaccggtgctcgatttagtacacgtgattagggagttggggaggtctcagagaggagccttagccctggactccaaggcctttgcacttggtgatcagcactgagcacagaggactcaccatggaattggggctgagcttgggttttccttgttgctatttagaaggtntccagtgtgaggtncaggttggtgaatcgtggggtaaacttggtccaggtccgtgggggtccctaggaacgtcgtcctcgtgtcgctacgcctgtcggtattctaattattaagtaactgtacgttaggtataggtaggttcgggtacccgactaacgggtcctaccggtaaggggaccggggttactggggtaacggtgggtaccggaccgtaactaacgtaaaccacgaggtaacgaagtaaagaaaagtacgtaatggtacgtaccgtagtaggtaacggacgggtactacggtacccacggtacctacgtaagaccaaccgtaaacgcgtaaacgtagtaaccncgtttaagtacttcggaaactaagactacgacgtactgaaacgtaggaccggtaaanacccaaccggtactaaggttattaagttacgttagaaaacgtaattactgtaaagttccaaggttacgtaaggtcggttacccggtaacgtggggttactacgg

SEQ ID NO: 2531 - DNA, 711 bp, Homo sapiens
  misc_feature: GYAE6OF02F5LHR.38.23.C01.1.454.CMB.1.raw
  modified_base (118)..(118): a, c, t, g, unknown or other
  misc_feature (118)..(118): n is a, c, g, or t
  modified_base (125)..(125): a, c, t, g, unknown or other
  misc_feature (125)..(125): n is a, c, g, or t
tcagtcgatcacgtcacgaccggtgctcgatttagtacacgtgattaggagttgggggagctacaacaggcaggcagggcagcaagatgtgttgcagaccaggtcttcattctctgtnctctganctctggagccgtacgggacatcgtgactgacccagtcctaccaggacctcccgtggtctgtagttctcgtgggcgagacggccaccataccgactaggaccacgtacccacgaccagtagttacctttttgtaccagtaccttaccaaagtattactggtacgttcgttagtccgttacggacctagacaacgaacgtactaacgacgtacgtaccccgtaagttccgtacgttacgtaatttagtttacgtaccttacgttacttacggttccgggtcggtcccgggtaccttaccggacttaggtcgacgtccggacgacggtcgtactccggtaacggtactacggttactttaccacgtaccgtaccaccgtaagtaccgacgtaccgcgtaccgtagaccgaagaacgttacgaaggtactaggtacgtactaacgtttaacgttacggtacgtacgaacgtaacttacgttacgttaggttaccgtacgttccgtaccgtccgttaacccgtacggttacgggtaaccggtacggtaaccggtacgggtaccgtacgacgttaccggagtacccgtacgg

SEQ ID NO: 2532 - DNA, 754 bp, Homo sapiens
  misc_feature: GYAE6OF02HF8AC.38.23.C01.1.454.CMB.1.raw
  modified_base (172)..(172): a, c, t, g, unknown or other
  misc_feature (172)..(172): n is a, c, g, or t
  modified_base (566)..(566): a, c, t, g, unknown or other
  misc_feature (566)..(566): n is a, c, g, or t
  modified_base (687)..(687): a, c, t, g, unknown or other
  misc_feature (687)..(687): n is a, c, g, or t
tcagtcgatcacgtcacgaccggtgctcgatttagtacacgtgattagggattgggggagctacaacaggcaggcagggcagcaagatggtgttgcagacccaggtcttcatttctcgtgttcgctcgtggatcgtcgtggacgtccgtacgggactagtcgtgatcgaccngtcctcgacgtacctccgtggtctgtcgtctcggtggcgagcggaccaacgactaccgaagtcgacgtaacgtccgaagaccgtagttagttttcgtttttacgtccgagtaccgttaaccgaaaggtaattacgttaggttacggttttaccggttagtccgtttacggaacccgtaggtaaccgtaaaggtaaaccgccgtaaacgtaccggttaaccgttaccccggttaagttcgtaccgtacttaagttttcgtacgtactagttccgtacgggttccgggtccgttcccggtaccgtgacgttacgtcgacggtacgtcgacggtacgacgtaggtacggtaactcgttaacttccgacgttcacgtactactcgactcggactcganacggttacagttaagacgtgtcgtccggtaattttaccgttagcgttacgtaaccgaagtttaactacgttttagaacggttccgtacgtttacccgagttccgttaaccggtttacgggnggacccgggttaaacgggttcggtaaggtacggaaccgttaacgggtataaaccgggtcggttaggg

SEQ ID NO: 2533 - DNA, 885 bp, Homo sapiens
  misc_feature: GYAE6OF02I4YNI.38.23.C01.1.454.CMB.1.raw
  modified_base (617)..(617): a, c, t, g, unknown or other
  misc_feature (617)..(617): n is a, c, g, or t
tcagtcgatcacgtcacgaccggtgctcgatttagtacacgtgattagggattgggggagctacaacaggcaggcaggggcagcaagatggtgttgcagacccaggtcttcatttctctgttgctctggatctctggagccgtacggggacagtcgtgatcgacccgtagtctccgagtacctcccgtggcttgtcgtctcgtgggacgaggacgggccaccgtataccgtaacctcgtacgtaacgtcccgacgaccctaggttacgtttcgttttacgttacacggtacctaccgaaaagtaacgttagtacggttacggttttaccggttaacgtccggtttacggttaaaccccgaggacgtaaacgaaacggtccctaaccggtacctaaaccgggttaccccttaggttaccgtaccttacgtttaacgttttaacgtcgggttacttaaccgttaccggttaacggttccgggggttacccggttcccgggtttaccctaacggtacccgtaacgtttcggaccgggtacggtacacggggtaccggtcgtaccgggacggtacgtaacggttacctttaccggtaacccttccgtaaccaaacccggtntaccgggaaccgtacgtaccgttaccgtaccggagttaaaccggtaccgtttaaggaacggttacctacggggtaagtacgttttaaacggttttacctaccgttacgggtacttaaacgtaccgtttaaaggttacctttacgggttaaccgttacccggttcgtaccgtacgtttaacccgggttcggttaacggtcggggaaaccggtttacggtaacgggtaacggtaccgtaacggttacccggtaaggtcccggttaaaggg

SEQ ID NO: 2534 - DNA, 681 bp, Homo sapiens
  misc_feature: GYAE6OF02GR27Y.38.23.C01.1.454.CMB.1.raw
  modified_base (274)..(274): a, c, t, g, unknown or other
  misc_feature (274)..(274): n is a, c, g, or t
tcagtcgatcacgtcacgaccggtgctcgatttagtacacgtgattagggattggggaggtctcagagaggagccttagccctggactccaaggcctttgcacttggtgatcagcactgagcacagaggactcaccatggaattggggctgagctgggttttccttgttgctattttagaaggtgtccagtgtgaggtgcagttggtggaatcgtggggaaacttggtccagccgtcggggggtccctgaacgtctcgtcctgtgcacgcctcngctattcctacctttaagtaacttatttaagtgaacgtcgtacgggtcccgcctacgtccctacggaggggaagggcgtgggtaggtggggtcgccagcaacttaaacgaacgtagtcggaacgtaagaaaaacttacgtagtagtggtacctcgtaggtaggaacggggtccgtaacgtccggaccgtaccttacctaccgtaacgaacgaaccaaaccggaacccgaaacgaacctaccgtaccgtaggtcggtactcgccaacacgtacggaaccggtcgtacggacggacgggaccgaaccggaccgacgtcgtacgtcgttacttacgtcggtacgtacggaccgacccgtaccccgacggtaccggacggacccggttttacggacgggtagggtacccgg

SEQ ID NO: 2535 - DNA, 880 bp, Homo sapiens
  misc_feature: GYAE6OF02JB312.38.23.C01.1.454.CMB.1.raw
tcagtcgatcacgtcacgaccggtgctcgatttagtacacgtgattagggagttggggaggtctcagagaggagccttagccctggactccaaggcctttgcacttggtgatcagcactgagcacagaggactcaccagtggaattggggctggagcgtgggttttcctgttgctagtttacgaaggtgtccagtgtgaggttgcaggttggtggaatcgtaggggggaaacttgggtccctaggtcccgtaggggggtcccctaggaagtccgtcgtccgtaggtcgtaccgtgtcccgttccgtagggtacttacaactttagtttaacggttaacttccgtagtttacggagttacggtaggttttacgggggcccctaccgtacgggtaccttcccggtaagggggaaccggggtccgttagggaagggttcggggttacgggccctaaaccgttaaccggtaaaaccaccgggtaaggttaccggtaaacttaaacgggaaaaaacgtaccggttatacggggttacggaaccgtttaacccgtgggtacggggtaaaccggggtaccccgtaagttacccggaaccccggttttacgaaccccggttaacgggaacgggtaaccgaacccggtaacctaaaccggggttaaaccttaccgtaagttaccggtttaacttttacgggaaactaaacgtttcgaaaccgttacgacccgttagacgggtactaacgggtaacgaacccggtccgaaacctacgttaacttaacgttacttaccgggttaaagtaaaaccgttaggtacccttaaacgttccgagtttaagccggtttaaggtaaccggttacccggtttaacggggcgttaaccgg

SEQ ID NO: 2536 - DNA, 711 bp, Homo sapiens
  misc_feature: GYAE6OF02JUNRL.38.23.C01.1.454.CMB.1.raw
  modified_base (285)..(285): a, c, t, g, unknown or other
  misc_feature (285)..(285): n is a, c, g, or t
  modified_base (567)..(567): a, c, t, g, unknown or other
  misc_feature (567)..(567): n is a, c, g, or t
  modified_base (681)..(681): a, c, t, g, unknown or other
  misc_feature (681)..(681): n is a, c, g, or t
tcagtcgatcacgtcacgaccggtgctcgatttagtacacgtgattagggattggggaggtctcagagaggagccttagccctggactccaaggcctttgcacttggtgatcagcactgacgcacagtaggactcaccagtggaagttgggcttgagtcgttgggtttttccttgttagtccttatttttacgaaggttcgtacagttgtgaggtgctaggttggtgactgtagggaacttggtcacgtcgtcggggtcctgacgctctcgtgtgcacgtccgtntaggtacttcgaatttacgttaacgtacttctagttacgtagtcgtggttccggcctaccgacggtcgtaccggacgggtcgggtcgtaggtaacggtcgggtcgtacctacgtaacgtaaacccagttactaacgggaacgtaataaacggtactaggttacgtggaaccgtttaggtacggtacgggtaaccgggtctaacggtttacccggtaccgtaccgttccgaaacggtacgtaaaccgtaccgtaacgtaacggttaacttaaccgtacggttntttacgttaagaacgtaacgtaacgtaacgtacgtacgtagacggtaacgtacgacggacctacggtactaacgtaagtagttataggtaactaaagctatacgtgtaaagttnttacgggagtacggtcgttaccggtgtacg

SEQ ID NO: 2537 - DNA, 558 bp, Homo sapiens
  misc_feature: GYAE6OF01AFIBL.21.87.H10.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaacctgtctcctggtatcaacacaccaggacaaagccccaaaactcttaatttctggcgtcaatcagccgaccctcacatcgtttccagtcgattctctgcatccaagtctggcaacacggtcctttcngactatctctcaactccagctagaagacgaggcttatttatactgctcctcactacgcaggtgctacttatttttcgttggttttcggcgggtcggtaccctagtacgttcgtacgttgtccctcgtacgttccacggtaccccgaaggtcccgttcccggtccccccgttcggttacccg

SEQ ID NO: 2538 - DNA, 550 bp, Homo sapiens
  misc_feature: GYAE6OF01BS5RB.21.87.H10.1.454.CMB.1.raw
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctccgggcagtcggtcaccatctctgcgctggatccagcgatgatattggtacgttttaccttgtctcctggtatcaacaacaccaggacaaacgaccccaaaactcttaaatttctaggcgtacaatcagccgaccctcactactgtttccagtcgtacttctctgcacgtccaagtctggacaacgacgtctttcagactaatctctacaactccagtctagaacgacgagcttaagtttatactgcctcctacatacgcaggtcgactacttatttttcgttgggttttcgcgggtcggtacctagattcgacttgtacctcacgtcacgacccacggtacctccgtccccctggtccc

SEQ ID NO: 2539 - DNA, 533 bp, Homo sapiens
  misc_feature: GYAE6OF01BAIPA.21.87.H10.1.454.CMB.1.raw
  modified_base (372)..(372): a, c, t, g, unknown or other
  misc_feature (372)..(372): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgacctcacatgttccagtcgattctctgcatccaagtctggcaacacgctttcngacaatctctacaactccagctgaagacgagctatttattactgctctcatacgcaggtgactactatttttcgttggttttcggccgtcgggtaccctagtactcggacttgtccctcgacgttcacgtccccgaaggcctccggtcccccgtggtaccc

SEQ ID NO: 2540 - DNA, 514 bp, Homo sapiens
  misc_feature: GYAE6OF01AXJNY.21.87.H10.1.454.CMB.1.raw
  modified_base (378)..(378): a, c, t, g, unknown or other
  misc_feature (378)..(378): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggactttttaaccttgtctcctggtatcaacaacaccaggacaaagcccccaaaactcttaatttctggcgtcaatcagcgaccctcacatgtttccagtcgattctctgcatccaagtctggcaacacggtcctttcngacaatctctcaactccagctgaagacgagctatttatactgctcctcactacgctaggtgctacttatttttcgttggttttggcggtcggaccagtatgtctgtctcagtcacgtccaggctcgccccgtgtcc

SEQ ID NO: 2541 - DNA, 616 bp, Homo sapiens
  misc_feature: GYAE6OF01CP2KK.21.87.H10.1.454.CMB.1.raw
  modified_base (306)..(306): a, c, t, g, unknown or other
  misc_feature (306)..(306): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtcctcccgggcagtcggtcaccatctcttgcgctggactccagcgatgatattggtacgttttaacttgtctctggtatcaacaacaccaggacaaacgccccaaaactcttaattcnggctacaatcagcacctcactatcgttccagtcgattctctgcactccaagtcgtacggaccaacgtacggtcctttactacgaactaacttcctacctacctaacctccgacggtctaggaacgtacgacggtacttaatttaacttacgtgtacctcctacactacgcgtaggtcgtacttacgtttatttttcgtttgggttttcggaccggtccggtacctagtacgttacggtacgttcgtcccgtcgtacgttaccgacggtaccccgtaaggtcccgttcccggtccccccgttggtaccccg

SEQ ID NO: 2542 - DNA, 640 bp, Homo sapiens
  misc_feature: GYAE6OF01C1BP1.21.87.H10.1.454.CMB.1.raw
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacgagggtcctgggcccagtcctgccctgactcacgcctgcctccgtgtctgggtcctccgggcaggtcggtcaccatctcttgcgctggatccagcgatgatagttggtacttttactgtctctgtactacaacaacacaggaacaaacgaccctaaacttcttaattcgtaggtctacaactcacgccgacctcactattcgttcagtcgtacttctctagactactactaagtcgtagaccaacgtacggttcctttacacgaactaactcctactacaaccgtcaggtctaaggaacgtacgtagtacttaagtttactcgtcgtccttacctatacgttaccggcgtaacgggtcgtaaccgttacgttttacgtttttcggtttgggtttacgggacggtaccggtaaccgtagttaactcggttacgtacgttacccgtgtaaccgtccgtaaccggaccctaacggtccctaccccggttcccgtcggttacccg

SEQ ID NO: 2543 - DNA, 622 bp, Homo sapiens
  misc_feature: GYAE6OF01CG4R0.21.87.H10.1.454.CMB.1.raw
  modified_base (198)..(198): a, c, t, g, unknown or other
  misc_feature (198)..(198): n is a, c, g, or t
  modified_base (303)..(303): a, c, t, g, unknown or other
  misc_feature (303)..(303): n is a, c, g, or t
  modified_base (320)..(320): a, c, t, g, unknown or other
  misc_feature (320)..(320): n is a, c, g, or t
  modified_base (340)..(340): a, c, t, g, unknown or other
  misc_feature (340)..(340): n is a, c, g, or t
  modified_base (467)..(467): a, c, t, g, unknown or other
  misc_feature (467)..(467): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggactcgagcgatgatagttggtacttttaactgtctcctggtatacaacacacaggacaaacgacccaaaatcttaattcnggctcaatcagcacctnacatcgttcagtcgtattcnctgctatcctaaggtctaggactaaaccgacggttcctttactacgtaacctaatccttactaccaaccttccgaaggtctagaaacgtacgaggtactttaatttactaccgtgtaccctacctanaaccgtacggacgtaacgggtggtaacctacgttttcgtttttacgtttcgggggttttcggaccgggtaccgggtaccctagtacgtcgtaacgttcgaccttccgaacgtccgacgtaccctacgggtacctcccggtaccccgtcggtaccc

SEQ ID NO: 2544 - DNA, 550 bp, Homo sapiens
  misc_feature: GYAE6OF01B3BLF.21.87.H10.1.454.CMB.1.raw
  modified_base (365)..(365): a, c, t, g, unknown or other
  misc_feature (365)..(365): n is a, c, g, or t
  modified_base (376)..(376): a, c, t, g, unknown or other
  misc_feature (376)..(376): n is a, c, g, or t
  modified_base (435)..(435): a, c, t, g, unknown or other
  misc_feature (435)..(435): n is a, c, g, or t
tcagtcgtcgctcgcacgaccggtgctcgatttagcagtactgcgttgggtttgggggtcacaagaggcagcgctctcgggacgtctccaccatggcctgggctctgctgctcctcactctcctcactcagggcacagggtcctgggcccagtctgccctgactcagcctgcctcgtgtctgggtcctcccgggcagtcggtcaccatctcttgcgctggatccagcgatgatattgacgttttaccttgtctcctgtatcaacaacacaggacaaacgccccaaaactcttaatttctggcgtcaatcagccaccctcactattcgttccagttcattctctgactatccaagtctggcaaacncggtcctttcngactatctctacaacctcacggctagaacgacgagtcttaatttactactgtctcctanactacgctaggtgactattagtttttcgtttgggttttacggccggtaccggtaccagtactgtaccttgtaccctgacgtcaacggtccctaggctcccgccccgttcggtacc

SEQ ID NO: 2545 - DNA, 580 bp, Homo sapiens
  misc_feature: GYAE6OF01CM965.21.87.H10.1.454.CMB.1.raw
  modified_base (266)..(266): a, c, t, g, unknown or other
  misc_feature (266)..(266): n is a, c, g, or t
  modified_base (364)..(364): a, c, t, g, unknown or other
  misc_feature (364)..(364): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtcctccgggcagtccggtcaccatctcttgcgctggatccagcgatgatattggacttttactgtctcctgtatcaanaacacaggaacaaacgccccaaaatcttaattctgtcgtcaatcagccgacctcactatcgttccagtgacttctctgcatccaagtctggactaacncggtcctttcagactaactctactcaactcagtctaggaacgacgagtcttaatttatactcgtctcctatactacgctaaggtcggtacctacttagtttttcgttacgggttttggaccgggtcggtaacccgtaggtattacgtaaccgttgtcccttcgtaccgttacgaccgtcccgtaaacggtcccttaccgcccccgttcggttaccc

SEQ ID NO: 2546 - DNA, 756 bp, Homo sapiens
  misc_feature: GYAE6OF01AS65S.21.87.H10.1.454.CMB.1.raw
  modified_base (196)..(196): a, c, t, g, unknown or other
  misc_feature (196)..(196): n is a, c, g, or t
  modified_base (297)..(297): a, c, t, g, unknown or other
  misc_feature (297)..(297): n is a, c, g, or t
  modified_base (318)..(318): a, c, t, g, unknown or other
  misc_feature (318)..(318): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtctccgggnagtcgtcaccatctctgcgctggactccagcgatgattagttggtacttttacctgtctcctggtactcaacacacagacaacgccccaaatcttaattcnggctacaatcagccgaccctnactattcgttaccagttcgtactttcctcgtcgcctactaccgtaaaggttcctacgggaccctaaaccgtccgggttacccttttacgacgtaaccttaacgttcccttaccgtaaccctaaccgttcccgaagggtacccttaagggaaaccggtaccggtacggttaaccttttaagtttttaaccttaccgttacgtaccctttacccgtactaacgttaccggtacgtacgggttccggtacctttaacgttttacgtttttttcgggtttacggggtttttaccgggacccgggtaccggggtaaccccttaagggtacgtttaccggtaccgtttccggttaccccgttacggtaacccggtttaccgacccggttaccccggtaaccgggttcccgttacccccggttcccccggttacggttacccccg

SEQ ID NO: 2547 - DNA, 572 bp, Homo sapiens
  misc_feature: GYAE6OF01DU3ZJ.21.87.H10.1.454.CMB.1.raw
  modified_base (322)..(322): a, c, t, g, unknown or other
  misc_feature (322)..(322): n is a, c, g, or t
  modified_base (350)..(350): a, c, t, g, unknown or other
  misc_feature (350)..(350): n is a, c, g, or t
  modified_base (384)..(384): a, c, t, g, unknown or other
  misc_feature (384)..(384): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtctcccgggctagtcggtcaccattctcttgcgctggatccagcgatgatagttgtacgttttaccttgtctctgtatcaacaacaccaggaacaaacgaccccaaaacttcttaatttctggtcgtacaatcancgaccctcacattcgttccagtcattcnctgacataccaagtctggacaactacgtctttcngtaacatctactacactcaggctagaacgacgagacttaatttactactgtcctcctactacgtacgcgtacggtcgtactacgtttagtttttcgttggtttttacgggcgggtacccggtacctaggtctacggtcctgtccctgtacgtcacgtcccgtaagcctacccgtccccgtcgtacccg

SEQ ID NO: 2548 - DNA, 671 bp, Homo sapiens
  misc_feature: GYAE6OF01EAP09.21.87.H10.1.454.CMB.1.raw
  modified_base (211)..(211): a, c, t, g, unknown or other
  misc_feature (211)..(211): n is a, c, g, or t
  modified_base (219)..(219): a, c, t, g, unknown or other
  misc_feature (219)..(219): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcacgcctgcctccgtgtcgtgggtcctccgggcagtcgtcaccntctctgcnctggactccagcgatgtatagttcggtacttttaacctgtctacctgtatcaaacaacacgaacggaacaaacgtaccccaaaacttcttaaagtttcgtcggtacgtacaatcaagccgaccctcaactagtcgtttaccagtacagttctctgcactccaagtccgtagactaaacgccggtcctttgacgtaactaacttccgtacctaccgtaaactccggtaagtacctaggaaacgtaacggtaacggttacttaacttttaatacgttctaccttaccgttacgaaacgttaccgcggttaagtaccggtacttaaccgtttagttttttccgttagggttttacgggcccggttaacggtacccgtagtacgtcgtaacgttcggttaccctcgtacggtacaacccggtccgaacgtccctccggttcccctgggttaacccc

SEQ ID NO: 2549 - DNA, 678 bp, Homo sapiens
  misc_feature: GYAE6OF01C1587.21.87.H10.1.454.CMB.1.raw
  modified_base (198)..(198): a, c, t, g, unknown or other
  misc_feature (198)..(198): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctcgtgtctgggtcctcccgggnagtcggtcaccatctctgcgctggatccagcgatgatattggtactttaacttgtctctgtatcaacaacaccagacaaacgccccaaaactcttaatttctggctacaatcacgcgtaccctacactatcgttaccagtcgtacttctctcgactactacctaagttcgtggtaccaaccgtacggtccctttactacgtactaacttcctacctacctaacctccgaagggtcccttaaggaacggaaccgtaggtacctttaagttttacgttactcgtccttaccttacaacttaccggacgtagggttccggtaaccttacttttacgtttttttccggttttacgggtttttccggggcccgggtaacccgggtaacctaacgggttacgttcgtaaccggtcgtttacccgaccttacggtacccacggaccccgtaaggtccccttacccggcccccccgttggtaaccccg

SEQ ID NO: 2550 - DNA, 623 bp, Homo sapiens
  misc_feature: GYAE6OF01CHRBM.21.87.H10.1.454.CMB.1.raw
  modified_base (195)..(195): a, c, t, g, unknown or other
  misc_feature (195)..(195): n is a, c, g, or t
  modified_base (204)..(204): a, c, t, g, unknown or other
  misc_feature (204)..(204): n is a, c, g, or t
  modified_base (297)..(297): a, c, t, g, unknown or other
  misc_feature (297)..(297): n is a, c, g, or t
  modified_base (317)..(317): a, c, t, g, unknown or other
  misc_feature (317)..(317): n is a, c, g, or t
  modified_base (346)..(346): a, c, t, g, unknown or other
  misc_feature (346)..(346): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacgagggtcctgggcccagtctgccctgactcagcctgcctcgtgtctgggtctccgggnagtcgcacntctctgcgtctggactccagcgatgattagttcggtacgtttactgtctctgtatacaacacacaggacaaacgccctaaaatcttaatttcnggctacaatcagcgaccctntacagttcttaccgagtcgtacttcgtcngtactataccgtaagtctaggactaaccgtacggtcctttgagtaacctaacttccgtacctactaacctccgaggtactaggaaacgacgtaaagtacttaaattttactaactcgtaccttccctataaccgtacgtacgtaggtcggtacttacttttacgttttttcgtttacgggttttcggaccggtacccggtaccaggtagttacgcgttacgttcccgtactacggtaccacgtaccgtaacgccgttacccgccccgttggttaccc

SEQ ID NO: 2551 - DNA, 775 bp, Homo sapiens
  misc_feature: GYAE6OF01C1VAO.21.87.H10.1.454.CMB.1.raw
  modified_base (320)..(320): a, c, t, g, unknown or other
  misc_feature (320)..(320): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaactgtctctgtatcaacaacaccaggacaaacgccccaaaactcttaatttctggcgtcaatcagcgacctnacatcgttccagtcgacttctactgctatccaaagttcctggacctaaactaccgggtccttttactagaacctaaattccttacctacctaaaccttcccgaacgggtcctttacggaaaacgtaaccggtaacggtacctttaagtttttaacgtttaaaccgttcggtaacccttttacccctaacgtaacgtttaaccggtacccgtaacggggtttacggtaccgttaaaccgtttaacgtttttttttaccgttttacgggggttttttttaccggggtacccggggttaacccgggggttaaccccccgtaagggttaaccgttacgggtaaaccccgtttaggtttaccccctttacggtaaccgggtttacccgtaaccggtaccccccggtaaaacggggtccccgtttacccgggtccccccccccgtttggggttaacccccg

SEQ ID NO: 2552 - DNA, 758 bp, Homo sapiens
  misc_feature: GYAE6OF01D61V0.21.87.H10.1.454.CMB.1.raw
tcagtcgtcgctcgcacgaccggtgctcgatttagcagtactgcgttggggtttgggggggggtcacaagaggcagcgctctcgggacgtctccaccatggcctgggctctgctgctcctcactctcctcactcagggcacgagggtcctgggcccagtctcgccctgactcagcctcgcctccggtgtcgtgggtccgtcccgggcacggtccggtccacctacttccttcgttcgcgtcgttcggactccgagcgtatagtagttagtttacggttaaccgttttaaccttgtccgttccgttaggtaactaccgaaaccaaccaccgaacggaaccaaaccgtaacccctaaaactttctttaacgtttccgacgggtacctaacaacgtccgacggtaccctaaccctcgaacttacgttccggttttaccaacggtttcgtaacctttccgtacgtcgacctaaccgttaccgtaacggttccgtaccgaaccgtaacccgtaccggtttccctttacgaacgtacctaacgtcccttacctaacctaaccgtccgaaggtacaaggaacggtacgtacgttactttaagtttactaccgtcgtccctacctagacgtcgtacgacgggttctaccttacgttttgttttcggttgggttccggaccggtcgtaaccgtgtagttaccgtcgtctccgtagtacgtaccgtaaccggtcccggtaccgtccgtcccccggttcccgtgtaccc

SEQ ID NO: 2553 - DNA, 652 bp, Homo sapiens
  misc_feature: GYAE6OF01EI3OF.21.87.H10.1.454.CMB.1.raw
  modified_base (203)..(203): a, c, t, g, unknown or other
  misc_feature (203)..(203): n is a, c, g, or t
  modified_base (361)..(361): a, c, t, g, unknown or other
  misc_feature (361)..(361): n is a, c, g, or t
  modified_base (365)..(365): a, c, t, g, unknown or other
  misc_feature (365)..(365): n is a, c, g, or t
tcagtcgtcgctcgcacgaccggtgctcgattttagcagtactgcggttgggtttggggggggtcacaagaggcagcgctctcgggacgtctccaccatggcctgggctctgctgctcctcactctcctcactcagggcacgagggtcctgggcccagtctgccctgactcagcctgcctccgtgtcgtgggtcctcccgggnaggtcgggtcaccgatctcttgcgcgtggatcccagcgatgtatagtttggtaacgtttttaaccttgtcctctggtatcaacaacacagacaaacgccccaaaattcttaattctggcgtacatcagccgacctcatattcgttccagtcgtattcntganactcaagtctcggacaacgaccggtcctttcgagaacctaattcctacgttaccaaccgtttcccgaaggtcctaaggaacgacggtaacggtactttaattttaattacccgtgtccttaccgttaccaataaccggcgtagggccggtacttactttaacgttttttcggtttcgggttttacgggccgggtaccggtacccaaggttagttccgtaaccttcgtaccgtcgtaccgtacgacgtacccgacggtccctacccggttcccccggtcggttacccc

SEQ ID NO: 2554 - DNA, 744 bp, Homo sapiens
  misc_feature: GYAE6OF01ED32B.21.87.H10.1.454.CMB.1.raw
  modified_base (171)..(171): a, c, t, g, unknown or other
  misc_feature (171)..(171): n is a, c, g, or t
  modified_base (200)..(200): a, c, t, g, unknown or other
  misc_feature (200)..(200): n is a, c, g, or t
  modified_base (215)..(215): a, c, t, g, unknown or other
  misc_feature (215)..(215): n is a, c, g, or t
  modified_base (219)..(219): a, c, t, g, unknown or other
  misc_feature (219)..(219): n is a, c, g, or t
tcagtcgtcgctcgcacgaccggtgctcgatttagcagtactgcgttggggtttggggggggtcacaagaggcagcgctctcgggacgtctccaccatggcctgggctctgctgctcctcactctcctcactcagggcacgagggtcctgggcccagtctgccctgactcngcctgcctccgtgtctgggtctcccgggnagtcgtcaccatctntgcnctggatccagcgatgatattacggtacgttttaacttgtctccgtggtactacaacgaacaacaggaacaaacgaccccaaaattctttaattcgtaggtacgtacaatcacgcgaccctacaactattcgttaccagtcgtacttcctactcgactaacgtacctaaagttccgtacggactaaaacccgtacggttccctttaccgagtaaacctaacttcccttactaccctaaactccgaacggtactaggaaacgaacgtaacggtactttaacttttaacttacgtctaccttaccgccttaagtaccggtaacgtacgggttacgtacccgttaaccttttaggtttttttaccggttttacggggtttttacgggggacccgggtaacccgggggtaaaccctaacgggttaacgtaccggttaaaccgttcgggttacctaaccggtacgttaccggtaaacccggccccgtaaaacggttcccgtaacccccggttccccgtccggttaaccccg

SEQ ID NO: 2555 - DNA, 800 bp, Homo sapiens
  misc_feature: GYAE6OF01C26IU.21.87.H10.1.454.CMB.1.raw
  modified_base (457)..(457): a, c, t, g, unknown or other
  misc_feature (457)..(457): n is a, c, g, or t
tcagtcgtcgctcgcacgaccggtgctcgatttagcagtactgcgttgggtttgggggggggtcataagaggcagcgctctcgggacgtctccaccatggcctgggctctgctgctcctcactctcctcactcagggcacgagggtcctcgggcccagtctgccctgacctcgacgtcctcgtccgtcgtggtccggttcgggtcccgtcccgggacgtacggtccggtaccacctacgttccttcgttcggccgtcgtacggtacctaccgacggacgtagtagttaacgtttacggtttacggttttaaccgtttttaacttcggttcccttaccgttaggtaactaaccgaaaccaaccgaaccgaacggaaactaaaccccgtaaaccccttaaatttacttttaacgtttcgtacggtcctaactaaacgtcgtaccggaccctaccctaanacgttacgtttaccgttacgacgttactactttcctcgtacgactacgtaacgtacgtcgtacgaactaccggtccttacttcgaacacttaacttcctacctaacgaaccgttcgaccgtacgtaaacggaacggtacgttaagttacctttttaagttacttccgctttacctacgacgtacgtacgaggttacgttccgtacttttaacttttcggtttcgggtttacggttcgggacggtaacccgtcgttaggtacctccgggttacctaccggttcctacggtaactccgacccggttaaccgtcgggtcccctaccccgttcccgttacggtaccc

SEQ ID NO: 2556 - DNA, 630 bp, Homo sapiens
  misc_feature: GYAE6OF01EW1EY.21.87.H10.1.454.CMB.1.raw
tcagtcgtcgctcgcacgaccggtgctcgatttagcagtactgcgttgggtttgggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaactgtctcctggtatcaacaacaccaggacaaaacgccccaaaaactcttaattctggacgtcaatcagccgaccctcacattgtttccagtcattctctgcatccaagtctacggacaaacgacggtcctttcgtagaactaattcctaccgtactaactccaaggcttaagaacgacgaggtacttaatttaattaccgtgtaccttacctactaacgtacgacgtaagggtcggacctacgtttagttttttcgttagggtttttcgggccggtaccgggtaccctaaggtacttacggtaccgttcgttcccgtagtacgttccgaaccgtaccccgtaacggtacccgtccccggtacccccgttcggtaaccccg

SEQ ID NO: 2557 - DNA, 679 bp, Homo sapiens
  misc_feature: GYAE6OF01BF883.21.87.H10.1.454.CMB.1.raw
  modified_base (139)..(139): a, c, t, g, unknown or other
  misc_feature (139)..(139): n is a, c, g, or t
  modified_base (354)..(354): a, c, t, g, unknown or other
  misc_feature (354)..(354): n is a, c, g, or t
  modified_base (643)..(643): a, c, t, g, unknown or other
  misc_feature (643)..(643): n is a, c, g, or t
tcagtcgtcgctcgcacgaccggtgctcgatttagcagtactgcgttggggtttggggggggtcacaagaggcagcgctctcgggacgtctccacatggcctggctctgctgctcctcactctcctcactcagggcacngggtcctgggcccagtctgcctgactcagcctgcctccgtgtcgtcgggtcctcccgggctacggtccggtcaaccctattctcgttacgcgcttgggactccgaggtccgatgtattacgttcggtaactttttactgttccttcgtaggtactacaaactaaccaccgaaggtaaccaaaaccgtacccctaaaaattcctttaaatttccgngggtactacaacgtcacgccgtaccctacagtacttcgtttacccaggtcctaacttccgtctacgcctaactcgtaacgtcgaacggacctaaaccgtaccggttcctttacgacgaacctactccgtactaacctacctcgtacgacgtaacgaagacgtacggtactttaacttcttacgtctaccttctactacgtaacggcgtacggttacgtaccttacgttttagttttcggttcggtttacggcccgggtcgtaaccgtgttacgtcgtaccttgtaccgngtacgcgacggtccagtccgaccgtcccgtgtaccc

SEQ ID NO: 2558 - DNA, 725 bp, Homo sapiens
  misc_feature: GYAE6OF01DHE0X.21.87.H10.1.454.CMB.1.raw
  modified_base (548)..(548): a, c, t, g, unknown or other
  misc_feature (548)..(548): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacgagggtcctgggcccagtctcgccctgactcagcctgcctcgtgtcgtgggtcctccgggcagtccggtcacctattcctcgtgccgtctaggactccgagtcgatgtaattacgttggttaaccttttaacttgtctccgtagtatacctaaacaacaccgtaaggaaaccaaaccgtaacccctaaaaacgttactttaaacgtttctacgggtactactaaacgtccgaacgtcccgtaaccccttactaaccgtaagttttccgttacccgaggttacctacttttctccgtagtaccacttaccgtaaacgttcgtacgaacctaaccgtacccggttctttacgtcgaactacttccgtacctacaaccgtcacggtacgtagtaacggacgtacgtaacttntttaacttcctcgtaccttctacgtaacgtccgtacggtagtccggtaactttacgtttcgttttttacgttgggttttccgacgggtacccggtaactagtactcggtattccgtaacgtccgtaacgtccgtaaccggtacctaacccggccgttccccgtcccctccggtaccc

SEQ ID NO: 2559 - DNA, 647 bp, Homo sapiens
  misc_feature: GYAE6OF01CXZQS.21.87.H10.1.454.CMB.1.raw
  modified_base (188)..(188): a, c, t, g, unknown or other
  misc_feature (188)..(188): n is a, c, g, or t
  modified_base (195)..(195): a, c, t, g, unknown or other
  misc_feature (195)..(195): n is a, c, g, or t
  modified_base (212)..(212): a, c, t, g, unknown or other
  misc_feature (212)..(212): n is a, c, g, or t
  modified_base (218)..(218): a, c, t, g, unknown or other
  misc_feature (218)..(218): n is a, c, g, or t
  modified_base (248)..(248): a, c, t, g, unknown or other
  misc_feature (248)..(248): n is a, c, g, or t
  modified_base (294)..(294): a, c, t, g, unknown or other
  misc_feature (294)..(294): n is a, c, g, or t
  modified_base (403)..(403): a, c, t, g, unknown or other
  misc_feature (403)..(403): n is a, c, g, or t
tcagtcgtcgctcgcacgaccggtgctcgatttagcagtactgcgttgggtttgggggggtcacaagaggcagcgctctcgggacgtctccaccatggcctggctctgctgctcctcactctcctcactcagggcacagggtcctgggcccagtctgccctgactcagcctgcctcgtgtctgggtcncccgggnaggttcggcaccatctntgcgtntggatccagcatgatgtggtacttttactntctctgtacacaacacacaagacaaacgacccctaaatcttaatcncggtactacaatcacggcctacctacactacttcgtttaccgagttcgtaacttctactcgtactaactaccgtaacgtcgtaggacccttaaacgccggttacctttnacgactaactctacgtacacctcgagtacgtagaaacgtcgtagtctttaattacttaccgtctcctacgtactacttaccgcgtaacgtccggtacttacgttttacgttttcggtttacgggtttaccggaccgggtaccgggtacctacgggttactaccggtaccggtttacgaccctttcggacggttaaccaccgtaccggtaccgttacggtcccccgtacccggttcgttaccccg

SEQ ID NO: 2560 - DNA, 689 bp, Homo sapiens
  misc_feature: GYAE6OF01BAZ5M.21.87.H10.1.454.CMB.1.raw
tcagtcgtcgctcgcacgaccggtgctcgatttagcagtactgcgtttggggtttggggggggtcacaagaggcagcgctctcgggacgtctccaccatggcctggctctgctgctcctcactctcctcactcgagggcacgagggtcctgggcccagtctcgccctgactcagcctcgcctcgtgtcgtcgggtcctccggcacgtcgtacactatctcgttagcgctaggactccgagtcgatagacttagttacggttaccgttttaaccttgtcctctaggtactacaacacacaacggaacaaaccgacctaaaagttcttacttcgtcggtacgtacaagtcgacgtaccgtaacctataacgtacgtttcttactaacggtctacgttctacgtacactacgtacgaacgtcgtagaaccacgttacgttcttacgactaactactacctcctaacaaccgttacgaacggtacgtacggaaacgtacgggttaacttactttaagtttaccttacgtacgtaccttacgtactacgacgtacggtacgttacgtctttaacgtttagtttttcgttagggtttcggacggtaccggtaactaggtacttacggtacttcggtacttcggacgtaccgttaccgaccggttaacgcccgttacccgtcccgttggtaacccg

SEQ ID NO: 2561 - DNA, 790 bp, Homo sapiens
  misc_feature: GYAE6OF01DAKB4.21.87.H10.1.454.CMB.1.raw
  modified_base (181)..(181): a, c, t, g, unknown or other
  misc_feature (181)..(181): n is a, c, g, or t
  modified_base (256)..(256): a, c, t, g, unknown or other
  misc_feature (256)..(256): n is a, c, g, or t
  modified_base (380)..(380): a, c, t, g, unknown or other
  misc_feature (380)..(380): n is a, c, g, or t
  modified_base (687)..(687): a, c, t, g, unknown or other
  misc_feature (687)..(687): n is a, c, g, or t
  modified_base (726)..(726): a, c, t, g, unknown or other
  misc_feature (726)..(726): n is a, c, g, or t
tcagtcgtcgctcgcacgaccggtgctcgatttagcagtactgcgttggggtttggggggggtcacaagaggcagcgctctcgggacgtctccaccatggcctgggctctgctgcctcctcactcctcctcactcgagggccacgtagggtccgtcgggcccagtctcgccctgacctacncgtcctcgcctccgtgtcgtcgggtccgtccggctacggtcgtaccactctctctgcgcgtagactcgagacgtntgtagttagttcggtttacctttacgttcgtccttactgtaactaccaaacaaccgaaccgtaacggaaacctaaaccgaacctaaaacgtttctttaacgtttcgtaccggtactacgtaacnccgtacgtacccgacctactacttacgttcgttaccgactcgttactcgtcacgtacttacgacgtaacgtcgtacgactaaacgtccgtaacttcgaaactactactaccgtactacgtaaccgcggtaacgtacgtaaggaacgtacggttaacgtttacctttaatttaccggttacgtacccgtttaccgtaacccgtttaacgaaccggtttacggaaccggttttacggggtccttaacgttttacgtttttccggttttttacggggtttcccgggtaggggtccccggttaaacccggngtaaccgtttaggtaccggtttactaccggttaacccgngtaacgtcccgggacctaaccgggttaccgtacccctaccccgggtccccgttacggttccccg

SEQ ID NO: 2562 - DNA, 1053 bp, Homo sapiens
  misc_feature: GYAE6OF01EDCYN.21.87.H10.1.454.CMB.1.raw
  modified_base (156)..(156): a, c, t, g, unknown or other
  misc_feature (156)..(156): n is a, c, g, or t
tcagtcgtcgctcgcacgaccggtgctcgatttagcagtactgcgttggggtttggggggggtcacaagaggcagcgctcgtcgggacgtctccaccatggcctgggctctgctgctcctcactctcctcactcgaggcacgaggtcctcggcccngtctcgccctgacgtcacgtcctcgtccgtccgtcgttcgtcgggtccgtccgggctcggtcggtaccacctctcctcgttggcgtcgttaggacttccgagtaccgtagtaggtaacgtttacggtttacggtttaacccgttttttaaccgtttcgtacccgttccggttaacggttaacctaaaccgaaaaccccgtaaaccgaacccgtaaaccgggtaaaaccctaaaaacccccggtaaaccccttttaaaaaccttttacccgtttaaacgtttttccgggaccgggttaaccgttaacctaaacgttacccgaaccggtaccccgtaaccccttactaacttacggttttaccgtttaaccgtacgttacccggttaacctttccgttacccgttacgtaacccgtaaccgttaccgtaacggttacccggtacggaaccgttaaaaccccgttcccggttttaccgtttaacgtaccgtaaaccctttacgtttaccccgttaccttaaaccccggtaaacccgttaccggtaaccggggtaccgttaaacggaaacccgggttaacgttaaaccggttttacccgtttttaaagttttaacccgttccggtaaaccgtttccccgttaacccttacgtaccgtaaccgggtgggttacccgttaccggggttaccttttttaacccggtttttacggttttttttccgggggtttaccgggttttaccccgggtacccggggtaaccccggttaaaccgggttgtacccgggtttaccgttaccgggtttacccttccccgggagttaaccccccggttacgaaccccgggtaaaccccgtttcccggaccccccggttcttccccccgggttaaccgttccccccg

SEQ ID NO: 2563 - DNA, 683 bp, Homo sapiens
  misc_feature: GYAE6OF01BP2T1.21.87.H10.1.454.CMB.1.raw
  modified_base (255)..(255): a, c, t, g, unknown or other
  misc_feature (255)..(255): n is a, c, g, or t
  modified_base (561)..(561): a, c, t, g, unknown or other
  misc_feature (561)..(561): n is a, c, g, or t
tcagtcgtcgctcgcacgaccggtgctcgatttagcagtactgcgttggggtttggggggggtcacaagaggcagcgctctcgggacgtctccaccatggcctgggctctgctgcctcctcacctctcctcactcgagggcacgagggtcctcgggccctagtctcgaccctgactcacgcctgcctcggtgtcgtcgggtcctcccgggctacggtccggtaccaccattccttcttgccgcgtggactaccgngtcgatgtattagttcggtactttttacttgtctcgtgtactacaacaacgacaacgaacaaaccgtaccaaacttcttaagttcgacgtacgtacaacgtcacgccgaccttacactacgttcgttacaacgttcgttacttcgtcctagtctacgtacctaagtcgtacggtaccaaccgtacggtttccttacacgtacttacgtcctactacctaaccgtacgtacgggtctaagggaactacggtacgtactttacgttacttacctacgttcctctacgtacgactcggttacggacgtnttaccgtttttggttttaccggtttcgggtttacggcggtaccggtaccgtctacggtcgtcgttacgtccgtgtacgtccgaccgtaaccggcgttacccgtcccgttcccgtccgttacg

SEQ ID NO: 2564 - DNA, 738 bp, Homo sapiens
  misc_feature: GYAE6OF01CK4IF.21.87.H10.1.454.CMB.1.raw
  modified_base (201)..(201): a, c, t, g, unknown or other
  misc_feature (201)..(201): n is a, c, g, or t
tcagtcgtcgctcgcacgaccggtgctcgatttagcagtactgcgttggggtttgggggggggtcacaagaggcagcgctctcgggacgtctccaccatggcctgggctctgctgctcctcactctcctcactcagggcacagggtcctgggccagtctgccctgactcagcctgcctccgtgtcgtcgggtcctccgggnagtcggtcacctatcctctgcgcgtggactccagcgatgtattagtcggttacttttacttcgttctcgtaggtactacaacgtaaccaaccgacgtaaacaaaaccgacccctaaaacgttactttaacgtttccgtaggtaccgtactaactaccgtacgccggtaaccctactactaacttcgttactaacggtaccgtatttcctcttagtaccctacttaccgtaacgttacgtacggtaacctaaccgtaacggttcccgttttaacacgtaactaacctctactaaccgaaccttcgaacgtcgtaacggtaacgaacggttaggaacttttacgtttaacttacggtaccgtaccttacccgtagtaaccggttcgtaacggtaacggtccgtactttaacgttttcttttttacgggtttacgggtttcgggtcggtaccccgggtactaagtcgttaagtccgtacccgtcgttccgaacttaccgacccggtaccgacggtcccctaccgtcccccggtgttcccc

SEQ ID NO: 2565 - DNA, 771 bp, Homo sapiens
  misc_feature: GYAE6OF01E1WLG.21.87.H10.1.454.CMB.1.raw
  modified_base (147)..(147): a, c, t, g, unknown or other
  misc_feature (147)..(147): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtccngggcccagtctgccctgactcagcctgcctccgtgtctgggtcctcccgggcagtcggtcaccatctctgcgctgatccagcgatgtatagttgtacgttttaacctgtctactggtactcaacacacgagacaaacgcccaaaacttctaattctgctacaatccacgccgtacctcgaacacgttcgttccgaagttcgtaattcctctacgtacaacttacctaaaacgttccgaacggtactaaaacccgtaccgggttcccttttacgtaaggtaaccctaaacgttactaccctttaacccaaccttccgaacgggtcgtaacggaaacgacgtaaacggtacctttaaagttttaaccttaccgtcggtacccttaacccgtacctaacggtaccggtaccgtaacgggttacggtacccgtttaaaccgttttaaccggttttttcggtttttacggggttttttccggggaaccccgggggttaccgggtaaccccgtagtaaacgttaccgtaccgttaccgggttaccccttacgttaccgtaccccggtaaccgtaccccggtaaacgggtcccccgttacccggttcccccccgtaacccgggtttacccc

SEQ ID NO: 2566 - DNA, 838 bp, Homo sapiens
  misc_feature: GYAE6OF01C5ZAE.21.87.H10.1.454.CMB.1.raw
  modified_base (204)..(204): a, c, t, g, unknown or other
  misc_feature (204)..(204): n is a, c, g, or t
  modified_base (222)..(222): a, c, t, g, unknown or other
  misc_feature (222)..(222): n is a, c, g, or t
tcagtcgtcgctcgcacgaccggtgctcgatttagcagtactgcgttgggtttggggggatcacaagaggcagcgctctcgggactctccaaccatggcctgggctctgctgctcctcactctcctcactcgagggcacgagggtcctgggcccagtctgccctgactcagcctgccctcgtgtcgtcgggtcctccccggganacggtccgtccaaccgtnttcctcgttggccgtactggactccaggtcgattgattagttacggttaaccgttttaaccttcgttctcgttaggtactaacaaccaaccaaccgaaggaaaccaaaccgaacccctaaaacctttacctttaactttccgtacggtacctaactaacgtacaaccgtacccgtaaccctaccaactacttacgttacctacgttacgtactttacctactacgacctacgtaccgtaacgtcgtacgacctaacgtaccggttacctttacgtaacgtaactactaccttaccgtaacctaaccgtacggtaacggtacgttaaacgggaaaccggtaacggtaaccggttaacttttaacgtttaaaccgttaccgttaccgtacccttaccgtaccgtaacgttaccggtacggtacgggtacgttaactttaccggtttttacgttttttaccgggttcgggttttaccgggaccggggttacccggtaaacccggttaggtacggttacccggtaccggttaccggttccctaacggtacggttaaccccgggtaaccgaacccccggttacgggtccccggtttaccccccggtccccgtttaacccgg

SEQ ID NO: 2567 - DNA, 623 bp, Homo sapiens
  misc_feature: GYAE6OF01CRUID.21.87.H10.1.454.CMB.1.raw
  modified_base (121)..(121): a, c, t, g, unknown or other
  misc_feature (121)..(121): n is a, c, g, or t
  modified_base (175)..(175): a, c, t, g, unknown or other
  misc_feature (175)..(175): n is a, c, g, or t
  modified_base (219)..(219): a, c, t, g, unknown or other
  misc_feature (219)..(219): n is a, c, g, or t
  modified_base (323)..(323): a, c, t, g, unknown or other
  misc_feature (323)..(323): n is a, c, g, or t
  modified_base (328)..(328): a, c, t, g, unknown or other
  misc_feature (328)..(328): n is a, c, g, or t
  modified_base (344)..(344): a, c, t, g, unknown or other
  misc_feature (344)..(344): n is a, c, g, or t
  modified_base (410)..(410): a, c, t, g, unknown or other
  misc_feature (410)..(410): n is a, c, g, or t
  modified_base (431)..(431): a, c, t, g, unknown or other
  misc_feature (431)..(431): n is a, c, g, or t
  modified_base (437)..(437): a, c, t, g, unknown or other
  misc_feature (437)..(437): n is a, c, g, or t
tcagtcgtcgctcgcacgaccggtgctcgatttagcagtactgcgttggggtttggggggggtcacaagaggcagcgctctcgggacgtctccaccatggcctgggctctgctgctcctcnctctcctcactcgagggcacgacgggtcctcgggcccagtctcgccctgactcncgcctcgcctcgtcgtcgtcgggtccgccggctcggtcgtcacncttcctcgtcgctcgtaggactccgagtcgatgtattacgttacgttacgtttactgtcgtactgtacacaaacacacgagaacaacacctaattcttactcgngctanaagtcacgccacctancggtattcgtacctagtctattctctacgacacttacgaagtcgacgtactaacgtccgttcttanactactactctacgactaacncggganacgtagaacgtcgtacttacgttaatttacaccttcgtacccttcgaacgtcgtaacggtcgtagggtaccttacttagttttcgttttcggttcgggttcggcggtaaccgtaactggttaacgtcgtcctataaccttcggaacctacgctaccggtacgtcccgtaccgtacccttggtaccc

SEQ ID NO: 2568 - DNA, 760 bp, Homo sapiens
  misc_feature: GYAE6OF01CMH67.21.87.H10.1.454.CMB.1.raw
tcagtcgtcgctcgcacgaccggtgctcgatttagcagtactgcgttgggtttggggggggtcacaagaggcagcgctcgtcgggacgtctccaccatggcctggctctgctgctcctcactctcctcactcgagggcacgacgggtccgtcgggcccagtctcgccctgactcacgcctcgcctccgtgtcgtcgggtccgtcccggctacggtcggtaccaccgtacttcctcgttcgccgtcgtacggactccgagtcgagtagtacgttagtttacggttaaccttttaccgttcgtccttcgtaggtactaaccaaaacgtaaccaaccgtaacggaaccaaaaccgtaaccctaaaactttactttaacgttcgtacggtactaacgtaactaccgaccgccctaacctacgtaacttacgttaccgttaccgtacgtcgttaaccttcttacgacgtactacgtaccgaacgtcgtaccgtaacgtaccgtaccgttccttacgactaactactaccgtactacctaacgtcgacggtactacgaacggtcgtagttactttagttaactcgtactcttaccacgtacgtcgacgtacggttcgtactttacgttttacgtttcggtttgggttcccgggacggtaccggtacttaacggtacttaccggtacctcgttaacccgttgtaacccggaaccgacccgtaccgtaacccgggtccccgtacccggttccccgttccggtaacccg

SEQ ID NO: 2569 - DNA, 790 bp, Homo sapiens
  misc_feature: GYAE6OF01DMYRV.21.87.H10.1.454.CMB.1.raw
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacgagggtcctgggcccagtctgccctgactcagcctgcctcgtgtcgtgggtctcccgggctagtcggtcaccatctctgcgctggactccagcgatgattagttcggtaccttttaaccttgtcctcgtgtactaccaaccacaaccgaaggaaccaaaccgaacccctaaaactttctttaaacgtttcgtacggtccgtaactactaccgaccggaccctaccctactaaacgttcgtttaccgttaccgacgttaccgtatttccgtactacgtaacctaccgtaaccgttaacgtccgtacggaaccctaaccgttacccgttcctttacgtacgtaaacttaccttacccttaccaacccgttaaccgtccgtaagggtacctaacggtaaacggtacggtacgtttactttaatttaaccgttaccgtcgttacccttcccgtaactacggtaccggtacggtacggtacggttacctttaacggtttttacgttttttacggggttttacggggtttccggggaaccggggttaaccccggaacttacgggtacttaaccgtccggtttaccggtccgttaacgtaccgaccgtaccggtaacccggtaacgtccccgttaccccggccccgttggtaaccccg

SEQ ID NO: 2570 - DNA, 738 bp, Homo sapiens
  misc_feature: GYAE6OF01BRWM6.21.87.H10.1.454.CMB.1.raw
tcagtcgtcgctcgcacgaccggtgctcgatttagcagtactgcgttgggtttggggggggtcacaagaggcagcgctctcgggacgtctccaccatggcctggctctgctgctcctcactctcctcactcgagggcacgagggtcctgggcccagtctcgccctgactcagcctgcctcgtagtctgggtcctcccggctaggtccgtcaccattctcttgcgtcgtggactccgagcgattcgattacgttcggttaaccgtttttaccttgtaccttcccgttggtaactaccgaactaacccaccgaacggaaccaaaccgaccccctaaaacttcgtttaagtttccgtcggtaccgtactaacgtactaacggccgtaccctcactattccgttaccagtctacttctctcgactacgtacctacgtccgtacggactaacccgtaccgtttcctttacgtacgtactaacgttccttacctaccctaacgttcccgaagggttcccaaggtaaccggacgtacggtttacctttaagtttacttacccgcgttacctcccgttactaaccgtacgtcggtagggtcccgtaacttacgttttttacttttccgggtttagggtttccggggaccgtacccggtaccgttagtacgtaccgtacgttccgtacctccgtaccgtacgtaccgtaccgaccggttcccgtcccgtacccccgtcggtaccccg

SEQ ID NO: 2571 - DNA, 682 bp, Homo sapiens
  misc_feature: GYAE6OF02I1VRG.21.87.H10.1.454.CMB.1.raw
  modified_base (222)..(223): a, c, t, g, unknown or other
  misc_feature (222)..(223): n is a, c, g, or t
  modified_base (234)..(234): a, c, t, g, unknown or other
  misc_feature (234)..(234): n is a, c, g, or t
  modified_base (259)..(259): a, c, t, g, unknown or other
  misc_feature (259)..(259): n is a, c, g, or t
  modified_base (282)..(282): a, c, t, g, unknown or other
  misc_feature (282)..(282): n is a, c, g, or t
tcagtcgtcgctcgcacgaccggtgctcgatttagcagtactgcgttggggtttggggggggtcgacaagaggcaggcgccttctccgggacggtctcccaaccgacttcggcccttggggctctgctgcctcctcactctcctcgactccacgggcacgaagggtccgtggcccagtctggtccctgtactctagcctgcctcgtgtctgggtctcccggnngtcggtcaccntcggtcttgcgctggactccggacncgatgatcttggacgtttacctntctccgtgtctactaacaacacaggacaagcccaaactcgttaacttctggcgtccaaggtcgagcggaccctcgacactagttaccaaggtacgattcgtacgtgaccaaattaccaaggttcgtacggctaacgtacggaccgtttcctacgtaaccaacttacttccttaccaaactccgaacggacctacgaaacgtaccgacggtactttaatttactacgtcgtaccttcctactaacgtacccgtgacgggtcgtacctaacgttacttttttccggttgggttttttcggaccgggtaccgggttaaccctggtacgttacggtacttacggttccttacgacggttacggacggtcccggaaggccctaccggtcccccgttggttacccg

SEQ ID NO: 2572 - DNA, 536 bp, Homo sapiens
  misc_feature: GYAE6OF02GP5WX.21.87.H10.1.454.CMB.1.raw
  modified_base (373)..(373): a, c, t, g, unknown or other
  misc_feature (373)..(373): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaattctggcgtcaatcagcgaccctcacatgtttccagtcgattctctgcatccaagtctggcaacacggcctttcngacaatctctcaactccaggctgaagacgagctatttattactgctcctcatacgcaggtggctactattttttcttggtttttggcggtcgggtaccctagtacgtgtaccttgttccctctagttccacgcccgaaggtcctcggtcccccctcggtaccc

SEQ ID NO: 2573 - DNA, 540 bp, Homo sapiens
  misc_feature: GYAE6OF02GHR5P.21.87.H10.1.454.CMB.1.raw
  modified_base (305)..(305): a, c, t, g, unknown or other
  misc_feature (305)..(305): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatcccttgcgctggatccagcgatgatattggacgttttaacctgtctcctggtatcaacaacaccaggacaaagccccaaaactcttaaatttcnggcgtcaatcagcgaccctcacatgtttccagtcgattctctgcatccaagtctggcaacacggcctttctgacatctctacaactccagctgaagacgaggctattattactgctcctcatacgcaggtgcacgttatttttcgtttggtttttcggcggtcggtacccagtactgacgttgtacctcgagttccgagcccgaaggtcccgtacgccccctcggtacctacccg

SEQ ID NO: 2574 - DNA, 530 bp, Homo sapiens
  misc_feature: GYAE6OF02HO5JA.21.87.H10.1.454.CMB.1.raw
  modified_base (376)..(376): a, c, t, g, unknown or other
  misc_feature (376)..(376): n is a, c, g, or t
  modified_base (482)..(482): a, c, t, g, unknown or other
  misc_feature (482)..(482): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcaagcctgcctccgtgtctgggtctcccgggcagtcggtcaccgatctcttgcgctggatccagcgatgatattggacgttttaaccttgttctcctggtatcaacaacaccaggacaaagccccaaaactcttaattctggcgtcaatcagcgacctcacatgtttccagtcgattctctgcatccaagtctggcaacacggcctttcngacaatctctcaactccagctagaagacgaggtctaatttattactcgtactctcaatacgacaggtgcctactatttttcttgggtttttcggcggtcggacccngatcgactcgtcctgacgtcgacgcccaggtcctcgtccccgtggtcc

SEQ ID NO: 2575 - DNA, 526 bp, Homo sapiens
  misc_feature: GYAE6OF02HJQIZ.21.87.H10.1.454.CMB.1.raw
  modified_base (377)..(377): a, c, t, g, unknown or other
  misc_feature (377)..(377): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaatttctggcgtcaatcagcgaccctcacatgtttccagtcgattctctgcatccaagtctggcaacaccgtcctttcngacaatctctcaactccagctgaagacgaggctatttattactgctctctatacgcaggtgcacttatttttctttggttttggcggtcggacccagactggacttcgtcctcgacgtcacgtcccaaggcctcgtcccccgtggtccc

SEQ ID NO: 2576 - DNA, 518 bp, Homo sapiens
  misc_feature: GYAE6OF02IL5GA.21.87.H10.1.454.CMB.1.raw
  modified_base (375)..(375): a, c, t, g, unknown or other
  misc_feature (375)..(375): n is a, c, g, or t
  modified_base (399)..(399): a, c, t, g, unknown or other
  misc_feature (399)..(399): n is a, c, g, or t
  modified_base (428)..(428): a, c, t, g, unknown or other
  misc_feature (428)..(428): n is a, c, g, or t
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaaccttgtctcctggtatcaacaacaccaggacaaagccccaaaactcttaattctggcgtcaatcagccgaccctcacattcgtttccagttcgattctctgcatccaagtctggcaacacgcctttcngacatctctcaactcagctagaancgagcttaatttatactgctctcatacgnagggtgctactatttttccttgggttttcggcgggtccggaccctagtctggactgtcctcagtcacgcccaaggctcgccccctggtcc

SEQ ID NO: 2577 - DNA, 592 bp, Homo sapiens
  misc_feature: GYAE6OF02G315V.21.87.H10.1.454.CMB.1.raw
  modified_base (319)..(319): a, c, t, g, unknown or other
  misc_feature (319)..(319): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaactgtctcctggtatcaacacaccaggacaaagccccaaaatcttaattctggcgtcaatcagcgaccctnacatgtttccagtcgattctctgcatccaagtctggacaacacggtcctttctgacactctctaccactcccaggtctagaacgacgacgtcttaatttattactcgtctcctacactacgacgtaggtcggtctacgttacgttttttcgtttgggtttttcggcgggtacccgggtacccgtagtacgttacggtaccgttcgttacccgtacgtacgtacgtaccggacccgtaacgggtcccgttacccgtcccccgtcggttaccccg

SEQ ID NO: 2578 - DNA, 677 bp, Homo sapiens
  misc_feature: GYAE6OF02GCWGY.21.87.H10.1.454.CMB.1.raw
  modified_base (316)..(316): a, c, t, g, unknown or other
  misc_feature (316)..(316): n is a, c, g, or t
  modified_base (336)..(336): a, c, t, g, unknown or other
  misc_feature (336)..(336): n is a, c, g, or t
  modified_base (341)..(341): a, c, t, g, unknown or other
  misc_feature (341)..(341): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtcgtgggtcctccgggcagtcggtcaccatctcttgcgtctggactccagcgatgattagttggtaccttttactgtctccgtggtactacaactaacaccaggaaccaaacgcccccaaaacttcttaattcgnggctacaatcacgccacctnaactnttcgttaccagtcgtattcctctgacctagtccctaaggttcgtaggacctaacgtaccggtcctttcgtacgaactacgttcctactaccaacctccgtaggcctaggaacgacgtacggtctttaaagtttactacgtcgtccttaccgtactacgtaccgtactacgggttcgtacccttaacgttttacgttttttcgggttttacgggttttcgggacccgggttaccgggtaaccctaggttcgttaccggtaccgttccgttcccgttaccgtacgtcccgaacggtaccccgtaaggtcccttccccggtcccccgttacggttaccc

SEQ ID NO: 2579 - DNA, 533 bp, Homo sapiens
  misc_feature: GYAE6OF02JH7FT.21.87.H10.1.454.CMB.1.raw
  modified_base (324)..(324): a, c, t, g, unknown or other
  misc_feature (324)..(324): n is a, c, g, or t
  modified_base (377)..(377): a, c, t, g, unknown or other
  misc_feature (377)..(377): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacacaccaggacaaagccccaaaactcttaatttctggcgtcaatcagcgaccctnacatcgtttccagtcgattctctgcatccaagtctggcaacacggtcctttcngaacaatctctcaactccaggctagaagacgagtcttatttacttactgcctcctcatacgcaggtcgctacttatttttccttgggttttcggcggtccgggaccctagtactgtactgtcctgtacgtcacgcccgaagcctcgcccctggtcc

SEQ ID NO: 2580 - DNA, 548 bp, Homo sapiens
  misc_feature: GYAE6OF02GJFHS.21.87.H10.1.454.CMB.1.raw
  modified_base (326)..(326): a, c, t, g, unknown or other
  misc_feature (326)..(326): n is a, c, g, or t
  modified_base (367)..(367): a, c, t, g, unknown or other
  misc_feature (367)..(367): n is a, c, g, or t
  modified_base (377)..(377): a, c, t, g, unknown or other
  misc_feature (377)..(377): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaactcttaaatttctggcgtcaatcagcgaccctnacatgtttccagtcgattctctgcatccaagtctggcaacncggcctttcngacatctctcaactcagctgaagacgaggcttatttattactgtcctcctcatacgcaggtcgctacttattttttcgttgggtttttggccgggtcggacctagtcgtacggtaccgttcctacggtcacgtacccaacggcctccgcccccgtcggtcccacgttcccg

SEQ ID NO: 2581 - DNA, 547 bp, Homo sapiens
  misc_feature: GYAE6OF02FP5XE.21.87.H10.1.454.CMB.1.raw
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacaacaccaggacaaagccccaaaatcttaattctggcgtcaatcagcgacctcacatcgtttcagtcgattctctgcatccaagtctggacaacgcggtcctttctcgactaatctctactaactccaggtctagaacgacgaggtacttatttacttactgtctcctactatacgcgtaggtcgactacttactttttcgttggttttcggcggtcgggacctagactcgtactgtcctcgtacgtcgacgccgtaaggctccggtccccgtcgtcc

SEQ ID NO: 2582 - DNA, 613 bp, Homo sapiens
  misc_feature: GYAE6OF02ITNK9.21.87.H10.1.454.CMB.1.raw
  modified_base (198)..(198): a, c, t, g, unknown or other
  misc_feature (198)..(198): n is a, c, g, or t
  modified_base (219)..(219): a, c, t, g, unknown or other
  misc_feature (219)..(219): n is a, c, g, or t
  modified_base (383)..(383): a, c, t, g, unknown or other
  misc_feature (383)..(383): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcnctggactccagcgatgatagttggacttttaccttgtctcctggtactcaacaacacaggacaaacgaccccaaaactcttaatttcgtgcgtacaatcagaccgaccctcacatcgtttccagtcgattctctgcattccaagtctggacaacgacgtccttnacgactaatctctcaacttccgaagtctagaacgacgtacggtacttagtttaacttacttcgtccttaccttacaacgttaacggtacggttacggactacctttaagtttttcgtttagggtttttcggcgggtaccggtacctagtacgttcggtaacctcgttacctcgtaacgttaccgaccgaccgtaacggtccttccggacccccgtttcggtacctacccg

SEQ ID NO: 2583 - DNA, 638 bp, Homo sapiens
  misc_feature: GYAE6OF02FUJOV.21.87.H10.1.454.CMB.1.raw
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggtacgttttaaccttgtctcctggtatcaacaacaccaggacaaacgccccaaaactcttaattctggcgtacaatcagccgaccctcactattcgtttccagtcgtattctactgctactaccaagttctggaccaacgaccggtccctttactcgaactaactcctactaccaacctccaggtctagaaacgtacggaggtacttaagtttaatacttcgtccttaccttactaacgttacgcgtagggtcgacctaacttacgttttttccgtttagggtttttcggaccggggtaccggtaacccgtaggtacgttacggtacgtttccgttacccttacgtacgtccaccggacccgtaacgggtcccttcccggtaccccccgttcgggtaccc

SEQ ID NO: 2584 - DNA, 553 bp, Homo sapiens
  misc_feature: GYAE6OF02HI5LL.21.87.H10.1.454.CMB.1.raw
  modified_base (320)..(320): a, c, t, g, unknown or other
  misc_feature (320)..(320): n is a, c, g, or t
  modified_base (375)..(375): a, c, t, g, unknown or other
  misc_feature (375)..(375): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaacctgtctcctggtatcaacaacacaggacaaagccccaaaatcttaattctggctcaatcagccgaccctnacatcgttccagtcgattctctgctatccaagtctggacaacaccggtcctttcngaacaatctctcaactccgaggctagaacgacgagcttaatttacttactgtcctcctcattacgctaggtcgctacttactttttcgttgggttttcggccggtaccggtaccctagtacgttcgtacttcgtcctcgtagtccgacgcccgaaggtcctccgtccccgtggtaccc

SEQ ID NO: 2585 - DNA, 670 bp, Homo sapiens
  misc_feature: GYAE6OF02IC5M0.21.87.H10.1.454.CMB.1.raw
  modified_base (300)..(300): a, c, t, g, unknown or other
  misc_feature (300)..(300): n is a, c, g, or t
  modified_base (309)..(309): a, c, t, g, unknown or other
  misc_feature (309)..(309): n is a, c, g, or t
  modified_base (323)..(323): a, c, t, g, unknown or other
  misc_feature (323)..(323): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctccgggcagtcggtcaccatctctgcgctggatccagcgatgatattggacttttacttgtctctgtatcaacaacacaaggacaaacgacccaaaacttcttaatttcnggtacgtanaatcagccaccctnacattcgtttccagtcgtattctactgacacttaccaagttcctagggtaccaaaccgtacggttcccttttacacgtaactaaactccttctacctaaccttccgacggtacgtacgaaacgacgtaggtacttaaattttaacttactacgtacccttacctacaacgttacgtaccgtacgggttcgaaccgttacctttaacgttttttcgtttcgggttttttacgggccgggttacccggggacccgtaggttacgttcggtaaccgttacggttccttaccgtacgtaccgtacggacccgtaaccggtcccgttacccggtcccccgttcggtaccccg

SEQ ID NO: 2586 - DNA, 520 bp, Homo sapiens
  misc_feature: GYAE6OF02FHN8B.21.87.H10.1.454.CMB.1.raw
  modified_base (345)..(345): a, c, t, g, unknown or other
  misc_feature (345)..(345): n is a, c, g, or t
  modified_base (374)..(374): a, c, t, g, unknown or other
  misc_feature (374)..(374): n is a, c, g, or t
  modified_base (384)..(384): a, c, t, g, unknown or other
  misc_feature (384)..(384): n is a, c, g, or t
  modified_base (416)..(416): a, c, t, g, unknown or other
  misc_feature (416)..(416): n is a, c, g, or t
  modified_base (439)..(439): a, c, t, g, unknown or other
  misc_feature (439)..(439): n is a, c, g, or t
  modified_base (488)..(488): a, c, t, g, unknown or other
  misc_feature (488)..(488): n is a, c, g, or t
tcagtcgtcgctcgcacgaccggtgctcgatttagcagtactgcgttgggtttgggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacttttaactgtctcctgtatcaacaacaccaggacaaacgccccaaaactcttaatttctggctcaatcagccgaccctcactatcgtttccagtcgattcctntgcatccaagtctggacaacgcgtccttngaacatctcncactcagctgaagacgagcttaatttatactnctctcatacgcaggtgctacttnttttttcgttggtttttggcggaccggacctagctgtacttcgtcctangtaccacgacccaggcctccgccccgtgtccc

SEQ ID NO: 2587 - DNA, 596 bp, Homo sapiens
  misc_feature: GYAE6OF02IU7ML.21.87.H10.1.454.CMB.1.raw
  modified_base (198)..(198): a, c, t, g, unknown or other
  misc_feature (198)..(198): n is a, c, g, or t
  modified_base (472)..(472): a, c, t, g, unknown or other
  misc_feature (472)..(472): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggnagtcggtcaccatctcttgcgctggatccagcgatgatagttggaccgttttaacctgtctccgtgtatcaacacacagacaaacgcccaaatcttaattcgtggctacaactcacgccgaccctcactagttcgttccagtcgtattctctgctactaccaagtcgtagacaacgtacggtccctttacgacgaactactctacctacaacctccgaggtacctaggaacgacgtacgtactttatttactactcgtcctacctacactacgngtaggtcgtactactttacttttcgtttggttttcggaccgggtccgaccgtagtacgtacggtacttcgtccgtacgtacgtaccgacgtacccgtaggtccctccggtcccccgtaggtccc

SEQ ID NO: 2588 - DNA, 669 bp, Homo sapiens
  misc_feature: GYAE6OF02IA2ON.21.87.H10.1.454.CMB.1.raw
  modified_base (290)..(290): a, c, t, g, unknown or other
  misc_feature (290)..(290): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacaggggtcctgggcccagtctgccctgactcagcctgcctccgtgtctgggtctccgggcagtcggtcaccatctcttgcgctggatccagcgatgatattggacttttaacttgtctctgtatcaacaacacaggacaacgcccaaaactnttaattctggctacaatcacgccgaccctcacattcgttccagtcgtattctctgacatccaagtcaggaccaactaccggtcctttcagtaaccaacttcctacctaccaaaccgttccgaggtcctaggaacgtaccggtaaggtacttaattttaacgtttactcgtaccttaccctacgtaacttaccggaccgtaagggttccgtaccgttacgttttacgttttttttcggttttcggggtttttacgggcccgggttacccgggtaccctaggttacgttacggtaccgttcggttacccttacgtaaccggtacccgtaccggacccggtaaccggtcccgtttccccggtacccccccgtggttaccccg

SEQ ID NO: 2589 - DNA, 683 bp, Homo sapiens
  misc_feature: GYAE6OF02FV8PC.21.87.H10.1.454.CMB.1.raw
  modified_base (197)..(197): a, c, t, g, unknown or other
  misc_feature (197)..(197): n is a, c, g, or t
  modified_base (318)..(318): a, c, t, g, unknown or other
  misc_feature (318)..(318): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctccgggnagtcgtcaccatctctgcgctggatccgagcgatgattagttggtaccttttaacctgtctcctgtatcaacacacagacaacgacccaaatcttaattctgcgtcaatcacgccaccctnactacttcgttaccagtcgtattctctgactactcctaagtcgtacgaccaaccgtaccggtcctttcgacgaactaacttccttacctacctaacctccgtacggacttacggaaacggacggtaacggtactttaagttttaacttacgttactccttaccttactaaccgtacggtacgtacgggttcgtaccttaccgttttacgtttttttccgttttacgggtttttcgggaccgggttacccgggtaaccgtaggttacgttaccggttacgttccgttacccgtaccgtaccggttaccgtaacccggtacccgtaaccgggtccctttccccggtaccccccggttccgttacccg

SEQ ID NO: 2590 - DNA, 592 bp, Homo sapiens
  misc_feature: GYAE6OF02F77CH.21.87.H10.1.454.CMB.1.raw
  modified_base (302)..(302): a, c, t, g, unknown or other
  misc_feature (302)..(302): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggacgttttaaccttgtctcctggtatcaacacacaggacaaacgcccaaaactcttaattcnggctacaatcagccgaccctcactattcgttccagtcgtatttctctgcactccaagttctaggacaaacgccggtcctttcacgaactacttctctacaacctccgaggtctagaacgacgtaggtacttagtttactactcgtacctcctctaatccgcgtaggtcgaccttactttacgttttttcgtttgggtttttcgggcgggtaccggtacctgtactggtacttcgttcctcgtacgttccgacgtacccgaaggtccctccggtcccccgttcggtacccg

SEQ ID NO: 2591 - DNA, 745 bp, Homo sapiens
  misc_feature: GYAE6OF02GW7M1.21.87.H10.1.454.CMB.1.raw
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcagtcggtcaccatctcttgcgctggatccagcgatgatattggtacttttactgtctctggtatcaacaacaccagacaaacgcccaaaactcttaattctggcgtacaatcagccgaccctcactattcgtttccgagttcgactttctcgtacgactactaccgtaacgttccgtagggacctaaaccgtaccgggttcccttttaccgtacgtaaaccttaacttacctacccttacccgtaaaccgttcccgtaacggtaccgtaacggaaacggtaccggtaacgggtacctttaaacttttaacgttaaccgttggaccctttacccttaaccgtacgttaacccggtccggttaacgggtacggtaccttaaaccgtttttacgtttttttccggttttacggggtttttttacgggacccgggttaacccgggtaaccgttacggtacgttacggtaaccgtttcggtacccttcgtacggttaccgtaccgtacccggtaacggttacccgtccggttacccccggtacggttacccg

SEQ ID NO: 2592 - DNA, 599 bp, Homo sapiens
  misc_feature: GYAE6OF02HVGJ1.21.87.H10.1.454.CMB.1.raw
  modified_base (182)..(182): a, c, t, g, unknown or other
  misc_feature (182)..(182): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtntctgggtctcccgggcagtccggtcaccatctcttgcgctggatccagcgatgatattggacttttaacttgtctcctgtactcaacaacaccaggaacaaacgacccctaaaactctttaaacttcgtggacgttacaaactcgaacgccgaccctcaactacgttcgtttaccagtcgtactttctctgactatccaaagtctacggacaacgacggtcctttcagactaatctctacactcagctagaagcgaagtcttaattattacgtctcttacctactactacgacgtacgtgacctacttactttttcgtttgggttttcggacgggtccggtacctagtactacggacttacgtcctacgtacgttaccgacgacccgtaaggtccctacccgtccccgttggtaccc

SEQ ID NO: 2593 - DNA, 702 bp, Homo sapiens
  misc_feature: GYAE6OF02IR9Y8.21.87.H10.1.454.CMB.1.raw
  modified_base (519)..(519): a, c, t, g, unknown or other
  misc_feature (519)..(519): n is a, c, g, or t
tcagtcgtcgctcgcacgaccggtgctcgatttagcagtactgcgttggggtttgggggggggtcacaagaggcagcgctctcgggacgtctccaccatggcctgggctctgctgctcctcactctcctcactcagggcacgagggtcctgggcccagtctcgccctgactcagtcctcgccctccgtgtcgtcgggtcctcccgggcaggtccggtcaccatctcttgccgtcgtggactccgagcgatgattagttggtacttttacttgtctctgtatacacaacaccaggaacaaacgaccccaaacttcttaactttctcggacgtactaactcagccgaccctaccactacttcgttaccagttcgactttctctacgtctactacctaacgttcgtacggacgaaccgaccgtaccctttctagtaacctaacttccctactaccaacctcctaacggtctaaggaaacggacgtaggtactttaagtttactttactacgttaccttaccnctaacgtacccgacggtaggtacggtacttaacgtttacgtttttttccgggtttgggttttcgggtaccgggtacccgggtaccgtacggtacttacggtaccggttccggttccgttacgaacgggttccaaccggtaccccggaaggttccccgccccggttcccccgtcgggtaacccc

SEQ ID NO: 2594 - DNA, 778 bp, Homo sapiens
  misc_feature: GYAE6OF02JG72M.21.87.H10.1.454.CMB.1.raw
  modified_base (199)..(199): a, c, t, g, unknown or other
  misc_feature (199)..(199): n is a, c, g, or t
  modified_base (210)..(210): a, c, t, g, unknown or other
  misc_feature (210)..(210): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacgagggtcctgggcccagtctgccctgactcagcctgtcctcgtgtctgggtcctccgggnagtcgtcaccntctctgcgctggactccagcgatgatagttcggtaaccttttaaccttgtccttccgtggtactaccaaacaaccaccgaggaaccaaaacgacccctaaaacttctttaatttcgtggtccgtacaatcacgccgaccctcactattcgtttaccagtcgtattctctgactatacctaagtcgtcggaccaaacgtcccggttcccttttacgacgtaactaacgtttccttacctaacccgaaaccttcccggtaaggtaccgttaacgggaaaacggtaaccggtacgggttaccttttaaattttaacgttttaccgtcggtcccttacccgttactaacgtttaccggacgttacggggttacgacccgtttaacgtttttacgttttttttacggtttttcgggggttttttaccgggcccggggttacccggggttaaccccgtaggttaacgttccggttaaccgtttcggttaccccgttacgtaacggtttaccgaacccggtaccccggtaagggttcccccgttcccgggttacccccccgttcgggttaacccc

SEQ ID NO: 2595 - DNA, 729 bp, Homo sapiens
  misc_feature: GYAE6OF02HQ77X.21.87.H10.1.454.CMB.1.raw
  modified_base (549)..(549): a, c, t, g, unknown or other
  misc_feature (549)..(549): n is a, c, g, or t
tcagtcgtcgctcgcacgaccggtgctcgatttagcagtactgcgttgggtttgggggggggtcacaagaggcagcgctctcgggacgtctccaccatggcctgggctctgctgctcctcactctcctcactcagggcacgagggtcctgggcccagtctgccctgacctcagcctgcctcgtgtcgtgggtcctcccgggctacggtccggtcaccactccttcttgcgtctggactccgagcgatgattagttcggtaacttttaacttgtcctctaggtactacaaactaacaaccgaggaaccaaacgacccctaaaactacctttaattcgtaggtctacaatcacgccgaccctcgaactacttcgtttaccagttacgtatttcctcgtacgctaacgttacctaacgttcgtacggacctaaaccgtccggttacccttttcgtacgtaacctaacttccgttacctaaaccctaaacgttcccgaagggtccctaagggtaaacgacggtaaggtaccttttaattttaactccgttacncccgtttcctaatacgttaaccgacggtaacgggttcaacctttagttttacgtttttttcggtttcggggtttaggacccgggtacgggtaccctagttcgtaccgtacgttccggtaccttacgacggttccgaacggtacccgagggttcccctaccggtccccgtgggttaacccc

SEQ ID NO: 2596 - DNA, 579 bp, Homo sapiens
  misc_feature: GYAE6OF02HRYSG.21.87.H10.1.454.CMB.1.raw
  modified_base (301)..(301): a, c, t, g, unknown or other
  misc_feature (301)..(301): n is a, c, g, or t
  modified_base (374)..(374): a, c, t, g, unknown or other
  misc_feature (374)..(374): n is a, c, g, or t
  modified_base (386)..(386): a, c, t, g, unknown or other
  misc_feature (386)..(386): n is a, c, g, or t
  modified_base (404)..(404): a, c, t, g, unknown or other
  misc_feature (404)..(404): n is a, c, g, or t
  modified_base (410)..(410): a, c, t, g, unknown or other
  misc_feature (410)..(410): n is a, c, g, or t
  modified_base (423)..(423): a, c, t, g, unknown or other
  misc_feature (423)..(423): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacgagggtcctgggcccagtctgccctgactcagcctgcctccgtgtctgggtctcccgggctagtcggtcaccattctcttgccgctggatccagcgatgatagttggtacttttaactgtctcctgtatcaacacacagacaacgacccaaatcttaattcngcgtcaatcagcgacctcactatcgtttcagtcacttctcgtgcataccgtatcgtgacaacgccgtctttcngaactactctcncaacgtcagctagaacgnacggtnttaatttacttancgtcctctagctacgcgtagtcgacttaccgtttgttttttccgttttgggttcggacccgggttaccgtaacccgtagttaacgttccgaacgtttccgtccgtacgtagtcccaacggtaccctaggttcccctcccggtacccgttcgtaccc

SEQ ID NO: 2597 - DNA, 709 bp, Homo sapiens
  misc_feature: GYAE6OF02GWOA3.21.87.H10.1.454.CMB.1.raw
  modified_base (199)..(199): a, c, t, g, unknown or other
  misc_feature (199)..(199): n is a, c, g, or t
  modified_base (213)..(213): a, c, t, g, unknown or other
  misc_feature (213)..(213): n is a, c, g, or t
  modified_base (345)..(345): a, c, t, g, unknown or other
  misc_feature (345)..(345): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgcctccgtgtctggtcgtccgccggngtcggtcgtcactntctcgtcgcgtgtgtctacgacgacgtatagtattacggttacggtttaccttttacgttctccgtcgtagtacaaccaacacacgacgaacaacccaaacctaacttacgttacttcggcgtactactacncgacgtaccctacctacattcgttaccttacgtacgtacttcttcgtacgtctaccgtctaacggtacgttcgacgaacctaacggtcctttcgttacgaactactaccgttcctaccctaaccgtaccgacgtacgtcgtaacgacggtacgtcgtttaactttaacgtttactcgtacccgttctaccgaacgttaacgccggtacggtttacgggtacctaaccttttagttttttacgggttttttcgggtttacggggtccgggacccgtacggttacagtttcggtccttagtttcccgtactacggtcaacccggtcggttaaccggtaccgtcccggttacccctacccgggttcc

SEQ ID NO: 2598 - DNA, 716 bp, Homo sapiens
  misc_feature: GYAE6OF02JP9HC.21.87.H10.1.454.CMB.1.raw
  modified_base (205)..(205): a, c, t, g, unknown or other
  misc_feature (205)..(205): n is a, c, g, or t
  modified_base (311)..(311): a, c, t, g, unknown or other
  misc_feature (311)..(311): n is a, c, g, or t
tcagtcgtcgctcgcacgaccggtgctcgatttagcagtactgcgttgggtttggggggggtcgtacgaagagggcagcgctctcgggacgtctccaccatggcctgggctctgctgctcctcactctcctcactcagggcacgagggtcctaggggcccaggtctgccctgactcagcctgcctcgtgtctgggtcctccgggnaggtccggtcaccatctcttgacgctggactccagcatgtatattggtacttttaacctgtctccgtgtatcaacacacaggacaacgccaaaactctaattcagngtacatcgagtccgaccctacactaacgtcgtttacccgaagttccgtattccgttctagtaccctagttaaccaaggttccgtcggtacccaaaacgttcccggttcctttacgaacggtaccaaacttccttacgtaccctaaacgttcccaggggtacccttaagggaaaccgtacgggtaacggttacgtttaaactttaacgtttaaccgtacgtacccgtttacgttaccaacgtttaccggacgtaacggggttacgtacctaacggtttacttttttccggtttaagggttttccggaaccgggtcgggtacccgttagtagtcgtaaccgttaccgttcgtaacgttccggtacacccggtcggtaacgtccgttcccggtccccgttacgttccg

SEQ ID NO: 2599 - DNA, 599 bp, Homo sapiens
  misc_feature: GYAE6OF02IFMBA.21.87.H10.1.454.CMB.1.raw
  modified_base (225)..(225): a, c, t, g, unknown or other
  misc_feature (225)..(225): n is a, c, g, or t
  modified_base (264)..(264): a, c, t, g, unknown or other
  misc_feature (264)..(264): n is a, c, g, or t
  modified_base (321)..(321): a, c, t, g, unknown or other
  misc_feature (321)..(321): n is a, c, g, or t
  modified_base (329)..(329): a, c, t, g, unknown or other
  misc_feature (329)..(329): n is a, c, g, or t
  modified_base (336)..(336): a, c, t, g, unknown or other
  misc_feature (336)..(336): n is a, c, g, or t
  modified_base (443)..(443): a, c, t, g, unknown or other
  misc_feature (443)..(443): n is a, c, g, or t
  modified_base (464)..(464): a, c, t, g, unknown or other
  misc_feature (464)..(464): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcgagggcacgagggtcctgggcccagtctgccctgactcagccttgcctccgtgtcgtggtcctccgggctaggtcggtcaccatcctcttgcncgtggactccagcgatgatagttcggtaacttttacttntctcttgtactacaacaacacgagacaaacacccaaacttcttaattctcggactanaactcacncgacctnactattcttccgagttccgtattcctactcgcctaacgtccaagtcgtacgacctaactacggtcctttcacgtacacttctactacactcgagtcagacgagagtntttattactactgtcctctanacttagctacggtcgtactacttttattttttcgtaggttttcgggccgtacggacccgtgtagtacgtcgttacggtctaacgttcgtacgtaccgccggtaacggtccttacccggtcccccgttggttaccc

SEQ ID NO: 2600 - DNA, 918 bp, Homo sapiens
  misc_feature: GYAE6OF02I5DZW.21.87.H10.1.454.CMB.1.raw
tcagtcgtcgctcgcacgaccggtgctcgatttagcagtactgcgttgggtttggggggtcacaagaggcagcgctctcgggacgtctccaccatggcctgggctctgctgctcctcactctcctcactcagggcacagggtcctgggcccagtctgccctgactcagcctgcctcgtcccgtcgtgggtccgtcccgggcacgtcggtccacctactcttcgttgcgtctggactccgagcgatgattagttcggtaacgttttaaccttgtcctccgtggtactaccaaaccaaccaccgaacggaaccaaaaccgtaaccccctaaaaacttacctttaaacgttttcgtacggtaccgttaccaaacgttaccgaacggacccgtacccctacaaccttacgtttaccgttttacccgaacggtttaccgtaacttttccgttacgttacgtacctaaaccgttacccgtaaacggttccgttacggggtaaccctaaacccggtacccggtttacccttttaccgtaaccgtaaacctaacgtttcccttaacccttaacccgtaaacccgtttacccggaaacgggttccgtaaacgggtaaaaccggtaaccgggtaaccggtttaccttttaaaacgttttaccgtttacccgttacggttccctttacccgtactaaccgttaaccggtaccgtaacggggttccgtaacccgttttaacgtttttaccggttttttttcgggtttttaccggggtttttaccggggacccgggggttaacccggggtacccgtaggttacggttaccggttaacccggtttcggtacccttacggtaccgtaccggttaacccggaccggttaacccgggttcccgtaccccggttccccgggttaccggttaccccg

SEQ ID NO: 2601 - DNA, 593 bp, Homo sapiens
  misc_feature: GYAE6OF02GERQO.21.87.H10.1.454.CMB.1.raw
  modified_base (200)..(200): a, c, t, g, unknown or other
  misc_feature (200)..(200): n is a, c, g, or t
  modified_base (346)..(346): a, c, t, g, unknown or other
  misc_feature (346)..(346): n is a, c, g, or t
  modified_base (431)..(431): a, c, t, g, unknown or other
  misc_feature (431)..(431): n is a, c, g, or t
  modified_base (546)..(546): a, c, t, g, unknown or other
  misc_feature (546)..(546): n is a, c, g, or t
tcagtcgtcgctcgcacgaccggtgctcgatttagcagtactgcgttgggtttgggggggggtcacaagaggcagcgctctcgggacgtctccaccatggcctgggctctgctgctcctcactctcctcactcagggcacagggtcctgggcccagtctgccctgactcagcctgcctccgtgtctgggtctcccgggcngtcggtcaccatcctcttgcgctggatccagcgatgatagttggtacttttaaccttgtctcctggtatcaacaacacaggacaaacgcccaaaatcttaattctggctacaatcacgcgacctcactatcgttcaagtctattcnctgcactcaagtctcgacaacacgtcctttcacgaactatcctctacacctcgagtcgtagaagacggagtcttattactacgtncctactactagtacgagtacggtgtactacttttacgtttttcgttgggttttacggccggtacgggtaacccaggtacttaggtaacgttcgttaccgtacgtacggttaaccnccggttaacccgaacggttcctacccggtcccccgttagtaaccccg

SEQ ID NO: 2602 - DNA, 711 bp, Homo sapiens
  misc_feature: GYAE6OF02JD3YE.21.87.H10.1.454.CMB.1.raw
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacgagggtcctgggcccagtctcgccctgactcagcctgcctccgtgtctgggtcctcccgggctagtccggtcaccatctcgttgcgctggactccagcgatgattagttcggtacgttttaaccttgtctcctggtatacaacaacacaggaactaaacgacccaaacttcttaattcgagtcctacaatcacgaccgacctcactatcgtttacgatacgtacttcgtactcgtactaacttccgtaaagttccgtacggacctaaaccgtaccggttcccttttacgacgtaaccgtaactcttaccctaccgtaaccgtacccgtaaggtcgtaaacggtaagaccgggtacgttaacttacgtttaagttacccgtcgtaccttccttacaacggtaacgtcggtaagtccgtaccgttattttacgtttttcgttttcgggtttaccggaccggtaccgggtaaccctaggtacgttaccggtacgttcccgttaccgtaacgttaccgtaccggtaaccggtacccgttaacgggccccgttccggtacccccggttacggttccc

SEQ ID NO: 2603 - DNA, 685 bp, Homo sapiens
  misc_feature: GYAE6OF02IBDYT.21.87.H10.1.454.CMB.1.raw
  modified_base (215)..(215): a, c, t, g, unknown or other
  misc_feature (215)..(215): n is a, c, g, or t
  modified_base (242)..(242): a, c, t, g, unknown or other
  misc_feature (242)..(242): n is a, c, g, or t
  modified_base (248)..(248): a, c, t, g, unknown or other
  misc_feature (248)..(248): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacgacgggtcctgggcccagtctgccctgctcagcctcgccctcgtcgtcgtcggtcccgtccggactcggtcgaccnctctcttcgtcgcgtcgtacgtcacgngacgtntatacgttagtaccggttttaacttacgttcgttctcgtcgttacacaacaaccacgaacggaaacaaccgaaccctaaacttacttaacttcgaggtcctaactaactcgacgtaccaaccctacaacttctttaccgttacgtactctatttcctgttacacgtactacgtacgtacgtactacaccgttacgtccttagacttactactaccgttctaactaccgtacgacgtacgtaacggaacgtaaccggtacgttactttaacgttacgttacctgtccctactacgtaacgttacgacgtttacgggctagttaccgttttcgtttttaggttcgggttcggaaccggtaccggacttagaccggttctaccggtctacggtacttaccgacggaccaccgtacgtccggtttcccgcccgtgttaccc

SEQ ID NO: 2604 - DNA, 663 bp, Homo sapiens
  misc_feature: GYAE6OF02H74N2.21.87.H10.1.454.CMB.1.raw
  modified_base (205)..(205): a, c, t, g, unknown or other
  misc_feature (205)..(205): n is a, c, g, or t
  modified_base (387)..(387): a, c, t, g, unknown or other
  misc_feature (387)..(387): n is a, c, g, or t
  modified_base (391)..(391): a, c, t, g, unknown or other
  misc_feature (391)..(391): n is a, c, g, or t
tcagtcgtcgctcgcacgaccggtgctcgatttagcagtactgcgttggggtttgggggggggtcacaagaggcagcgctctcgggacgtctccaccatggcctgggctctgctgctcctcactctcctcactcagggcacagggtcctgggcccagtctgccctgactcagcctcgcctccggtgtccgtgggtcgtcccgggnacgttcggcaccattctcgttgcgcgtggctccgagtcgatgtatagttaggtaaccttttaccttgtctcgttggtactacaaacaaccacgaacgaacaaaccgtaccccaaaacgttcctttaagttcgtacggtctacaacgtccacggcctacctcactagttcgttaccagtactnttcnctagctactcgtaacgtcgacgtcaacgtacgtcttcgatactacgtctacctacactccgtagtactacgaggacgtagttacttctttaatcgcgtcctactactagtaccgtggtacgggtactacctttacgtttacgtttttccgtttcggggttacggccgggttaccggaccctagggttacctacggttccgttcgtaccttcggtacgtacccgtccggttaccctaacgggttccctcccgttacccccgggtgttaccccg

SEQ ID NO: 2605 - DNA, 721 bp, Homo sapiens
  misc_feature: GYAE6OF02HCYN6.21.87.H10.1.454.CMB.1.raw
  modified_base (152)..(152): a, c, t, g, unknown or other
  misc_feature (152)..(152): n is a, c, g, or t
  modified_base (200)..(200): a, c, t, g, unknown or other
  misc_feature (200)..(200): n is a, c, g, or t
  modified_base (209)..(209): a, c, t, g, unknown or other
  misc_feature (209)..(209): n is a, c, g, or t
  modified_base (684)..(684): a, c, t, g, unknown or other
  misc_feature (684)..(684): n is a, c, g, or t
tcagtcgtcgctcgcacgaccggtgctcgatttagcagtactgcgttgggtttggggggggtcacaagaggcagcgctctcgggacgtctccaccatggcctgggctctgctgctctcactctcctcactcaggcacgagggtctgggcccngtctgccctgacctcgagcctgcctccgtgtcgtagggtcctccgggnaggtcggcncctatctcgtgccgcgttagactccgagacgtatcggtattacgttcggttaaccgttttaaccgttgttacctcgtggtactaccaaaccaaccaacgaacggaaccaaaccggtacccctaaaacttctttaacgttctacggtacgtacaatccgaacgcccgtaacctctacgtacttcgttaacctgttaccgtatttacctcggtactctaacctaccgagttcgtacggaactaaccgacccgggtttctttacgacgttaaccacgttacctacccgtaacttaacccgtaccgtacgggaacgttaccgggaaataaccgggtaagttacgtttactttaagttcccttacggtacttacccgtacgtacgtacgtacgtagggcgttaactacgtttagttttacgtttgggttcggcgttaccggcgtacgttacgtggtccttacggaccttcgcggttaacnccgtaccgtacggtcctaacccgtacccgtgtacccg

SEQ ID NO: 2606 - DNA, 768 bp, Homo sapiens
  misc_feature: GYAE6OF02G0T8B.21.87.H10.1.454.CMB.1.raw
  modified_base (197)..(197): a, c, t, g, unknown or other
  misc_feature (197)..(197): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcaggcacagggtcctggcccagtctgccctgactcagcctgcctcgtgtcgtgggtcctcccgggntaggtcggtccaccgtattcctcttggcgtcgtaggactccgagcgatgtattagttcggttaaccgttttaaccttcgttccttaccgttggtaactacaaccaaccgaccgaacggaaaccaaaccgtacccctaaaacttcctttaacgttccgtacggtccgtaactaacgttaccacgtcccgtaaccctaccaaactacgtttaccgttaccaagttcgtaactttcctaccgttacgacctacttaccgtaagttcgtaccggacctaaccggtccgttaccgtttaccgtaacgtaacctacgtccttacctaccgtaacccgtaccgtaggtacctaaggaaaccgtacggtaacgttccgttttaaatttaccgttaccgacgttcctaccgtactacgtacgacgtacggtcgtaactttacttttacggtttttcgtttacgggtttaccggccggtaccggtacctaggttccgtaacgttaccggtacgttacccgtcgaacgttacccgcgtaacccggtaccgtccccgtcccgttacccccggtgttaaccccg

SEQ ID NO: 2607 - DNA, 668 bp, Homo sapiens
  misc_feature: GYAE6OF02JNR3D.21.87.H10.1.454.CMB.1.raw
  modified_base (491)..(491): a, c, t, g, unknown or other
  misc_feature (491)..(491): n is a, c, g, or t
  modified_base (503)..(503): a, c, t, g, unknown or other
  misc_feature (503)..(503): n is a, c, g, or t
  modified_base (511)..(511): a, c, t, g, unknown or other
  misc_feature (511)..(511): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacacgggtcctgggccccagtctgccctgactcacgcctgcctcgtgtctgggtctcccgggctagtcggtccaccatctcttgccgcgtggactccagcgatgtacttattggtaccttttaacctgtcctccgtgtactcaaactaccaccaaggaccaaacgacccctaaactactttaattcgtggtcgtactaatcacgccaccctcactattcgttacctcgtacgtattcctatcgactactaccgtaagtcgtcgactaaacgtccgtaccgtttctagaacctaatcccttaccgtactaaaccctcgaccgtgtaagactaccggtagtacttacttagttacncgtcctctaacncgtaccgngttagtcgtaccttagtttagtttttcggtttcggttacggccgggttacggtacccttaagggttacgtcggttaaccgttcgtacccgtaccgttacggttacttaccccgggaattaccggacccttacccccggtttacccgtaccgttcccg

SEQ ID NO: 2608 - DNA, 716 bp, Homo sapiens
  misc_feature: GYAE6OF02FWWXB.21.87.H10.1.454.CMB.1.raw
  modified_base (207)..(207): a, c, t, g, unknown or other
  misc_feature (207)..(207): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcgagggcacgagggttccgtcgggccctagtctcgccctgactcacgcctgcctccgtgtctcgggtcctccgggnagtcggtacacctatcttcgtgcgactggactccgagcgatgtattacgttacggttaaccttttaaccttcgtcctccgttggtatacaacaaccacgaaggtaaccaaaccgtacccctaaaacgttactttaaactttcgtacggtacgtactaagtacgacgtaccgtaccctacgtaactacgtttcgtttaccgtaagtaccgtaacgttctcgtacgacgtactaccgtacgtacgtcggaaccgttacctacggttcctttacgtagtaaacctacttcctacgttaccaaaccgtccgacggtctaaggtaaaccgacggtagtactttagttaactcgtcttccttacgactacgttacgttaaggcgtaccgttaatttttacgttttcgtttagggttacgccggttaccgggaacttagtcgtagtccgttcgaacttaccgacgtacttaccggtaccgtccgttaccgtcccgttcccttacggaccttcccgg

SEQ ID NO: 2609 - DNA, 644 bp, Homo sapiens
  misc_feature: GYAE6OF02IRKQ3.21.87.H10.1.454.CMB.1.raw
  modified_base (359)..(359): a, c, t, g, unknown or other
  misc_feature (359)..(359): n is a, c, g, or t
  modified_base (363)..(363): a, c, t, g, unknown or other
  misc_feature (363)..(363): n is a, c, g, or t
tcagtcgtcgctcgcacgaccggtgctcgatttagcagtactgcgttggggtttggggggggggtcacaagaggcagcgctctcgggacgtctccaccatggcctgggctctgctgctcctcactctcctcactcagggcacagggtcctgggcccagtctgccctgactcagcctgcctccgtgtcgtcgggtcctacccgggcacggtccggtacaccctattcctcttggccgctggactccgaggcgatgattagttgggtaaccgttttaccttgtcctcgtgtactacaaacacacaggaacaacgaccctaaaactctttaattcgtggactacaactcacgtccgaccctnactnttcggttaccagttctacttcgtcgtgactacttaccgtaagtctacggtacaaccgtccggttcctttacgacgtactacttctcctaccacctcgaggtcaaggacgacgtagttacttattacgttactcaccttctacacgtacgtcgtaggtccgatttacgtttaccgttttttggtttggggttccggacgggtacccgacgttagtcgtacggactttccgacgttcacggtacgtccgaacggtccgtccgtacccgtcccgttaggtaccc

SEQ ID NO: 2610 - DNA, 845 bp, Homo sapiens
  misc_feature: GYAE6OF02IFZVG.21.87.H10.1.454.CMB.1.raw
  modified_base (223)..(223): a, c, t, g, unknown or other
  misc_feature (223)..(223): n is a, c, g, or t
tcagtcgtcgctcgcacgaccggtgctcgatttagcagtactgcgttgggtttgggggggggtcacaagaggcagcgctctcgggacgtctccaccatggcctgggctctgctgctcctcactctcctcactcagggccacgacgggtcctgggccctagtctcgccctgactcagcctgcctctgtgtctgggtccgtcccgggctaggtccggtccacctnttctcttggccgctaggactccgagcgtatgattagttcgggttaaccgtttttaccttgtccttccgttggttacttaccaacaacctaccgaacggtaaaccaaaccgtaaccccctaaaaattaccttttaaactttccgtagggtaccgttacaagtccgaacggacccgtaccccttacgaccttaacgtttccggtttaccctaaggtccgttaactttcctcttcgactacctacctaaggtcgtacggaaccctaaccggtaccggttccctttacgtacgtaacctaaccttcccttacctaaccctaaccctacccggtacgggttaacgtaacggtaaaccggtacggtacggttaacgttttaaccttttaacgtttaaccttccggtacccttcccgtaaccttaacgttaccggaccgttacggtaccgtaccgtttaccttttaacgtttttttccggtttacgggtttttaccggggaccggggtacccgggtaacccgttaaggttaccggttacggtaccgtttaccggttcccgttaaccgtacggtacccgtacggtacccccgtaaccgggttcccttacccccggttaccccgttcccgg

SEQ ID NO: 2611 - DNA, 733 bp, Homo sapiens
  misc_feature: GYAE6OF02FIGPZ.21.87.H10.1.454.CMB.1.raw
  modified_base (328)..(328): a, c, t, g, unknown or other
  misc_feature (328)..(328): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcacagggtcctgggcccagtctgccctgactcagcctgccctccgtgtcgtgggtcctcccgggcagtcggtcaccatcctcttgcgtctaggctcccgagcgattcgattagttaggtaccgttttaaccgttcgtctcctggtactcaactacaccgaggacaaacgacccctaaattcttaactttcgngcgtacaactcagtccacccgtcactacttcgtttccgacgtcgtattcctctcgactactaccgtaagtcgtacggacaaccgtaccggttcctttcgacgtaactacgtttcctacctactaaccgttcgacggtcgttaacggaaacgtaccggtacgtactttaagtttaacttaccgtacgttaccttacctacgaacttaccgacggtaggttcgtaccttacgtttttaccgtttttacgtttggggttttacggacccgggtacccgggtaacctaggtaacgttacccggttacgttacccggttcccgttacgttaaccgggttacccgtaacccgggttaacccgtacccgggttcccggtccccgttaccccccgggttacggtttacccccg

SEQ ID NO: 2612 - DNA, 694 bp, Homo sapiens
  misc_feature: GYAE6OF02FRAIW.21.87.H10.1.454.CMB.1.raw
  modified_base (233)..(233): a, c, t, g, unknown or other
  misc_feature (233)..(233): n is a, c, g, or t
tcagtcgtcgctcgcacgaccggtgctcgatttagcagtactgcgttgggtttggggggttcgacgaagaggcagcgctctcgggacgtctccaccatggcctgggctctgctgctctcactctcctcactcagggcacagggtcctgggcccagtctgccctgactcagcctgcctccgtgtcgtgggtctcccgggcaggtcggtcaccgatctcttgcgctggactcgancgatgatacttggtacgttttaaccttgtctcgtggtactcaacctaacacctaaggacaaacgcccgaaaactcttaatttcgtcgtcgtcgtaatcgacgcgtaccctacgactatcgtttaccgacgtctaacgtttcctagtcgaactagtaccgtaacgtcttacgggactaaccgtaccggttacctttacctacggaactaacgtaccttactacccgaacctcgtacggactacggaaacggagtaacggtccttaatttaacgtacgttacgtcccttaccgtacctaacttaccgacggtaggttcggaacttactttaacgttttttcggttaaccgggtttttggtacccgggttaaccgggaccctacgggtagtacgtacgtttaccgtccgttaaccgcgttaacgacccgtaccgacggtcgttaccccgcccgtacggttaccc

SEQ ID NO: 2613 - DNA, 887 bp, Homo sapiens
  misc_feature: GYAE6OF02FL50I.21.87.H10.1.454.CMB.1.raw
  modified_base (200)..(200): a, c, t, g, unknown or other
  misc_feature (200)..(200): n is a, c, g, or t
  modified_base (214)..(214): a, c, t, g, unknown or other
  misc_feature (214)..(214): n is a, c, g, or t
  modified_base (218)..(218): a, c, t, g, unknown or other
  misc_feature (218)..(218): n is a, c, g, or t
tcagtcgtcgctcgcacgaccggtgctcgatttagcagtactgcgttgggtttgggggggggtcacaagaggcagcgctctcgggacgtctccaccatggcctgggctctgctgctcctcactctcctcactcagggcacagggtcctgggcccagtctgccctgactcagcctgcctcgtgtctcggggtctcccgggntaggtcggtcaccntctnttgcgtctgactccagcgatgattacgttcggtacttttaaccttggtacctcgttaggtactcgaaacctaccgaccgtaaggaacaaacgaccccctaaaaattcttaaatttccgtaggtaccgtacgtaaactccgacgggacctaccctacacaacgttcgtttaccgacgttaccgactttccgactacgtaccacttaacccgtaaggtccttcgggaacctaaccgtaaccggttcccgttttaacgacgttaaaccgtaaccttaccttaaccgtaccctaaacgttaccccgtaaacggtaccggttaaacggtaaaaccgggtaaacccgttaacgggttaacccgtttttaaacgttttaaacgtttaccgttaccggttaacccgtacccgtttaaacttaaccggttacccgttaccggtaaccgggttaccggtaacccgttaaacgtttttaccgttttttacggtttaccggggttttttaaccggggaccggtttacccgggggtaacccgttaaccggacggttttacccgggtaacggttacccggttccggtttaaccggtaaccgggtttacccggtacgggttaaccccgtaacccggggtcccggtttacccccggttacccccggttacccgggttaaaccccg

SEQ ID NO: 2614 - DNA, 763 bp, Homo sapiens
  misc_feature: GYAE6OF02JPT9I.21.87.H10.1.454.CMB.1.raw
  modified_base (553)..(553): a, c, t, g, unknown or other
  misc_feature (553)..(553): n is a, c, g, or t
  modified_base (575)..(575): a, c, t, g, unknown or other
  misc_feature (575)..(575): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactcctcctcactcagggcacgagggtcctgggccctagtctcgcctgactcagcctcgcctccgtgtctgggtcctcccgggctaggtccgtacacccattcctcttcgcgtctggactccgagcgtatgtaactgttcggtaacctttttactgtcctacgtgtaacttacaacctaacctaccgaacggtaacaaacccggaccccttaaaaagttcctttaacttttaccgcggtaccgttaacctaacgtaccaaccgtaccggacccttacaccgtaacgttccgttttcccgagttccgtaacttcgtccgtagtaccctagtaccgtacgtcgtacgacctaccgaccggttcctttcgaacgtactaacctctacctaccgtaactccggagtactagggaactaccggtgttacttacgtttanacgttacgaccctcttactacnccgggtagtacgtacgtctttaacgtttacgttttttcgttagggtttacccgggccggggaccgttaaccggtgtaaaccgtttcggtaaccccgtttaccggtttccccaacgggtttacctaaccccggtaccgggttaacccggtagttacccccgtcccggttccccggtttacccttcccgg

SEQ ID NO: 2615 - DNA, 770 bp, Homo sapiens
  misc_feature: GYAE6OF02GN2PS.21.87.H10.1.454.CMB.1.raw
tcagtcgtcgctcgcacgaccggtgctcgatttagcagtactgcgttgggtttgggggggggtcacaagaaggcgagcgcgtctcgggaccggtctccaccactggccgtgggcgtctgctgctcctcactctcctcactcgaggcacacgggtccgtcggccacgtctcgccgtcgtactcacgcctcgtccgtccgtcggttcgtcgggtccgtaccgggccgtacgtcggtccacctacttccttcttcggcggtcgtacggtacgtaccgtacggacgtacgtaggtaacgttaagtttacggttaaccgtttttaaccgtttcggttccttacccgttgggttaaacttaccaaaacctaaaccgaacccgtaaggaaacctaaaaaccggtaacccccttaaaaaccttaacttttaaacgttttccggttaacgggaacgttaaccaagttacccgtaacgccgtaaccccttacacgttaacgttcgtttaccacggtacgtacttactctacgactactacgacgttctcgaactaacgtacgttccttacagtaacacttacgtctactaccgtacgacgtatacgaagacgtactagttacttataacctgtcctctactaacgtcgagtcgtacgtaactagttttacgttttacgttaggttttcggcccgggtacgtactacggttacttacggtaaccgttcggtcctacgtacgacgtaccggactccggtaccgtacccgtccgtacgtaccg

SEQ ID NO: 2616 - DNA, 704 bp, Homo sapiens
  misc_feature: GYAE6OF02F1SB6.21.87.H10.1.454.CMB.1.raw
  modified_base (203)..(203): a, c, t, g, unknown or other
  misc_feature (203)..(203): n is a, c, g, or t
  modified_base (642)..(642): a, c, t, g, unknown or other
  misc_feature (642)..(642): n is a, c, g, or t
  modified_base (663)..(663): a, c, t, g, unknown or other
  misc_feature (663)..(663): n is a, c, g, or t
tcagtcgtcgctcgcacgaccggtgctcgatttagcagtactgcgttgggtttggggggggtcacaagaggcagcgctctcgggacgtctccaccatggcctgggctctgctgctcctcactctcctcactcagggcaccagggtcctgggcccagtctgccctgacctcagcctgccctcgtgtctcgggtcctccccgggntacggtccggtcaccctatccttctggccgcgtggactccaggcgtatgtaacgttattacgggtaaccttttaaccttcgtccttccgttaggtaactactaaaccgtaacctaccgtaacggaaaccaaaacgtaacccccctaaaattaccgtttacttaccgtaggtccgtactaactaccgacgtaccgtaccctacgtactacgttcgtttaccacggttctactttcctctcgaccaacgtacctaagtccgtacggacctaacgtacccgttccttacgactacgtattcccgtacctactaaacctcggtacgacgttagaacggtacggtacctaccgtttatttacgttacgtcctcctacctactacctacgacgtcgtacgtacttctttagtttttcggttacggtttcggacggtccgtaccgntacgtactgtcctactacgtntacgccggacctaccggtctacccggtacccgtcgtacccg

SEQ ID NO: 2617 - DNA, 742 bp, Homo sapiens
  misc_feature: GYAE6OF02F3IPD.21.87.H10.1.454.CMB.1.raw
  modified_base (218)..(218): a, c, t, g, unknown or other
  misc_feature (218)..(218): n is a, c, g, or t
tcagtcgtcgctcgcacgaccggtgctcgatttagcagtactgcgttgggtttgggggggggtcacaagaggcagcgctctcgggacgtctccaccatggcctgggctctgctgctcctcactctcctcactcgagggcacagggtcctgggcccagtctgccctgactcagcctgcctcgtgtctcgggtcctccggcagtcgtcaccatctctgcncgtgactccgagcatgattagttaggtaaccgtttttaaccttgtaccttccgtaggttactacaaaccaactaccgaacggaacaaacgaaccccctaaaacttactttaacttttcgtacggtccgtacaacgtcacgtaccgtaaccctctaactattccgtttaccacgttacgtactttcctcgtcgaccgtacttaccgtaacgttcgtacggaaccgtaaccgtaccggttacccgtttactaaccgtaactaacttttaccctacccttaacccaaccgttaccgtaagggtacctaacggtaaacggaccggtaacttaaccgtttaatttaactacgtcgtacctcctactacgtacggcgtaggtcgtaccttagttttacgtttttcggtttacggtttcggaccgggtacccggtacctaggtaccgtacgttcgtaccgttaccgtacgttacgtacccgacggtacccgtaaccggtcccgttaccccgtaccccggttacgttacccg

SEQ ID NO: 2618 - DNA, 690 bp, Homo sapiens
  misc_feature: GYAE6OF01AL9ZL.51.75.G09.1.454.CMB.1.raw
  modified_base (483)..(483): a, c, t, g, unknown or other
  misc_feature (483)..(483): n is a, c, g, or t
tcagcgatcgtatacacgaccggtgctcgatttagtatagacatctaacgtacgaccaaagggggagtccaggtctccagtcaggtacacagtcatggacatggagggtccccgctcagctcctggggctcctgctactctggctccgaggtgcctaggtactgtgactattaccagatgacccagtctccatcttcctgtctggcattctgtaggagacgagacgtcaccatccacgttggccgggactaagacagaactagttggacagtcttaagtttaaagtggtatcgagtcgaacgaaacccaaggggtaacaccccgtaaccgtcctaggacttccgtaatcgactgactacgtccctactttggacctaaaggttggtaacgttacccagttcgtagggttccaggtcggacgtagggtcgggttactagggactagtctttcctacgtctacaacctagttacgacgtacgttntacgactaacgtagtaagtacttttacgaactaactttacgtacgttacgtacctaaacgtagtaacgttaactacgtttacgacccttaacttccttaaaccgtttaccgggtacccggtaaacgggtaccgaaccgggttaccgttacgggtaaacgttaacgtttaaaccggaacgttgggtacggttacccgtaggtaacccg

SEQ ID NO: 2619 - DNA, 635 bp, Homo sapiens
  misc_feature: GYAE6OF01DXO8O.51.75.G09.1.454.CMB.1.raw
  modified_base (225)..(225): a, c, t, g, unknown or other
  misc_feature (225)..(225): n is a, c, g, or t
  modified_base (273)..(273): a, c, t, g, unknown or other
  misc_feature (273)..(273): n is a, c, g, or t
tcagcgatcgtatacacgaccggtgctcgatttagtatagacatcaacacacgaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgganaagacagaacatgcagctatttaatggtatcagcagaaacgaggaacncccctaactcgtagactctatcgctgcacgtacctacgtttgacgtaaagtcggtacgtccctagtcggtagtcaggtcgacgaggtggtcgtagggaactagtactttccgtccttacgtaccaaccttagtttacgacgtagtccgtacgaccgtaacccgttagaagttacttttacggaaccttaaaccgtttacgtaactcggttaaaccaaacgtacggttaaccgttaacttaacgtttacccgaccttaacgttacctaccggtttaccgggaccgtaaagggaccctaacgtacggtaacgggtaagtaaacgtttaaaaccggacgttaggttacggtccttacggtaaccc

SEQ ID NO: 2620 - DNA, 566 bp, Homo sapiens
  misc_feature: GYAE6OF01BDK3C.51.75.G09.1.454.CMB.1.raw
  modified_base (227)..(227): a, c, t, g, unknown or other
  misc_feature (227)..(227): n is a, c, g, or t
  modified_base (300)..(300): a, c, t, g, unknown or other
  misc_feature (300)..(300): n is a, c, g, or t
tcagcgatcgtatacacgaccggtgctcgatttagtatagacatcaacgtacgactaaagggggagtcagtctcagtcaggacacagcatggacatgagggtccccgctcagctcctggggctcctgctactctggctccgacggtgccagatgtgacatccagatgacccagtctccatctccctgtctgcatctgtaggagacagagtcaccatcacttgccggnaagacagtaacattggcagctattaaatggtatcagcagaaaccgaggaacgcccctaactcctagatctatnctgccagccagttcgactaaagtggacgtcccagtacgaggttcaggtcgactaggtcggtcgtcgggacagtactttcgtacctctacacctagttacgactagtctacgactaaccgtagtaagtacttttagaccgtaacttacgtaccttacggtactaaacgtagtaacgttaacgtaacttcgacctactacctacgttccggaccgtaacggtacacgtacgtaggaacgtaacgtaaacgactagtcgtcctgtaccg

SEQ ID NO: 2621 - DNA, 589 bp, Homo sapiens
  misc_feature: GYAE6OF01BUQ3Q.51.75.G09.1.454.CMB.1.raw
  modified_base (231)..(231): a, c, t, g, unknown or other
  misc_feature (231)..(231): n is a, c, g, or t
tcagcgatcgtatacacgaccggtgctcgatttagtatagacatcaacgtacgacaaagggggagtcagtctcagtcaggacacagcactggacatgagggtccccgctcagctcctggggctcctgctactctggctccgaggtgccagatgtgacatccagatcgacccagtctccatcttccctgtctgcatctgtaggagacagagtcaccatcacgttgccggganaagacagaacattggcagctattaatggtatcagcagaaaccagggaactcccctaacgtcctgaatctatcgctgcacgcctacgtttgactaaaggtggacgtcccagtcggaggttcaggtggctaggtggtctagggactagtactttctctctcacctattacgctaagtctagtctaacctgtaatcttttcgacttaaaccttctaacgttacgtaacaacgtaccgtaagtttaccaagtttccgaccctatccgtaaccgtttaccgggaccgtaaacgggtactaaccggtaacgttacgggtaaagtaacgtttaaaaccggacgtttggacggtcgtcgtaacccg

SEQ ID NO: 2622 - DNA, 751 bp, Homo sapiens
  misc_feature: GYAE6OF01A9FUE.51.75.G09.1.454.CMB.1.raw
tcagcgatcgtatacacgaccggtgctcgatttagtatagacatcaacacaacgaaaggggggagtcagtctcagtcaggacacagcatggacatggacgggtccccgctcagcctccgtggggctcctgctactctggctccggaggtgccagatgtgacatccagatcgacccagtcctccattccttccctgtctgctatcgtggtaggagacgagacgtaccaacctactaccacgttcggccgggacaaacggacaagaactagttggacagtacttaatttaagttggtatacgagacgaaacggaaaaccgaacggggaaaaccgtacccccttaaacccgtccgtacgtaacttacctagtcgtactcgaccgtacgtaccttacgttacgacgtaaaggtcggacgtacccgtagtacggtacggttacgaggtcggacgtagggtggtacgtagggtactacggtttactttcctcgtacctacctaaccgttagttacgacgttacgtccgtacgaacccttaacggtagtaaacgtttcgttttacgaacctttaaacctttacgttaaccgttacgtaacctaaagttaacgtttaacgtttaaccttagttaccccgaccttaacgttaaccgttaccggtttaccccgggaaaccggtaaacggtaccgtaacggtaacgggttaggaaaaccttaacggttaaacccgtagttgggtaccgtactaggtaacccc

SEQ ID NO: 2623 - DNA, 777 bp, Homo sapiens
  misc_feature: GYAE6OF01AXSR8.51.75.G09.1.454.CMB.1.raw
  modified_base (148)..(148): a, c, t, g, unknown or other
  misc_feature (148)..(148): n is a, c, g, or t
tcagcgatcgtatacacgaccggtgctcgatttagtatagacatcaacgacacaaagggggacgtcagtctcagtcgaggactacagcgatggacatgaggtcccgactcagctcctgggctcctgctacgtctggctccgaggttcncctagactgttagacgattccagatgacccagtctccatcgttccctgtcggtgcgactctgtaggagtaccagagtcaccatcacttcgccgggacaagtacagaacctacttcggacaagccgttaatttaaagttcggtaacttcgacgaccaaggaaacccgagggaaaccgaccccgtaaccgtccttaggactcgtagtcgactgtcgtacgcctacgttttaggacgtaaaggttcggtaaccgtacccgtagttacggtacggttacgacggttcgggaccggtaacgggttcggggttaccgtacggggaaccttacgggttaacttttacccgtactttaccgttaacctaacccgttaacgtttaacgggaaccgtaacgtaccttacggtacctaaacccggttaaggaaacgtttaacgttttaacggaacctaaacctttaacgttaacgttacgttaaccgaaacgtaacggttaacgttaaacttaacgttttacaccccttaagttaccgttaaacgggttacccggaaaccgtaacgggtaaccacgggttaactcgggaaattaaaccggttaaaacgtaacgttacgggtacggtacgtcggaaacccg

SEQ ID NO: 2624 - DNA, 630 bp, Homo sapiens
  misc_feature: GYAE6OF01C0FMG.51.75.G09.1.454.CMB.1.raw
tcagcgatcgtatacacgaccggtgctcgatttagtatagacatcaacgacgacaaagggggagtcagttctcagtcaggtacacagcatggacatgaggtccccgctcagctcctggggcgtcctgctactctggcgtccgacggtgccagatgtgacatccagatgacccagtctcattccttccctgtctgcactctggtagagacgagagtccaccgatcgacttgccgggtacaacgacagaacagttaggacagcttaatttaaagtgtatcagacaacgaaacgagggaaacgcccctaacctcctagatcctatgacctagacacgacctaactttcgacgtaaaggtcggacgttacccagtacggtaggtttacaggttcggacgtaggtggggtacttagggggaacctaggtacttttacctcgttacttacctacgtagttacgcgtagttctagaccttaacccgtagtaatagttttacgacttaacgttactaacgttcgtacgtaacgtagtacgttaacgtacgttcgaccctagtacctacgttccgacgtaacggacaaccgtaccgtaggaacgtaacgttaaacgacgttacggtcgcgtcgtacccg

SEQ ID NO: 2625 - DNA, 708 bp, Homo sapiens
  misc_feature: GYAE6OF01C2OJI.51.75.G09.1.454.CMB.1.raw
  modified_base (203)..(203): a, c, t, g, unknown or other
  misc_feature (203)..(203): n is a, c, g, or t
  modified_base (468)..(468): a, c, t, g, unknown or other
  misc_feature (468)..(468): n is a, c, g, or t
  modified_base (485)..(485): a, c, t, g, unknown or other
  misc_feature (485)..(485): n is a, c, g, or t
tcagcgatcgtatacacgaccggtgctcgatttagtatagacatcaacacacgaaagggggagtcagtctcagtcaggacacagcatggacatggagggtccccgctcagctccgtggggctcctgctactctggctccgaggtgccagatgtgacatccagatgacccagtcctccattccttcctgtctgcatctgtaggngacagagtaccaccatcctacgttcggccgggactaagaccaagaactcgttacggacacgtaccttaacttttaaagtcggttaactccgagtaccgaacgaaacccggtaacggggaaacctaccccccgtaacctaccgtagtacctacttagtcgaccgttcgacaacgtccctacttacggacctaaaggtcggacgttacccgagtcggtacggttccgaggtcggcgtagggtcggtcggtagggactgtactttccncgttactccgaaacttntacgtgaacgtctacgaccgtacgtaggtaatttcggtttaccgacttaacgttaccgttactacgttaacaacgttagtaacctttaactaacgtttccgaaccctttagtaaccctttaccggttaccggaaacccggtacgggtaaccctacgggtacgttaaggggaaccttaaacggttaaaccggtaacgttggtacccgtcggttcggtaaacccc

SEQ ID NO: 2626 - DNA, 692 bp, Homo sapiens
  misc_feature: GYAE6OF01BCLMI.51.75.G09.1.454.CMB.1.raw
  modified_base (251)..(251): a, c, t, g, unknown or other
  misc_feature (251)..(251): n is a, c, g, or t
tcagcgatcgtatacacgaccggtgctcgatttagtatagacatcaacacaacgaaagggggagtcagtctcagtcaggacacagcatggacatgacgggtccccgctcagctccgtggggctcctgctactctggctccggaggtcgccagatgtacgactactaccagatccgacccagtcctcctattcccttccgtgtctgactatcgtagtaggagacagtactcacctatctacgtcggccgganaagacgagaactagtacggcacgtaattaagtttaagttgtactacgacgtacgaaacgaaaccggaaggtaaacccgtacccctaccgtcctatacgtacctacgtacgccgtacgactaccgtacttaacgttacgaacgtaaacggtcgtaccgtaccgtagtacggtacggttacgaggtcggagtacggtcggtacgtagggactaggtactactacctcacctactactaccgacgtaacgtacgaccgtaacgtacgtacgttaagttcgttacgttacgttagtttactaacgttacgtacacggtaccgtaacgtacctacgtaccgttcgtaccgtttcggtaccgggttacggaaccgggtacggtaacggtagggtaacggtaccgtaagtaaccggtaacggttacgtaggtcgtccgtaagtacccg

SEQ ID NO: 2627 - DNA, 735 bp, Homo sapiens
  misc_feature: GYAE6OF01EMPB3.51.75.G09.1.454.CMB.1.raw
tcagcgatcgtatacacgaccggtgctcgatttagtatagacatcaacacgacaaagggggagtcagtctcagtcaggacacgagcagtggacagtggacgggtccccgctcgacgcctccgtggggcctccgtgctactcgtggcctccggaggtcgccgagtatgtagacactccgagacgtcgaacccagtcctcctattcccttccctgtctgcatcgtaggtaggacgaacgagtacgtaccaacctacgtacctaacgttcgggacccggaacaaacgtaacaacgaaacttagtacggactaacgtacttttaaagtttaaagttggtaactacgaacgaacgaaaccggtaaaacccggaagggtaaacccgtaccccttaacttccgtagtactacgtagtcgactcgacctacgtccgtacgttacgacgtaacggtcggtacctacgtagtcggtacggttacgaggtcgacggtacggttggtacgtacgggacttattaccgtttcctacgtcttaaccgtaaccttagtacgcgtacgttaccgtcgaaccttaacgttagttaacttttcggttacaaccgtttaacttacgttcgtactaaccgaagttataacgtttaacgaccttcgaacccttagtcccgttacgtaccggaaccgtaacggtaccgaacgtacggtaagtaactaacgttaacccgagttcgcgtcgttcgaacc

SEQ ID NO: 2628 - DNA, 793 bp, Homo sapiens
  misc_feature: GYAE6OF01D2HM6.51.75.G09.1.454.CMB.1.raw
  modified_base (739)..(739): a, c, t, g, unknown or other
  misc_feature (739)..(739): n is a, c, g, or t
  modified_base (784)..(784): a, c, t, g, unknown or other
  misc_feature (784)..(784): n is a, c, g, or t
tcagcgatcgtatacacgaccggtgctcgatttagtatagacatcaacacacgaaaggggggagtcagtctcagtcaggacacagcatggacatgacgggtcccccgctcacgctccgtgggggcctcctgctactcgtggctccggaggtgccagatgtgacatccagatcgacctatcctcctatccttccctgtctcgctatcgtaggtaggacgacagtacgtaccaacctactccgacgttcggacccgggacgaaacggacaacggaacgtacgttacgggactagttaacgtttaaattttaaagttggtactacgagtaacaaacggaaaaccgaacgggaaaaccgtaccccccttaaaccgtccgtagtacttaccgtagtccgtcgtcgcctacgtaccgtttaacttacggaacggttaaacggtccggtaaccgttaccccgaagtacgggttaacggttaccgtaggtcgggtacgtggggtaccgggttaggtaccgggactaacggtttcttaccgtccgtttacctacgttaaaccgttagttacgaccgtaacggttacgtaaccgtaccgtaaacgtagtttaaacgttttacttaccgtaaaccttaccgtttaacttacggtaaccggtaacctaaacgggttagttaaaccgtttacgttaaccgttccgaacccgtttaataccggtttacccgtacccggaacggtaaccggtanaacccggtagtaggtaaacgtaacgtaaacgttagacgttcggcncggtaaccc

SEQ ID NO: 2629 - DNA, 792 bp, Homo sapiens
  misc_feature: GYAE6OF01CB8SQ.51.75.G09.1.454.CMB.1.raw
  modified_base (247)..(247): a, c, t, g, unknown or other
  misc_feature (247)..(247): n is a, c, g, or t
tcagcgatcgtatacacgaccggtgctcgatttagtatagacatcaacacgacaaagggggagtcagtctcagtcaggacacagcatggacatgacggtcccgctcagctccgtggggctcctgctacctcgtcggctaccggaggtcgccgagatgtacgacagtccagatcggacccagtcctacacttcttccgtgtctcgacatcgtagtagactccagactacacctatctcgtagccgganacgtacgataacgtcgtaggacctaagtactttaagtttaaagttaggacgtacagtacgaaccgtaaaccggacggtaaaccgtcccccgttaactcggtaactactaccgtagtctacgtacgtacgacgtacttaacggttacggaactaggaccgttacgtaaccccggtagtacgggtacgttacgacgggtacggtacgttgggacggttacgggtaagtaaccgttagttacctttacgtaaccgttcgtaacctaacgttacgtacgacgttaactaccggtacgtaaaccggttaactcggtttaaaccgtttcgtttaacgtacccgtttaaagtttaccaacggttacggttaacctaacggtttaaggttaaccttaaccggttttaacgtacccgttacccgttagttaccccggttaaaccggttaccgggaaaccgttaacgggtaaccgttaacgggtacgttaaaccgggggttaataaaccgggttaaccctttggggtaagtaccccgttaagggtctaaaccccg

SEQ ID NO: 2630 - DNA, 998 bp, Homo sapiens
  misc_feature: GYAE6OF01ET575.51.75.G09.1.454.CMB.1.raw
  modified_base (237)..(237): a, c, t, g, unknown or other
  misc_feature (237)..(237): n is a, c, g, or t
tcagcgatcgtatacacgaccggtgctcgatttagtatagacatcaacgacacaaaggggagtcagtctcagtcaggacacagcatggacatgaggtcccgctcagctcctggggctcctgctactctggctccgagtgccagatgtgacagtccagtatcgacccagtctccattcttaccctgtctgctatcgtcgtaggagaccagagtccacctatccacgttgaccgggtanaacgacacgtaactagtcggtcgacgtacttaagtttaaacgttagggttaacttacgaacggtaaccgtaaacggaaaacccgggtaaacgggggtaaaaacccgtacccccgtttaaaccccggttacccgttacggtaaccctttaccggttaacgtttaacggtacccgttaacgtaccggtaaaccgttacccgttaaccgttttacggaaccgttaaaaacgggtccgggttaaaccggttacccccggtaaggtttaacccgggtaacgggtttaaccggtaacggtaaccggggttacgggtaaaccggggttttcgggggtaccggttaaacggggggttaactaacggttttacgttttaaccccgtttcccgtaaccgtttaccgaaacccggtttacgtaaccgggtacgtacgggtttacctacggtaacccgttaaacccggttagttaaacggtttaaccgtttttaccgtaaaccgtttaacccggtttaaccttaaacccgttaacggtttaaaccccgtaaaaggttaaacccgggtttaacggttttaaacccgtttaacccgtttaccgggttaacccccttaacggtttaaccccgtttaccggttttaaacccggggaacccgttaaaaccggggtacgtaaaccccggggtcgtttaaaacccgggggaaattaaacccgggttaaacccggttaaaccggttaccgggtaacgtttaccccggacggttaaaccccg

SEQ ID NO: 2631 - DNA, 1015 bp, Homo sapiens
  misc_feature: GYAE6OF01BITMT.51.75.G09.1.454.CMB.1.raw
  modified_base (107)..(107): a, c, t, g, unknown or other
  misc_feature (107)..(107): n is a, c, g, or t
  modified_base (212)..(212): a, c, t, g, unknown or other
  misc_feature (212)..(212): n is a, c, g, or t
tcagcgatcgtatacacgaccggtgctcgatttagtatagacatcaacacacgaaaggggggagtcagtctcagtcaggacacagcatggacatggagggtccccgntcagctccgtggggctcctgctactctggctccggaggtgccagatgtgacatccagatcgaccctagtcctccattccttccctgtctgcatcgtagtaagganacagtacgtaccaaccctaatccgtaacgttgggacccgggaacaaacggaaccaaggaaaccttaggttacgggacctaaggtactttaaattttaaaaggttggtaactacgaaggaccgaaaacggaaaaacccgacgggggtaaaaacctcccccttaaaacccgttccgttaaggaacctttacctaaggttacccgacgttacggaaccgtaacacccgtttaaacgttttcggaaaaccggttaaaaggttaccggggtaactacccccgtaaggtaaccgggtacggtttaacgacgggttacggtaccgggtaagggtttaccgggggtacctaacggggggtaaacttaaccgttaacggttttcccttacccgttaccgttaaccgtaaacccgttaaacgtttaacggtaccgttaacggttaccgtaaccggtaaccgttaaacccggtaaagggtttaaacgttaaccgttttaccgtaaaccgtttaaacccgttttaaccgttaaccgttaaccggttaaaccgtaaaacccggttaaacgggtttaaaccgggttttaaaccctttaaacccggtttaccgtaaccccccgtttaaacgtttaaacccggggtttaacccgtttaaaacccggggtaaaccccgggtaaaaaccggggttaaaccccggttaaacccggggtaaaccggttaaaggggttaaaacccggttaaaaacggttttaaaaacccggaaaccggttttacggggtaaccggttaacccggttaaaggttaaaccccccgg

SEQ ID NO: 2632 - DNA, 777 bp, Homo sapiens
  misc_feature: GYAE6OF01DQ0XU.51.75.G09.1.454.CMB.1.raw
tcagcgatcgtatacacgaccggtgctcgatttagtatagacatcaacacaacaaagggggagtcagtctcagtcaggacacagcatggacatgacgggtccccgctcagctccgtggggctcctgctactctggcctccgaggtcgccagatcgtagacatccgagatcgacccagtcctccattccttcccgtgtctgactatcgtaggtaggacgacgagacgtccaccatcctacttcggccggacaaacgacaacgaactagtaggacagtactttaatttaagttggtactacagacaacgaaacgaacggaaccgtaccctaacctcgtagtactactactcgtactagacacgtaccctagttacgacaggtacggtacgtaacccaggttacggtacgttacgacggtacggcggtagggttcggggtagtacggtaagtacggttactttccgttacctaccgtacctaacccgttagtttacggaacgttaccggtacgttaacgtaacccttaaacgtacggttaacgttttacgtttaaccgtaacctttaaacgtttaccgtaacgtttaacgaacccgttaaagtaaccgtttaacgtacctttaaacgttcccggttaacctaccgttaacccggtttccggtaaccggtaacccggtaaaggggttaccccttaaacggttaacgggtaaacggttaaaccggtaaaacgttttaaaaccgggccgttttaagggacccgggttcgtaaacccggtaccg

SEQ ID NO: 2633 - DNA, 540 bp, Homo sapiens
  misc_feature: GYAE6OF02ITGIQ.51.75.G09.1.454.CMB.1.raw
  modified_base (278)..(278): a, c, t, g, unknown or other
  misc_feature (278)..(278): n is a, c, g, or t
tcagcgatcgtatacacgaccggtgctcgatttagtatagacatcaacgacacaaagggggagtcagtctcagtcaggacacagcatggacatgagggtccccgctcagctcctggggctcctgctactctggctccgaggtgccagatgtgacatccagatgacccagtctccatcttccctgtctgcatctgtaggagacagagtcaccatcacttgccgggcaagacagaacattggcagctatttaaattggtatcagcagaaaccagggaacncccctaactcctgatctatgctgcagccactttgacaaagtggacgtccatcgagttcagtggcaggtgggtctggggacaggtatttctctctcacctattacgctagtctgcctaactgaacgtattttcgactaacttactacttacgtacaaactagtaacgttactaaattttcgaccctattcctacgtttccggaccgtaagggaccaacggtactagggtaataacgttaaacgacgttggtacggctagtacc

SEQ ID NO: 2634 - DNA, 582 bp, Homo sapiens
  misc_feature: GYAE6OF02ISKL6.51.75.G09.1.454.CMB.1.raw
  modified_base (229)..(229): a, c, t, g, unknown or other
  misc_feature (229)..(229): n is a, c, g, or t
tcagcgatcgtatacacgaccggtgctcgatttagtatagacatcaacacgacaaagggggagtcagtctcagtcaggacacagcatggacatgagggtccccgctcagctcctggggctcctgctactctggctccgaggtgccaggatgtgacatccagatgacccagtctccatcttccctgtctgccatctgtaggagaccagagtcaccatcacttgccggganaagcagaacattggcagctatttaaatggtatcagcagaaaccagggaacgcccctaactcctggactctaatgactcgcacgccactttgctaaagtggacgtcccagtcgaggttcagtggcaggtgggtactgggacaggtatttctctctcacctattagctagtcctgtactaacctgtaagtattttacgactaaacctttatacttacgtactaacgtagtaacgttaacctaagtttcgaaccctagttcctacgttttacgggaacccgaaagggtaccaacgggtaccgttacgggaactaaacgtttaaacggaccgttacggtacggtcgtacgtaacccg

SEQ ID NO: 2635 - DNA, 812 bp, Homo sapiens
  misc_feature: GYAE6OF02F31RA.51.75.G09.1.454.CMB.1.raw
tcagcgatcgtatacacgaccggtgctcgatttagtatagacatcgaacacacaaagggggagtcagtctcagtcaggacacagcatggacatgagggtccccgctcagctcctggggctcctgctactctggctccggaggtgccagatgtgacatccagatgacccagtcctccatcttccctgtctgcatcgtgtaggagacagagtccaccatcgacgttcggccgggactaagactagaactagtttgggacctaggtaccttaagtttttaaaacgttgggttaactacacgactaacggaaaacccgtaagggggaaaccgtacccccctaacgttcccgtaaggacttacgttactcgcgttacggacctacgtcctaacgttttcgaacctaaagggtcggtaacgttacccaagtttaccgggaagggttccgaaggttcgggaccgtaaggggtttcggggtaccttaacgggggacttaggtttacgttttcccgtccgttacgtaacccgtaacttaacgttaccggtacgttaacggttcctacggtaaacccgttaaccggttaacggtttaaacggttacttttaccggaaccttttaaaccgttaactttaccgttaacggtactaaaccgttaaggttaactttaaaccgttacgttacctacccgttaacttcccgtaaccgtttacgggaacccgttaaacggggaaccctaacgggtaaccggtaacgggttaagtaaacccggttaacggttaaccggttcgggtaaccggttaccgttacggtaacccg

SEQ ID NO: 2636 - DNA, 564 bp, Homo sapiens
  misc_feature: GYAE6OF02F8P2U.51.75.G09.1.454.CMB.1.raw
  modified_base (284)..(284): a, c, t, g, unknown or other
  misc_feature (284)..(284): n is a, c, g, or t
  modified_base (296)..(296): a, c, t, g, unknown or other
  misc_feature (296)..(296): n is a, c, g, or t
  modified_base (388)..(388): a, c, t, g, unknown or other
  misc_feature (388)..(388): n is a, c, g, or t
tcagcgatcgtatacacgaccggtgctcgatttagtatagacatcaacgtacgacaaaaggggggagtcagtctcagtcaggacacagcatggacatcgagggtccccgcctcagctccgtggggctcctgctactctggctccgaggtgccagatgtgacatccagatgacccagtctccatcgttccctgtctgcatctgtagagacagagtcaccatcacttgccgggcaagacagaacatggcagctatttaaatggtatcagcagaaaccagggaaacncccctaactccngatctatgctgcagcctactttcgactaaaagtggaacgtcccagtcgaggtttcaggtggctaggttgggtctggggaacagtacttttcnctcgtcacctattagctagtctgactaaccgtgtaagtattttcgactaactttactactagtacaacgtagtacgtttacaactttcgacctattcctacgtttcggacctaaagggaccaacggtaactaggaagttaacgttaaacgaacgttaggtacggtactaggtaccc

SEQ ID NO: 2637 - DNA, 680 bp, Homo sapiens
  misc_feature: GYAE6OF02GRJAM.51.75.G09.1.454.CMB.1.raw
  modified_base (107)..(107): a, c, t, g, unknown or other
  misc_feature (107)..(107): n is a, c, g, or t
  modified_base (238)..(238): a, c, t, g, unknown or other
  misc_feature (238)..(238): n is a, c, g, or t
  modified_base (662)..(662): a, c, t, g, unknown or other
  misc_feature (662)..(662): n is a, c, g, or t
tcagcgatcgtatacacgaccggtgctcgatttagtatagacatcgaacacacaaaggggggagtcagtctcgagtcaggacacagcatggacatgagggtccccgntcagctcctggggctcctgctactctggctccggaggtgccagatgtgacatccagatcgacccagtctccattcttcccgtgtctgccatctggtacggagacagacgtcaccatctacttggccggganaagacagaacagttcggcagtcttaatttaaagttggtaactcgaagaccgaaaggaaaacccgaaggggtaaaccctcccccttaaaccttccgtagtaacttactagtcgctgacctacgcctacttggacgtaaggtcggactcccagtacggtacgtcgaggtcggacgtagggttcggtcgttacggggaactcgggttacttttacccgcttaccgtacccgtaacttagttacgccgtacggttaccgtacggtacctaacgtaggttaaacgttcgttttaacgacctttaaccttacgttacgttacgtaactaacgttaggttaacgtttaaacttactttacggacccttagttaccgtcggtttacccggacggtaacggacgtaccggtactagggaatacggttaaccgngttacggccgtagcgtac

SEQ ID NO: 2638 - DNA, 757 bp, Homo sapiens
  misc_feature: GYAE6OF02HQ8L4.51.75.G09.1.454.CMB.1.raw
  modified_base (106)..(106): a, c, t, g, unknown or other
  misc_feature (106)..(106): n is a, c, g, or t
  modified_base (146)..(146): a, c, t, g, unknown or other
  misc_feature (146)..(146): n is a, c, g, or t
  modified_base (158)..(158): a, c, t, g, unknown or other
  misc_feature (158)..(158): n is a, c, g, or t
  modified_base (217)..(217): a, c, t, g, unknown or other
  misc_feature (217)..(217): n is a, c, g, or t
  modified_base (232)..(232): a, c, t, g, unknown or other
  misc_feature (232)..(232): n is a, c, g, or t
  modified_base (249)..(249): a, c, t, g, unknown or other
  misc_feature (249)..(249): n is a, c, g, or t
tcagcgatcgtatacacgaccggtgctcgatttagtatagacatcaacgacacaaagggggagtcagtctcagtcaggacacagcatggacagtgagggtccccgntcagctccgtggggctcctgctactctggctccggaggtnccagatgtgacntccagatcgacccagtctcctatcttccctgtctgcatcgtgtagactacagctacacntctactcggccgganaagacagaactgtcganagtacttaagtttaagtggtactcagacaaagaaaccggaagggaaaccctacccccttaaccgtcgtaacgtctaacgttacgtcgtacctcggaccgtaacctaccgttacggtttacgaaacgggttaaacggttcgggtaccctaccgtaaggttaccgggttaagttcgaaagggttcgggaacggttacgggttcggggtacgggtaacgggtacgttaacggtttcctttacgtccctttaacccgtacaccggttaaacgttccgtacgttaccgttaacggccgtaaaccgtcggttaagtaaacgttttccgttaacggtacctttaaaccgttcgttaacttccggtaaactaacggaagtttacttaaccgttaacgttcccaaccggtttattacccgtacggtttacccgggaaccgtagtaccccgggaatacggttaacgggaacttaaccgtaaccgggtaacgttcggtacggtcgtaacccgtaacccg

SEQ ID NO: 2639 - DNA, 881 bp, Homo sapiens
  misc_feature: GYAE6OF02FPAXG.51.75.G09.1.454.CMB.1.raw
tcagcgatcgtatacacgaccggtgctcgatttagtatagacatcaacacgacaaagggggagtcagtctcagtcaggacacagcatggacatgagggtccccgctcagctcctggggctcctgctactctggctccgaggtgccagatgtgacatccagatcgacccagtcctccatcttccctgtctgcatctgtaaggagacagacgtcaccgtatcctacgttcggaccgggtacaaacggacaacgaaacgtagtttcgggactacggtaccttaaagtttttaaaacgttgggttaacttaccgaaacgaccgaaaacggtaaaaaccccgaagggggaaaacccgtacccccccgtaaaacccgtaccccggttaaggaaccttacctttaaggtaccggttcctaacgggactaccggttacccgtaaccgttttacggacgtaaaacgggtttacgggaacgttacccccgtaagttccgggtaaacggtttccgtaacgggttacggtaccggtaaggggttacgggggttaccggttacgggggaacttaacgggtttaacgttttcccggtttactaccccgttaaccgtaacccgtaaaggttaccgttaccgtaacggttttaccctacgggtacccttaaacccggtaaggttaaacgtttaacgttttagggtaccctttaaacgtttaccgttaacgttacgtacccgtaaaagtacggttaaacgttttaacgttaaacgttaccgtaccctacgttaacctttaccggttaccggtacccggtaaacgggtacctaacggtaacgttacggtaaacgtaacgttaaaccggttagtaacgggttacgtacggtagtaacccg

SEQ ID NO: 2640 - DNA, 295 bp, Homo sapiens
  misc_feature: GYAE6OF01EW1G5.38.36.D03.1.454.CMB.1.raw
  modified_base (288)..(295): a, c, t, g, unknown or other
  misc_feature (288)..(295): n is a, c, g, or t
tcagtcgatcacgtcacgaccggtgctcgatttagctgcgtcacgatctctcttggggtcccatctcggttcagtggcagtggatctgggacagatttcattctcaccatcagcagcctgcagcctgaagatgttgcaacttattactgtcaaaggtataaaagtgcccctcccactttcggcggagggaccaaggtggagatcaaacgaactgtggctgcaccatctgtcttcatccttcccgccatctgaacgtgatcgactgagcgggctggcaaggcgcatagnnnnnnnn

SEQ ID NO: 2641 - DNA, 288 bp, Homo sapiens
  misc_feature: GYAE6OF02IAHO4.38.36.D03.1.454.CMB.1.raw
  modified_base (285)..(288): a, c, t, g, unknown or other
  misc_feature (285)..(288): n is a, c, g, or t
tcagtcgatcacgtcacgaccggtgctcgatttagctgcgtcacgatctctcttgggtcccatctcggttcagtggcagtggatctgggacagatttcattctcaccatcagcagcctgcagcctgaagatgttgcaacttattactgtcaaaggtataaaagtgccctcccactttcggcggagggaccaaggtggagatcaaacgaactgtggctgcaccatctgtcttcatcttcccgccatctgaacgtgatcgactgagcgggctggcaaggcgcatagnnnn

SEQ ID NO: 2642 - DNA, 292 bp, Homo sapiens
  misc_feature: GYAE6OF02IZWBC.38.36.D03.1.454.CMB.1.raw
  modified_base (285)..(292): a, c, t, g, unknown or other
  misc_feature (285)..(292): n is a, c, g, or t
tcagtcgatcacgtcacgaccggtgctcgatttagctgcgtcacgatctctcttggggtcccatctcggttcagtggcagtggatctgggacagatttcattctcaccatcagcagcctgcagcctgaagatgttgcaacttattactgtcaaaggtataaaagtgcccctccactttcggcggagggaccaaggtggagatcaaacgaactgtggctgcaccatctgtcttcatcttcccgcatctgaacgtgatcgactgagcgggctggcaaggcgcatagnnnnnnnn

SEQ ID NO: 2643 - DNA, 301 bp, Homo sapiens
  misc_feature: GYAE6OF02IALRW.38.36.D03.1.454.CMB.1.raw
  modified_base (286)..(286): a, c, t, g, unknown or other
  misc_feature (286)..(286): n is a, c, g, or t
  modified_base (294)..(301): a, c, t, g, unknown or other
  misc_feature (294)..(301): n is a, c, g, or t
tcagtcgatcacgtcacgaccggtgctcgatttagctgcgtcacgatctctcttgggtcccatctcggttcagtggcagtggatctggacagattcattctcaccatcagcagcctgcagcctgaagatgttgcaacttatactgtcaaaggtataaaagtcgaccctcccactttcggcggagggacaaggtggagatccaaacgaatgtggctgcaccatctgtcttacatcttccccggacatcgtagaacgtgaatcgactgagcgggtctggacaagggcncaattagnnnnnnnn

SEQ ID NO: 2644 - DNA, 288 bp, Homo sapiens
  misc_feature: GYAE6OF02IJIAQ.38.36.D03.1.454.CMB.1.raw
  modified_base (276)..(276): a, c, t, g, unknown or other
  misc_feature (276)..(276): n is a, c, g, or t
  modified_base (282)..(288): a, c, t, g, unknown or other
  misc_feature (282)..(288): n is a, c, g, or t
tcagtcgatcacgtcacgaccggtgctcgatttagctgcgtcacgatctctcttggggtcccatctcggttcagtggcagtggatctgggacagatttcattctcaccatcagcagcctgcagcctgaagatgttgcaacttattactgtacaaaggtataaaagtgcccctccactttcggcggaggaccaaggtggagatcaaacgaactgtggctgcaccatctgtctcatctccgcatctgaacgtgatcgactgagcgggctggcaaggcncatagnnnnnnn

SEQ ID NO: 2645 - DNA, 357 bp, Homo sapiens
  misc_feature: GYAE6OF02JDJPM.38.36.D03.1.454.CMB.1.raw
  modified_base (131)..(131): a, c, t, g, unknown or other
  misc_feature (131)..(131): n is a, c, g, or t
  modified_base (144)..(144): a, c, t, g, unknown or other
  misc_feature (144)..(144): n is a, c, g, or t
  modified_base (230)..(230): a, c, t, g, unknown or other
  misc_feature (230)..(230): n is a, c, g, or t
  modified_base (304)..(304): a, c, t, g, unknown or other
  misc_feature (304)..(304): n is a, c, g, or t
  modified_base (306)..(306): a, c, t, g, unknown or other
  misc_feature (306)..(306): n is a, c, g, or t
  modified_base (310)..(310): a, c, t, g, unknown or other
  misc_feature (310)..(310): n is a, c, g, or t
  modified_base (314)..(357): a, c, t, g, unknown or other
  misc_feature (314)..(357): n is a, c, g, or t
tcagtcgatcacgtcacgaccggtgctcgatttagctgcgtcacgagtctctcttgggtcccatctcggttcagtggcagtggatctgggacagatttcattctcaccatcagcagcctgcagcctgaagntgttgacaacttnttactgtacaaaggtataaaagtcgaccccctcctacgtttcggcggagggaccaaggttggatatacaaacgatcgtgctgcacntctgtcttcacttcctcccgactatcgtagtaactgactcgactggaggccggctggacaagtcgacttagagngnatcngtcnnnnnnnnnnnnnnnnnnnnnnnnnnnnnnnnnnnnnnnnnnnn

SEQ ID NO: 2646 - DNA, 820 bp, Homo sapiens
  misc_feature: GYAE6OF01ARA9C.42.83.H06.1.454.CMB.1.raw
  modified_base (142)..(142): a, c, t, g, unknown or other
  misc_feature (142)..(142): n is a, c, g, or t
  modified_base (146)..(146): a, c, t, g, unknown or other
  misc_feature (146)..(146): n is a, c, g, or t
  modified_base (157)..(157): a, c, t, g, unknown or other
  misc_feature (157)..(157): n is a, c, g, or t
  modified_base (159)..(159): a, c, t, g, unknown or other
  misc_feature (159)..(159): n is a, c, g, or t
  modified_base (163)..(164): a, c, t, g, unknown or other
  misc_feature (163)..(164): n is a, c, g, or t
  modified_base (167)..(167): a, c, t, g, unknown or other
  misc_feature (167)..(167): n is a, c, g, or t
  modified_base (170)..(170): a, c, t, g, unknown or other
  misc_feature (170)..(170): n is a, c, g, or t
  modified_base (176)..(176): a, c, t, g, unknown or other
  misc_feature (176)..(176): n is a, c, g, or t
  modified_base (179)..(179): a, c, t, g, unknown or other
  misc_feature (179)..(179): n is a, c, g, or t
  modified_base (189)..(189): a, c, t, g, unknown or other
  misc_feature (189)..(189): n is a, c, g, or t
  modified_base (218)..(218): a, c, t, g, unknown or other
  misc_feature (218)..(218): n is a, c, g, or t
tcagtgacgtatgtcacgaccggtgctcgatttagatcacgtgcgtcgcggggctggctaaggcgtcagtagctgccttggtcaaggactacttccacgatacgtcacttgaggccggtcctgggccaaggcgcactagcgnatgngcatcagccancnctcnncantcncgactncgntccagcccgnagacgtactcatcgacgtcgtcgacgganattacgtaccgtacgaactacgtaaagtttgttttcggtactttaccgggtacgtacgacgaccgaacggacccgttaacgggaaccgaacccggtcccccgtttaacggacccgtaccgtaccgtacgttacgttaacgttacgtttaaggtttacggttacgtaaccggtaccgggtacccggttacccggttaccgtaacggtaaccggttaaccgggttacggtaaccggtacggttacgttacggttacggtacggtacggtacggtacgtacgtaccgttaccgtttaccgttaccgtaaccgtaaccgtaaccgtaaccgtacggtacgggtacgggtaccgggttaccggtacggtacggtacggttacggtttacgggtttacgttacgtacgtacgttacgttacggtacgttacgttacgtttaacgttaaccgttaccgtaccgttaccgttaacggttacggttacggtaacgggtaccggttacgggttacggttaccggtaccggtaaccggtaaacggtaacggtacggtacggtaccggtaccgtaccgtaaccgtacgtaccgtaccgttccgtcccgtacccg

SEQ ID NO: 2647 - DNA, 654 bp, Homo sapiens
  misc_feature: GYAE6OF01EN5RC.42.83.H06.1.454.CMB.1.raw
tcagtgacgtatgtcacgaccggtgctcgatttagatcacgtgcgtcgcgggcacgaccggtgctcgatttagatcacgtgcgtcgcgggggcaggagtcacgacccactcaggacacagcatggacagtggacgggtccccgctcagcctccgtggggcctcctgctgctctggcctcccgaggtgccagatgtcgccatccagatcgacccagtcctccactccctccctgtctgcgtcgtggtcggagacagacgtcctaacctatttaccgttcggccgggacaaggtccgagggacaagtaaagaaagttgtaagtttaggcgttaggtatcgagacaaggaacgaccgaaagggaaaccgccccgaagtcctcctagactactatcgctgcacttaccgtatttggaacgtaacgggttcgggtacctagtaccgtaaggttccacggccgtacgtaggtacggacttacgtacgactacgtagtacctttcgacctttccacgacctacgtaccgacgcgtaccgtccgtagtacccgtacgttacccggtaggttacggtttactttaccgtaactttaaacggtttacttaccgttacgtacctaacgtaagttaactttataccggtaccctacccggtaacgg

SEQ ID NO: 2648 - DNA, 629 bp, Homo sapiens
  misc_feature: GYAE6OF01D1CA6.42.83.H06.1.454.CMB.1.raw
  modified_base (237)..(237): a, c, t, g, unknown or other
  misc_feature (237)..(237): n is a, c, g, or t
  modified_base (308)..(308): a, c, t, g, unknown or other
  misc_feature (308)..(308): n is a, c, g, or t
  modified_base (543)..(543): a, c, t, g, unknown or other
  misc_feature (543)..(543): n is a, c, g, or t
tcagtgacgtatgtcacgaccggtgctcgatttagatcacgtgcgtcgcgggcacgaccggtgctcgatttagatcacgtgcgtcgcgggggcaggagtcagacccactcaggacacagcatggacatgagggtccccgctcagctcctggggctcctgctgctctggctcccaggtgccagatgtgccatccagatcgacccagtcctccatccctcctgtctgcgtctgtcgganacagagtccacctattacgtgaccggcaagtcgagggacaataagaatgtatttacggctggtatcgaganacggaagccgaaagggaacgtccccgaaagtcctccgtagtatactatcgctgacacttccgtaagtttaggacgtaaaggtccgggtaccctagttaccgtaacggttcacggtaccgccgtaaggtgacgtcgtacgaccgtaactacgttactttacctaccgttcctacctaacctacgtaccacgtaccgaacgtccctacggtaccgtacggtcccgttaggtacgttnttttacggtaaccttaagttttacttacgttacgttaacgttaacgtaaggttaacttaacgtacgttcctaacccggttaaccgg

SEQ ID NO: 2649 - DNA, 589 bp, Homo sapiens
  misc_feature: GYAE6OF01AZZG5.42.83.H06.1.454.CMB.1.raw
  modified_base (343)..(343): a, c, t, g, unknown or other
  misc_feature (343)..(343): n is a, c, g, or t
tcagtgacgtatgtcacgaccggtgctcgatttagatcacgtgcgtcgcgggcacgaccggtgctcgatttagatcacgtgcgtcgcgggggcaggagtcagacccactcaggacacagcatggacatggacgggtcccccgctcagctccgtggggctcctgctgctctggctcccaggtgccagatgtcgccatccagatcgacccagtcctccactccctccctgtctgcgtctggtacgacgactagacgtaccacctagtttacgtcggaccggacaagtccgagggacaagtaaagaaattgtattaggctggtatcagacagacgcgaaggaaccncccgagctccgtgactcgtatcgctgctactctacgttcgaacgtaacggtcggacctacgtcgtaacgtcacgccgtcgagtcgactcgagacacgtagtacttcacctcctaccactacacgacacgcgtccctaggacccacggtccgtaggttaacggttactttacgaacgtttaactttaacttccgttacgtacgttacgtaaacgttacttaccgtaaccgttcccgtaacggtaccg

SEQ ID NO: 2650 - DNA, 695 bp, Homo sapiens
  misc_feature: GYAE6OF02JLKS0.42.83.H06.1.454.CMB.1.raw
  modified_base (257)..(257): a, c, t, g, unknown or other
  misc_feature (257)..(257): n is a, c, g, or t
tcagtgacgtatgtcacgaccggtgctcgatttagatcacgtgcgtcgcgggcacgaccggtgctcgatttagatcacgtgcgtcgcgggggcaggagtcagacccactcaggacacagcatggacatgagggtccccgctcagctcctggggctcctgctgctctggctcccaggtgccagatgtgccatccagatgacccagtctccatcctccctgtctgcgtctgtcgagacagagtcaccattactgccggnaagtcagggcaagtaagaatgatttaggctggtatcgagcaaggacgccgaaggggaaacgccccggaaagccgtacctaggactctaagtgccttagcctaattcccctacgttttggaccgtaaaagggttcggggtaccccaagttaccgtaaacgggtttccgaacggtaccggaccgtaacgggttacggtaacgtaccgttacgtaaaccgaacgtaacggttaacttttaccgacctttaccgtacccgtaaccctaacgttacccgaacggtaccctaaccgggtcccttacggacccgtaacggtacccgttaggtacgggttacgtttttacgtaaccgttaaacttttacgtttaaccgttacgtttaaccgttaaccgtaagggttaactttaaacgtacggttacccgttaaccccgttaaccgg

SEQ ID NO: 2651 - DNA, 686 bp, Homo sapiens
  misc_feature: GYAE6OF02HQ8FK.42.83.H06.1.454.CMB.1.raw
  modified_base (353)..(353): a, c, t, g, unknown or other
  misc_feature (353)..(353): n is a, c, g, or t
tcagtgacgtatgtcacgaccggtgctcgatttagatcacgtgcgtcgcgggcacgaccggtgctcgatttagatcacgtgcgtcgcggggcaggagtcagacccactcaggacacagcatggacatgagggtccccgctcagctccgtggggctcctgctgctctggctcccaggtcgccagatgtgccatccagatcgaccagtctccatccctccctgttctacgcgtctggtcggagacagtacgtcaacctattaccgttcggaccgggacaaggtcgaagggactaagtaagaaatgtaagtttaggcttggtaatcagcaagagccgaaggaacgccaagctccgngatcatcgctgctactccttaatttcggaacgtaacgggttcgggtaccctaacgtacgtaacggttacgacggtaccgaccggtaaggtaccggtacgtaccgtaggaaccgtaacgtaacgttactttacccgacctttaccgtactaacccgtaacgtaccgacggaccgttaacgcccgtttaacggacctaaccggggtacccttagggttaccggttttaatttccgggtaacctttaaaccggttttaactttaccgttaccgttaacgttaaccgttaaggttaaaccttttacggtaaccgttaccgttaccccgttaaccggg

SEQ ID NO: 2652 - DNA, 742 bp, Homo sapiens
  misc_feature: GYAE6OF02GMH9T.42.83.H06.1.454.CMB.1.raw
  modified_base (140)..(140): a, c, t, g, unknown or other
  misc_feature (140)..(140): n is a, c, g, or t
  modified_base (176)..(176): a, c, t, g, unknown or other
  misc_feature (176)..(176): n is a, c, g, or t
  modified_base (181)..(181): a, c, t, g, unknown or other
  misc_feature (181)..(181): n is a, c, g, or t
  modified_base (591)..(591): a, c, t, g, unknown or other
  misc_feature (591)..(591): n is a, c, g, or t
tcagtgacgtatgtcacgaccggtgctcgatttagatcacgtgcgtcgcgggcacgaccggtgctcgatttagatcacgtgcgtcgcgggggcaggagtcagacccactcaggacacagcatggacatgagggtccccgntcagcctcctggggctcctgctgctctggctcccgnggtcnccagatgtgcctatccaggatcgaccctagtcctacactccctccctgtcctgcgtctggtccggagacaggacgtcctaacctagttaaccttcggaccgggacaagttcgagggactaagtaaacgaaagttagtaactttacggacgttagggtaacttacgacgtacgaacggtaacgaccggaaaggggaaaaccggcccccgtaaaggtcccttaccggtaggtaacttacgttaaacgttcggaccgttacgaccgtaccgtttaccttaacggtttacgtaacgggtaaacggttcggttaacccgtactacgtaacgtcgacggtacgacgacgtaggtactaccgtacgaacctaacgtaacgtacgttttacgaacttccttaccgacctaacgtaccncgtaccgaaccgttccgtcgtcgaacgtccgtacggttacgggttatttaccggtaaccgtttaacgtttaaaccgtttaacgttcggtttaaccgttaacggttaacggttacgttaaccgtaacggttaccccgtacccgttaacccgg

SEQ ID NO: 2653 - DNA, 697 bp, Homo sapiens
  misc_feature: GYAE6OF02F7PSH.42.83.H06.1.454.CMB.1.raw
  modified_base (139)..(139): a, c, t, g, unknown or other
  misc_feature (139)..(139): n is a, c, g, or t
tcagtgacgtatgtcacgaccggtgctcgatttagatcacgtgcgtcgcgggcacgaccggtgctcgatttagatcacgtgcgtcgcggggcaggagtcagacccactcaggacacagcatggacatgagggtccccgntcagcctccgtggggctcctgctgctctggacctccgaggtcgccagtactgtcgccatccgagatcggacccagtcctccacgtccctcctgtctcgcgtactggtacggagtacagtacgctaaccctattaccgttcggccggataacgttcgacgggactaagtaaagaagttggtaacttgggccttggataccgatacgaagtacgaccgtaaggggaccaccccggtaagcctacgtacgtactacgtagtcgtcggtactacgttaaccgtccgttaacggtttaaaccgacgggttaaaacgggttccggggtaaccctacgtaacggttaaccggtccggacggtcccgtaacgtaggtacgccgttacgtaacgaacgttacgtacttacgtttacaccttaccgactaaccgatccgaaacgccgtcgttacgcgaccgttagccttagggttacgttccgttaggttaacctaaccgtttacgttaccgtttgtaccgtacgttaacggtttactaaccggttaccgtacccttacgggtaaccg

SEQ ID NO: 2654 - DNA, 543 bp, Homo sapiens
  misc_feature: GYAE6OF01D873L.26.21.B10.1.454.CMB.1.raw
  modified_base (241)..(241): a, c, t, g, unknown or other
  misc_feature (241)..(241): n is a, c, g, or t
  modified_base (398)..(398): a, c, t, g, unknown or other
  misc_feature (398)..(398): n is a, c, g, or t
  modified_base (406)..(406): a, c, t, g, unknown or other
  misc_feature (406)..(406): n is a, c, g, or t
tcagagactatactcacgaccggtgctcgatttagtgtcgtcgcaagaggtaggagggggcctcgaggaagcagcatcggaggtgcctcaggcccatggcatggagtccctctcttcctcggtcgtccttgcgttactgcacaggatccgtggccttcgatcgagctgattcagccaccctcagtgtccgtgtccccaggacagacagccaccatcgacctgctcggcagacaaattgganatagaaatgctgcctggtattaccagaggccaaggccagtcccctatttggcatcttccaagataagaagcggcctcagggatcctgaccgaatttctaggctccgaactctgggtaacacagccaactctgaccatcagcgggaccagccaacggntgaggtanactactattgcaggcgtaggagtaatacgtagttagtagtgttaggacggtaagggacaggtctggaccgtccgtaggtcagtcccgaaggcctacgcccccttcgggtccaacttccttcgttcccgcccttcccg

SEQ ID NO: 2655 - DNA, 620 bp, Homo sapiens
  misc_feature: GYAE6OF01AD1UB.26.21.B10.1.454.CMB.1.raw
  modified_base (232)..(232): a, c, t, g, unknown or other
  misc_feature (232)..(232): n is a, c, g, or t
  modified_base (336)..(336): a, c, t, g, unknown or other
  misc_feature (336)..(336): n is a, c, g, or t
tcagagactatactcacgaccggtgctcgatttagtgtcgtcgcaagagaggagggggcctcaggaagcagcatcggaggtgcctcagccatggcatggatccctctcttcctcggcgtccttgcttactgcacaggatccgtggccttcgattagctgattcagccaccctcagtgtccgtgtccccaggacagacagccaccatcacctgctcggcagacaaagttgganatagaatgctgctaggtataccgagacggccaggccacgtcccctatttcggcatctacaagataagacgcgcctacgacgggtactccctgaccgaatttcgnggtcctaccaactcgtacgggaacacacgccactctacgaccagtccgaacggcccgggacccaaggaccgaaggagtaggaacgggactactacgtagttcggtacgacggcgtagggaataagttacgtaagttggtaaggttgggttacggcgggtaacggtaccagggtccgtacggtacccgtcgtacgggtaccacggtccccgtaaggtccctcccggtccccccgttgggtaccctaccgttcccgtaccgtttcccccgcccgtccgttaaccgg

SEQ ID NO: 2656 - DNA, 717 bp, Homo sapiens
  misc_feature: GYAE6OF01EG1MA.26.21.B10.1.454.CMB.1.raw
  modified_base (337)..(337): a, c, t, g, unknown or other
  misc_feature (337)..(337): n is a, c, g, or t
tcagagactatactcacgaccggtgctcgatttagtgtcgtcgcaagagaggagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccagtcccctagttttggtcatcttccaagataagagcgcctcgaggactcccgagaccgattcnggactaccaactcgtagggaacacgagccactctacgaccatcgacggccggggacccaacggacccgaaacgggactacgggaacggggaacgtaaccgttaaccgttaagtttcggtaaccgtaacggggtaccggttaggggaacgtaaacgttaaccgttaaggtttagggtttaacgggtttacgggttttacggggaccggggtaacgggggtacccgtaaagggggtcccgttacgggtaaccccggtttcccggttaaacggggtacccgaaaccgggtacccccggaaacgggttccccgttacccgggtcccccccggttacgggttaccccgttaacccgtttcccggttcccggtttaccccccccgg

SEQ ID NO: 2657 - DNA, 649 bp, Homo sapiens
  misc_feature: GYAE6OF01DBOK3.26.21.B10.1.454.CMB.1.raw
  modified_base (234)..(234): a, c, t, g, unknown or other
  misc_feature (234)..(234): n is a, c, g, or t
  modified_base (329)..(329): a, c, t, g, unknown or other
  misc_feature (329)..(329): n is a, c, g, or t
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtattaccagagccaggccagtccctatttgcatctccaagataagaacgcggccctgaggactcctgaccgaatttcnggacttccaactcgtaggaacacagcccaacgtctgacccatccgacggccggggacccacggcccaaacgggactacgggaacgggacgaacgtaaccgtagttcggtaccgagggtaccggtagggaagtaaacgtacgttaagttagggtaacggtttggtttaggggaccgggtaaggggtaacccgtaggggtccgtacggtacccggtacccgttaaggggtcccgtaacggaccccgaaagggtcccgtcccgacccccccgttccgggcccttaaccgttcccgttcccgttcccccggcccctttaccccg

SEQ ID NO: 2658 - DNA, 600 bp, Homo sapiens
  misc_feature: GYAE6OF01C8YCI.26.21.B10.1.454.CMB.1.raw
  modified_base (305)..(305): a, c, t, g, unknown or other
  misc_feature (305)..(305): n is a, c, g, or t
  modified_base (329)..(329): a, c, t, g, unknown or other
  misc_feature (329)..(329): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtatacagagccaggccagtccctatttggcatctccaagataagaagcgcctnagggactcctgaccgtaatttcgnggctacccaaactcgtagggaaccacgacgcccactctagacccatccgacggccggggacccacgaccaaacgggataggaagggagaacttactattgtcgagggcgtagggaagaagtaacttagtttaggtaggttgtttgggacgggtacgggaccgagggccttacgggacccgttccgtaagggtcccgtaacggccccgaaaggtccctccggtcccccctcgggtacccacccttccgttccgttcccccggccccttcccg

SEQ ID NO: 2659 - DNA, 316 bp, Homo sapiens
  misc_feature: GYAE6OF01AHTCT.26.21.B10.1.454.CMB.1.raw
  modified_base (297)..(301): a, c, t, g, unknown or other
  misc_feature (297)..(301): n is a, c, g, or t
  modified_base (303)..(316): a, c, t, g, unknown or other
  misc_feature (303)..(316): n is a, c, g, or t
tcagagactatactcacgaccggtgctcgatttagtgtcgtcgcaagagaggaggggccctcagggatccctgaccgaatttctggctccaactctgggaacacagccactctgaccatcagcggggcccagccaacggatgagggagactactattgtcaggcgtgggagaatactattgtagtgtttggcggagggaccaggctgaccgtcctaggtcagcccaaggctgccccctggtcactctgttcccacctcctcagtatagtctctgagcgggctggcaaggcgcatagnnnnngnnnnnnnnnnnnnn

SEQ ID NO: 2660 - DNA, 561 bp, Homo sapiens
  misc_feature: GYAE6OF01CP6AM.26.21.B10.1.454.CMB.1.raw
  modified_base (234)..(234): a, c, t, g, unknown or other
  misc_feature (234)..(234): n is a, c, g, or t
  modified_base (328)..(328): a, c, t, g, unknown or other
  misc_feature (328)..(328): n is a, c, g, or t
  modified_base (339)..(339): a, c, t, g, unknown or other
  misc_feature (339)..(339): n is a, c, g, or t
  modified_base (422)..(422): a, c, t, g, unknown or other
  misc_feature (422)..(422): n is a, c, g, or t
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaaatgctgcctggtataccagaggccaggccagtcccctatttggcatcttcaagataagagcgcctcagggactcctgaccgtatttcnggctcaactcnggaacacagccactctgaccatcagccgggccacgccaacggatggaagggaacgtactactagttgtcgaggcgtagggaanaatacgttaagttagtaggttggttgggacggagggaccgtagggcctagacccgtccgtaggaccgtacggaccccgaaggccctccggcccccctacgggtcccaaccgttccgtcccggtccccgtccccgtcccg

SEQ ID NO: 2661 - DNA, 678 bp, Homo sapiens
  misc_feature: GYAE6OF01CLMA8.26.21.B10.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcactgctcgcagacaagtggganatagaatgctgctggtataccagagccaggccagtccctatttgcatctacaagataagacgcggccctagacgggactcccgtagaccgtaatttcgcggaccttacccgaactcgtagggaaaccacgacgcccaactcgtacgaccacgtcgacggccgggacccaacgaccgaacgggagtacggaagggacgtaactacgttacgttcgacgagggtcggtagggaataacgttacgttagttaggttaggttagggtttacggggacgggtaacggggtaccgtacgggaccgttacgggtaacccgttccggtaacgggttacccgaaccgggtaccccgaaacggggtccccgtaccccgggtccccccccggttacgggtaccccgtacccgttacccggtttccccggttaccccccgtacccccgtttaccccg

SEQ ID NO: 2662 - DNA, 778 bp, Homo sapiens
  misc_feature: GYAE6OF01AGHQA.26.21.B10.1.454.CMB.1.raw
tcagagactatactcacgaccggtgctcgatttagtgtcgtcgcaagaggaggagggggggcctcaggaagcacgcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggtcagtcccatattttggcatcttccaagataagaacgcgccctgagggactccctgaccgtaatttctggcctaccaactcgtagggaaccacacgcccaactccgtacgaccctatcgaacggccggggaccccaggacccgaaacgggtagtagggaacggggaacgaaccgttaacgttaagttcgtacggtacgggtaccggttaggggaacgtaaacgtttaaccgtaaggtttttacggttaacgggttttacggggtttttacgggggaaccgggggttaacggggggtaaccccgtaaacgggggtccccgttacggggtaaacccccgggtttaccccgggttaaaccggggtttaccccggaacccggggttaaccccccggtaaacgggggttccccgttaaccccgggtcccccccccggtttacccggggttacccccgtaacccccgtttccccggtttaccccgggttttacccccccccttaacccccccgg

SEQ ID NO: 2663 - DNA, 531 bp, Homo sapiens
  misc_feature: GYAE6OF01ESXL8.26.21.B10.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattggganatagaaatgctgcctggtattaccagaggccaggccagtcccctattttggtcatcttccaagataagaagcgccctcagggatccctgaccgaatttctggctcaactctagggaacacagcccactctgaccatcagccgggcccagccgaacggatagagggagactactattgcaggcgtgggagaatactattgtagttgttggcggaggaccgaggcgtggaccgtccgtaggtcaggcccgaaggcctcggccccccttcgggtacaccgtctcgttccccgtccccg

SEQ ID NO: 2664 - DNA, 515 bp, Homo sapiens
  misc_feature: GYAE6OF01EEAEI.26.21.B10.1.454.CMB.1.raw
  modified_base (234)..(234): a, c, t, g, unknown or other
  misc_feature (234)..(234): n is a, c, g, or t
  modified_base (436)..(436): a, c, t, g, unknown or other
  misc_feature (436)..(436): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcgcagacaaattggganatagaatgctgcctggtattaccagaggccaggccagtcccctatttggcatcttccaagataagaagcggccctcagggatcccgtgaccgaatttctggctccaactctgggaacacacgccactctcgaccatcagcgggcccagccgaacgatgaggagactactatgtcaggcgtggagatactatgtagtgttggnggaggacgaggctgaccgtcgtaggtcacggcccaaggtccgacgccccctcggtccacctctcgtcccgcccttcccg

SEQ ID NO: 2665 - DNA, 606 bp, Homo sapiens
  misc_feature: GYAE6OF01BAJQZ.26.21.B10.1.454.CMB.1.raw
  modified_base (307)..(307): a, c, t, g, unknown or other
  misc_feature (307)..(307): n is a, c, g, or t
  modified_base (321)..(321): a, c, t, g, unknown or other
  misc_feature (321)..(321): n is a, c, g, or t
  modified_base (330)..(330): a, c, t, g, unknown or other
  misc_feature (330)..(330): n is a, c, g, or t
  modified_base (343)..(343): a, c, t, g, unknown or other
  misc_feature (343)..(343): n is a, c, g, or t
  modified_base (362)..(362): a, c, t, g, unknown or other
  misc_feature (362)..(362): n is a, c, g, or t
tcagagactatactcacgaccggtgctcgatttagtgtcgtcgcaagtaggtaggaggggcctcgaggaaggcagcatcggaggtgcctcagccatggcagtggatccctctcttcctcggcgtccttgcttactggcacaggatccgtggccttcgatgagctgagttcagccacctcagtgtccgtgtccccaggcagacagtccaccgactccacctgctcggcagacaaagttgggagatagaactgactgcctggtattaccgaggagccgagccacgtcccctatttcggcatctccaagntaagagcggccctnaggatcccngaccgaatttcgnggctcaactcgtaggaacncagcccatctacgaccatcacgcgggccagccaacggatcggaggacacgtactattgtccaggtcgtagggagaaacgtactaagttaggttaaggttgtttacggggacgttacggggaccgtagggtacgttacggaccggttacccgttagggtacccgaacggtccccgaaagggtcccgtaccggacccccgtacgggttccacccgttccgttcgttacccccgtccccgttacccg

SEQ ID NO: 2666 - DNA, 733 bp, Homo sapiens
  misc_feature: GYAE6OF01CI80D.26.21.B10.1.454.CMB.1.raw
  modified_base (234)..(234): a, c, t, g, unknown or other
  misc_feature (234)..(234): n is a, c, g, or t
tcagagactatactcacgaccggtgctcgatttagtgtcgtcgcaagaagaggggcgtggcgtcaggagcagcatcggaggtgcctcagccatggcatggatccctctcttcctcggcgtccttgcttactgcacaggatccgtggccttgatgagctgattcagccaccctcagtcgtccgtcgtccccaggaccagacagcccacatcgacctgctcgcagacaattggganatagaatcgctgcctggtattaccagacggcacggccagtccccttagttttcggcatcttaccaagtataagacgccgccctcgagggactaccctgaccgtaattcgtcggtctacctaacgtcgacgggaaccacacgtacccactcctacgacctacgtccgaacgggcccgggaacccgacgacccgaaacggtacgaaggaacggggtaacgtaccgttaacgttacgtacgggttacgtaacgggtccggtaaggtaacgtaaacgttaccgttaacggtttggttaacgggtttcgggttttaggggacccggggtaacggggtacccgaacggggttaccgttaccggtaccccgggttaccgtttaaaccggggtcccgttaaccgggaaccccggttaaaccggggtccccgttaccccgggttaccccccgttccgggttacccctaacccgtttccccgttcccggttccccccgttaaccccccg

SEQ ID NO: 2667 - DNA, 753 bp, Homo sapiens
  misc_feature: GYAE6OF01DQJKH.26.21.B10.1.454.CMB.1.raw
  modified_base (234)..(234): a, c, t, g, unknown or other
  misc_feature (234)..(234): n is a, c, g, or t
  modified_base (333)..(333): a, c, t, g, unknown or other
  misc_feature (333)..(333): n is a, c, g, or t
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggatccgtggccttcgatgagctgattcagcccaccctcagtgtccgtgtccccaggacagacagccaccatcacctgctcggcagacaaatggganatagaaatgctgcctggtattaccagagccaggccagtcccctatttggcatctccaagataagagcggccctgagggactcccgtgaccgtaatttcnggcctccaactcgtagggaaccacgacgcccaactctacgaccaatccgacggcccggggacccaggaccccgaaacggggatacgggaacggggtaacgtaaccgttaacgtaacgtttcggtaccgaggggtaccggttaggggaagtaaacgttaacgttaagtttacgggttaggtttacggggttttacgggaccgggggttaacggggtaaccccggtaaggggtcccgttacgggtaaccccgggtttacccggttaaacggggttccccgtaaaccgggtaccccccggtaaaacggggtcccccgttaccccggggtacccccccccggtttaccgggttaaccccgttaacccccgttcccggttttacccccggtttacccccccgtaaccccccgtttaaccccccgg

SEQ ID NO: 2668 - DNA, 557 bp, Homo sapiens
  misc_feature: GYAE6OF01B413Y.26.21.B10.1.454.CMB.1.raw
  modified_base (396)..(396): a, c, t, g, unknown or other
  misc_feature (396)..(396): n is a, c, g, or t
tcagagactatactcacgaccggtgctcgatttagtgtcgtcgcaaagagagagggggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattgggagatagaaatgctgcctggtattaccagaggccaggccagtcccctatttggtcatcttccaagataagaagcggccctcagggactccctgaccgtaatttctggcctccaactctacgggaacacacgccactctgaccatcacgccgggcccagccaacggntaggagggacgactacgtattcgtacgagggcgtagggagtaatacgtagttagtaggttggtttgggacggtagggaccgaggtccgtggaccgtccgtaggtcgacgccccgaaggcctccgcccccgtcggtccacttccgcgttccccgcccgtccg

SEQ ID NO: 2669 - DNA, 576 bp, Homo sapiens
  misc_feature: GYAE6OF01CM7PS.26.21.B10.1.454.CMB.1.raw
  modified_base (235)..(235): a, c, t, g, unknown or other
  misc_feature (235)..(235): n is a, c, g, or t
  modified_base (314)..(314): a, c, t, g, unknown or other
  misc_feature (314)..(314): n is a, c, g, or t
  modified_base (323)..(323): a, c, t, g, unknown or other
  misc_feature (323)..(323): n is a, c, g, or t
  modified_base (329)..(329): a, c, t, g, unknown or other
  misc_feature (329)..(329): n is a, c, g, or t
  modified_base (371)..(371): a, c, t, g, unknown or other
  misc_feature (371)..(371): n is a, c, g, or t
  modified_base (380)..(380): a, c, t, g, unknown or other
  misc_feature (380)..(380): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtcgtcccaggacagacacgccacatcacctgctcggcagacaaagtggganatagaatgctgcctgtatacagagccagccagtcctatttgcatctacagatagagcgctcgaggctcctgactattcngctcactcnggaacncacgccatctcgaccatcacggccgggaccacgaccaacggntggaagganaaccgtataagttgacgaggtcggtagggaataacttacgtaagttggttacggttggttacgggcgggaagggacccgagggaccttacgggtacccgttccggtacggtaccgaaccggtaccccgaaggtcccgtacccggtcccccggttcgtaccctacccgttcttacccgttccccgtaacccttcccg

SEQ ID NO: 2670 - DNA, 610 bp, Homo sapiens
  misc_feature: GYAE6OF01EJ8IU.26.21.B10.1.454.CMB.1.raw
tcagagactatactcacgaccggtgctcgatttagtgtcgtcgcaagagaggagggggggcctcaggaagcagcatcggaggtgcctcagccatggcatggatccctctcttcctcggcgtcctgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccagtcccctatttggtcatctccaagataagaagtggccctcgagggatccctgaccgaatttctggctccaactctgggaacacgagcccactctcgaccatccgaggccggggacccagcccgaaacggataggaagggagactacgtattgtacgagggccggtagggagtaagttaacgtagttaggtagtttgggtttagggacgggtagggtaccgaggccgtacggacccgtccgtaagggtccgaacggtaccccgaagggtcccgtaccggtcccccccgttcgggttaccgaccccttaccgttcccgttccccccaaccccgttcccccg

SEQ ID NO: 2671 - DNA, 562 bp, Homo sapiens
  misc_feature: GYAE6OF01EVIXP.26.21.B10.1.454.CMB.1.raw
  modified_base (235)..(235): a, c, t, g, unknown or other
  misc_feature (235)..(235): n is a, c, g, or t
  modified_base (362)..(362): a, c, t, g, unknown or other
  misc_feature (362)..(362): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctgtataccagagcaggccagtcccctatttggtcatcttccaagataagaagcgccctgaggactcccgtagaccgtaattctggctccaactctacggaacacagcccatcanacatcgagccgggcccagaccaaggataggaaggacactactattcgacgaggcggtaggaagtatactagttagtagttggtttaggacgggtacgggaccgaggtcgtggacccggttccgtacgggtccgtaccgtaccgaacggcctaccgccccgtacggtcctaccttccgttccgttccccgcccgttacccg

SEQ ID NO: 2672 - DNA, 664 bp, Homo sapiens
  misc_feature: GYAE6OF01CS2A9.26.21.B10.1.454.CMB.1.raw
  modified_base (237)..(237): a, c, t, g, unknown or other
  misc_feature (237)..(237): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcacgccaccctcagtcgtccgtcgtccccaggacagacagccacatcacctgctcggcagacaaagtggganatagaatgctgcctaggtactaccagaggccaggccagtcccttatttcgcatcttacaagaataagaacgccgacctcgaggactccctagaccgtaatttcgcggcctacctaacgtcgtacgggaacacgacgaccctactcgtacgacctatccgacgggccgggaccccaggaccgaaacggacgtagggaacgggaataaccgtagttacgtcggacgtagggcggtagggaagtaagtacgttaagttaggttaaggttcggtttacgggacgggtaacgggaaccgtacgggtacttacgggtaccccggttaccgtaacgggtcccgaaccggaccccgtaaacgggtccccgttcccggaccccccgttaccgggtacctaacccggttcccgttcccggttcccccggttaccccc

SEQ ID NO: 2673 - DNA, 664 bp, Homo sapiens
  misc_feature: GYAE6OF01BRBL5.26.21.B10.1.454.CMB.1.raw
  modified_base (235)..(235): a, c, t, g, unknown or other
  misc_feature (235)..(235): n is a, c, g, or t
  modified_base (337)..(337): a, c, t, g, unknown or other
  misc_feature (337)..(337): n is a, c, g, or t
  modified_base (360)..(360): a, c, t, g, unknown or other
  misc_feature (360)..(360): n is a, c, g, or t
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggatcccgtggccttcgatgagctgattcagccaccctcagtgtccgtgtccccaggacagacagccaccatcacctgctcggcagacaaattggganatagaatgctgcctggtatacgagacgccaggccacgtcccctagtttcgcactcttaccaagataagaacgccggcctcgaggactcctagaccgtattcnggctaccgaactcgtacggaacncaacgccacgtcctagaccctatccgacggccggggacccacggtacccgaacgggacgtacgggaagggtaacgtaaccgttacgtaacgtttcggtacggagggtaccggtaggggaataaacgttaacgtacgtttaggtacggtttagggttacgggtacggggacggtaaccgagggtaccgtaggtaccccgttacgtaacgggtccgacggtaccccgtaagggtccccttacccggtaccccccgttacggtaccctacccgtcccgtttccgtccccccgttaccccgttacccg

SEQ ID NO: 2674 - DNA, 720 bp, Homo sapiens
  misc_feature: GYAE6OF01A543E.26.21.B10.1.454.CMB.1.raw
  modified_base (341)..(341): a, c, t, g, unknown or other
  misc_feature (341)..(341): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttgggagatagaaatgctgcctggtattaccagaggccaggccagtcccctagttttggtcatcttccaagataagacgcggccctcgaggactccctgaccgtaatttcgnggcctccaactcgtacgggaacacgacgcccactcctacgaccatccgacggccggggccccaggaccccgaaacgggacgtacggaacggggacgaaccgttacgttaacgttcggtaccgacgggtcggtacggggaagtaaacgttaccgttaagtttacggttaagggtttcgggttttacggggtaccggggtaagggggtaccccgtaacggggtaccgttaccgggtaccccgggttacccggttaacgggttacccgaaccgggtaacccccggtaaacggggtccccgttacccgggtccccccccggttaccgggttacccctaacccggtttccccgtttcccggtttacccccccgtaaccccccgg

SEQ ID NO: 2675 - DNA, 766 bp, Homo sapiens
  misc_feature: GYAE6OF01D7CED.26.21.B10.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagaggagggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacacgcccaccatccacctgcctcggcagacaagtggganatagaatgctgcctgtactaccagacgccacgccacgtccccttagtttcggtctacttccttaccgaaagaataaacggaacggcccggtaccctacggaacgggtactaccccgtacggtaacccgttaacgttttccgtacggtaccttacccgaaaccgttcggtaacgggaaaccaccgaaccgaccctaaccgttccgtaccgaaccctaactccggaaccgggacccggggaccccaacggacccgaaacgggtacggtacgggaacggggtaacgtaacctttaacgttacgttacggtaccggaggggtaccggttaagggtaaacgtaacgttaacgttaagtttaggttacgggtttagggtttacggggacggggtacgggaaccgtagggtccgtacgggtaacccgttccggtaacgggtccgaaccgggtaccccgaacgggtcccgtccccggtaccccccgttacgggtccctacccgttccgtccccggttcccccgtccccgttacccg

SEQ ID NO: 2676 - DNA, 700 bp, Homo sapiens
  misc_feature: GYAE6OF01EO0MH.26.21.B10.1.454.CMB.1.raw
  modified_base (240)..(240): a, c, t, g, unknown or other
  misc_feature (240)..(240): n is a, c, g, or t
  modified_base (344)..(344): a, c, t, g, unknown or other
  misc_feature (344)..(344): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacacgccacatccacctgcctcggcaagacaagttgganatagaatgctgcctggtatacagagccaggccagtcccctatttggctagtccttaccaagtataagaacgcggccctcgagggtactcctgaccgtaatttcnggactccaactcgtagggaacacgacgaccactcgtacgacctataccgaggccgggacccaggaccccgaaagggacgtacgggaacgggacgtaaccgttaacgttaagttcggtacgagggtcggtaacggggaataacgttaacgttaggtttaggtaacggtttcggggtttagggaccggggtaacggggtacccgtagggtcccgttagggaaccccggtttccggtaacgggttcccgaaccgggtaccccggtaaacgggtccccggttacccgggtcccccccgttacgggtacccctaaccggtttccccgttccccgggtttccccccgtccccgtttaccccg

SEQ ID NO: 2677 - DNA, 749 bp, Homo sapiens
  misc_feature: GYAE6OF01ED523.26.21.B10.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcgcagacaatggganatagaaatgctgcctggtatacagagccaggccacgtccccttatttcggtcatcttaccaagataagagccgcctgacggactcctagaccgtaatttcgcggtctacccaacgtcgtacgggaactacgacgacccactcgtacgacccagtaccgacggcccggggtaccccaacggaccccgaaacggggacgtacgggaacggggtaacgtaacccgttaacgttaacgtttacgggtaccgtaacggggtaccgggttaagggggtaagttaaacgtttaacgttaaaggttttacgggttaagggttttaggggttttaccggggtaaccggggtacggggtaacccggtaggggtcccgttacggggtaaccccggttacccggtaacgggtacccgtaaccgggtacccccggtaaacgggtccccgtacccgggtacccccccggttaccgggttaccctacccgttccccgttacccgtttaccccccgtacccccgtttaccccg

SEQ ID NO: 2678 - DNA, 881 bp, Homo sapiens
  misc_feature: GYAE6OF01D2JZ9.26.21.B10.1.454.CMB.1.raw
  modified_base (179)..(179): a, c, t, g, unknown or other
  misc_feature (179)..(179): n is a, c, g, or t
tcagagactatactcacgaccggtgctcgatttagtgtcgtcgcaagaggaggaggggggggcctcaaggaagcagcatcggaggtgccctcagccatggcatggatccctctcttcctcggcgtccttgcttactgcacaggatccgtggccttcgatgagctgattcagccaccctnagtgtccgtgtccccaggacagacacgccaccatcacctgcctcggcagactaaagttgggagatagaatgctgccttggtattaccgaggacggccgacggccctacgtccccttaagttttcggtcctattccgtttaccgaaaggtaacgtaaaggaaccggcccgggtacccccttacggaacggggtacccttacccccgtacggtaaccccgttaaacgtttttcccgacgggtacccttaccccgtaaaccgttccgttacggggaaaacctaccgtaacgcccctaaaccgttccgtacggaaaccctaagtaccgtaaccgggacccggggtaccccaacggtaccccgaaaccggggtacgtacgggaacggggtaacgtaaccgttaacgttaacggtttacggtaccgtaacgggtaccgggttacggggtaagtaaaccggttaaccgtttaagtttacgggttaaggtttcgggtttacgggtaccggggtaacgggtaacccggtaggggttaccgttaaccgggttaacccggttaccccggttaacgggtacccggtaacccggtacccccggttaaaccgggtcccccgttacccgggttccccccccggttacgggttcccccgttaacccggtttacccggttccccggtttaccccccggtccccccgttttaacccccgg

SEQ ID NO: 2679 - DNA, 601 bp, Homo sapiens
  misc_feature: GYAE6OF01EEFMM.26.21.B10.1.454.CMB.1.raw
  modified_base (181)..(181): a, c, t, g, unknown or other
  misc_feature (181)..(181): n is a, c, g, or t
  modified_base (242)..(242): a, c, t, g, unknown or other
  misc_feature (242)..(242): n is a, c, g, or t
  modified_base (337)..(337): a, c, t, g, unknown or other
  misc_feature (337)..(337): n is a, c, g, or t
tcagagactatactcacgaccggtgctcgatttagtgtcgtcgcaagagaggaagggggctgggcctcaggaagcagcatcggaggtgcctcagccatggcaatggatccctctcttcctcggcgtccttggctttactgcacaggatccgtggccttcgatgagctgattcagccacctnagtgttccgtgtcccaggacagacagtccaccatcacctgcctcggcagacaaagttgganatagaaatgctgctggtattaccagagcaggccagtcccctatttggctatcttccaagataagagcgcctgaggactccctgaccgtaatttcngctccaactcgtggaacacacgcccactctacggacctagtcgacggccggggacccaagacccgaaacggactcgggaagggacgtacgtaactacgttagaccgaggcgtagggaacgtaattaccgtagttagtagtttggtttcggacgggtacgggaccgagggtacctacggacccgttccgtaacggtccgacggtacccgaaggtcccgtacccgtcccccgttcggtaccctaccgttccgtccggttacccccc

SEQ ID NO: 2680 - DNA, 852 bp, Homo sapiens
  misc_feature: GYAE6OF01DXAY0.26.21.B10.1.454.CMB.1.raw
  modified_base (179)..(179): a, c, t, g, unknown or other
  misc_feature (179)..(179): n is a, c, g, or t
  modified_base (238)..(238): a, c, t, g, unknown or other
  misc_feature (238)..(238): n is a, c, g, or t
tcagagactatactcacgaccggtgctcgatttagtgtcgtcgcaagagaggagggggctgggcctcaggaagcagcatcggaggtgcctcagccatggcatggactccctctcttcctcggcgtccttgcttactgcacaggatccgtggccttcgatgagctgattcagcccacctnagtcgtccgtcgtccccaggacagacagccacatccactgctcgacagacaagtggganatagaatgctgccgtaggtactacgaggacgccgacgcctacgtcccttagtttcggctactccttaccgaagtaacgtaacggacgccggaccctaggaacgggtaccttacccggtacgtaacccgttaacgtttccgacggtaccctaacctaaacgttccggtaacgggtaaaccaccgtaacgccctaaccttaccgtaccgaaccctacgaccggaccgggtaccccgggggaccccaaccgggaacccggtaaaccgggtacggttaacggggaaaccgggtaaccgttaaccgtttaacggtttacggtttacggtaccggggtacggggttacgggtaacgggggtaacgtaaacgttttaaccgttaagggttttacggggttaacggggttttacggggtttaaccgggggacgggtaacccgggggttaacccggtaccgggtacgggttaccccgggtaaaccccggtttacgggttaacccggtacccgggtaacccggggtacccccggaaacccgggttccccgtacccccggttaccccccgggtttacccggaaccctttacccggttccccccggtttccgggttaccccccccg

SEQ ID NO: 2681 - DNA, 802 bp, Homo sapiens
  misc_feature: GYAE6OF01DXVDW.26.21.B10.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccacctcagtcgtccgtcgtccccaggacagacacgccaaccatcacctgctcgcagacaaagttggganatagaatgctgcctggtattaccagacgccagccacgtcccctttagttttcggtcattaccttaccgaagtaataaggaaggccggtaccctacgacgggaccttcccgtacgtaaccgtaagtttcgcggtacctacctaaccgttcgtaacgggaaacaccgtacgaccctacttaccgtacggaaccctacgtccgaaaccgggtcccgggggacccccaacgggaccccgaaaaccggggtgttacgggaaacggggaacctaacgttaacgttacggtttaccggtaccggtaaggggttccgggttaagggggaaacttaaacggttaacctttaagggtttacggtttaaacgggttttcggggttttacggggaccggggaaccggggttaaccggacgggttacggtaacccggtacccggttacccgggttacgggtaaccgaacccgggtaaccccggtacgggtccccgttaccccgggtacccccgttacgggttaccccttaacccgtttcccggtttccccggttacccccgtccccgtttaaccccg

SEQ ID NO: 2682 - DNA, 609 bp, Homo sapiens
  misc_feature: GYAE6OF01B33T1.26.21.B10.1.454.CMB.1.raw
  modified_base (234)..(234): a, c, t, g, unknown or other
  misc_feature (234)..(234): n is a, c, g, or t
  modified_base (331)..(331): a, c, t, g, unknown or other
  misc_feature (331)..(331): n is a, c, g, or t
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgcctggtattaccagagccaggccagtcccctattttggcatcttccaagataagaagcgccctgagggactcctgaccgaatttcnggctacccaactcgtaggaacacacgccactctgaccatccgagccggggccccagcccgaaacgggagtaggagggatacctacgtagttgacgacgggcgtagggaagtaagtacgttagttgttaggttgggttttagggcgggaacgggtaccgagggtcgtacggtacccgtccgtagggttacgaccggtaccccgaacgggtcccgtccggacccccccgttcgggtaccctaaccgttcccgttccgttccccccgccccgtttaccccg

SEQ ID NO: 2683 - DNA, 692 bp, Homo sapiens
  misc_feature: GYAE6OF01EFF71.26.21.B10.1.454.CMB.1.raw
  modified_base (243)..(243): a, c, t, g, unknown or other
  misc_feature (243)..(243): n is a, c, g, or t
  modified_base (358)..(358): a, c, t, g, unknown or other
  misc_feature (358)..(358): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctcagtcgtccgtcgtccccaggacagacagccaccatcacctgctcggcaagaacaaagttgggaanataagaatgctgcctaggtactaccgagacggccaggcctacgttccccttattttcggctattcctaccaagtataagacgccgcctcgaggtactccgtagacctaatttcgnggtcctacctaactcgtacgggaacctacgacgccctaactcgtacgaaccacgtcgacgggcccgggacccgacgacccgaacgggagtacgggaacgggtaacgtaacgttaacgttacgttacggtacggtacgggtacgggtaacgggaacgttaacgttaacggtttaagttagggttaggtttcgggtttagggaccgggtaacgggaccgtacgggtccgtacggtacccggttaccggtaggtccgaaccggtacccgacggtcccgtcccgtacccccgttcggtaccctaccgttaccgttcccgttcccccgcccgttacccg

SEQ ID NO: 2684 - DNA, 664 bp, Homo sapiens
  misc_feature: GYAE6OF01EPJLH.26.21.B10.1.454.CMB.1.raw
  modified_base (178)..(178): a, c, t, g, unknown or other
  misc_feature (178)..(178): n is a, c, g, or t
  modified_base (238)..(238): a, c, t, g, unknown or other
  misc_feature (238)..(238): n is a, c, g, or t
  modified_base (474)..(474): a, c, t, g, unknown or other
  misc_feature (474)..(474): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggactccgtggccttcgatgagctgattcagcccaccctnagtcgtccgtcgtccccaggacagacacgccaccatcacctgctcggcagacaagtgganatagaatgctcgcgtagtactacgagacggccacggcctacgttccccttagttttcggtactacttcttaccgaaagtaagtaaacggaacgccggtaccctcggaacgggtactccccgtagtaacccgttaatttccgtacggtaccctaccgtaacctacggtacgggaaaccacgaacgcctaactcacgaaccactaccggacggcccgggacccacgaccgaacggganacggaaggactactacgtagttcgacgaggtcggtaggaacgtaatacgtagttaggtagttgggttacgggacggaggtaccgtaggtccgtacggtcccgtaccgtaggtccggacgtacccgacggtcccgtcccggtaccccgttcggtacctaccgttccgttacccgttccccgccctttaccg

SEQ ID NO: 2685 - DNA, 763 bp, Homo sapiens
  misc_feature: GYAE6OF01CQ7DB.26.21.B10.1.454.CMB.1.raw
  modified_base (269)..(269): a, c, t, g, unknown or other
  misc_feature (269)..(269): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaaattgggagataagaatgctgcctggtataccagagccaggccngtcccctatttggcatctccaagataagaagcggccctgagggactcccagaccgtaatttctgcctccaactctacgggaactacacgcctaacgtcctacgacccatccgacggccggggaccccaggaccccgaaacgggactacgggaaggggaacgtaaccgttaaccgtaagtttacggtaccggaaggggtacccggtttagggggaaacggtaaaacgtttaaaccggtttaagttttacggggtttaaggtttaggggttttttaccgggggaacgggggttaaccggggggtaaccccggggtacgggttacccgggtaacccgggttaccccggttaaaccgggttaccgggacccgtacccgggtaaccccgggtaacggtccccgggttaccccccggtacccccgggttaccgggttaccccgttacccggtttccccgtttaccccccgggttcccccgtacccccggtttaaccccgg

SEQ ID NO: 2686 - DNA, 790 bp, Homo sapiens
  misc_feature: GYAE6OF01CXAUF.26.21.B10.1.454.CMB.1.raw
  modified_base (252)..(252): a, c, t, g, unknown or other
  misc_feature (252)..(252): n is a, c, g, or t
tcagagactatactcacgaccggtgctcgatttagtgtcgtcgcaagagaggagggggctgggcctcaggaagcagcatcgggaggtgcctcagccatggcatggatccctctcttcctcggcgtccttgcttactgcacaggatccgtggccttcgatgagctgattcagcccaccctcagtcgtcccgtcgtcccccaggaccagacacgccaccatccacctgcctcggacagaacaaagttggggaanagtaagaatgactgcctaggtacttaccgaggacggccgaggcctacgttccccttagttttcggtcacttaccttaccgaaagataaggaacgccggaccctgaacgggtacctacccgtacggtaaccttaacgtttccgtacggacctacccgtaaaccgttcgtaacgggaaaccctacgtaaccgtaccctaacgttacctacggaaccctacgttaccggaccgggaccccggggaccccaaacgggacccgaaacgggtacgtagggaacgggtaacgtaccgttaacgttagttcggtacggtacgggtcgggttaagggaacgtaacgttaacgttagtttgggtacgggtttacgggtttacggggaccgggggtacggggtaacccggtcggttacccgggtaccggttaccggttacggggaccctaacccgggtaccccggtaaccgggtcccgtacccccggttcccccggttaccggtaccctaccgggtttcccctttcccgggttccccccgttacccccg

SEQ ID NO: 2687 - DNA, 608 bp, Homo sapiens
  misc_feature: GYAE6OF01EC6YE.26.21.B10.1.454.CMB.1.raw
  modified_base (234)..(234): a, c, t, g, unknown or other
  misc_feature (234)..(234): n is a, c, g, or t
  modified_base (415)..(415): a, c, t, g, unknown or other
  misc_feature (415)..(415): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcacctgctcggcagacaagttggganatagaatgctgcctggtactaccgagaggccaggccacgtccccttatttcggctatcttaccaagataagacgcgcctgaggactccgtgacctattcgcgtctaccaactcgtacggaacacgacgacctactcgtacgaccatccgacggcccgggacccaaggacccgaaacggganacgggaagggtactaaccgttacgtagttcgacgacgggtcggtaggacgtaatacgttagttggttaggttgggtttagggacgggaggaccgtaggcgtacggaccggttcgaggtcgaccgtaccgaagggccctacccgcccccgttacggtccctaccgttccgttccgttccccctcccgttacccg

SEQ ID NO: 2688 - DNA, 698 bp, Homo sapiens
  misc_feature: GYAE6OF01BK8AC.26.21.B10.1.454.CMB.1.raw
  modified_base (248)..(248): a, c, t, g, unknown or other
  misc_feature (248)..(248): n is a, c, g, or t
  modified_base (342)..(342): a, c, t, g, unknown or other
  misc_feature (342)..(342): n is a, c, g, or t
tcagagactatactcacgaccggtgctcgattttagtgtcgtcgcaagtacgagtaccggggggaaacctaccgtgtcgccccaccatggacaccggcctttgctccacgctcctgctggctgaccatcccttcatcgggtcttggtcccaagtatactaccgttgaagggaggtctgggtcctgcgcttaggtggacgacccacgacacgacccgtcgacgctagacctgctccgtctctggattcncactccaccaccgactgagtcgaagtgtggcctgggtaccggtctacgggccccggaagggccctggagttgcttaggcactcgtattttacgnggtacgtgtactccgtcaaaggtccggttacaagtacccgggtccgttcgtacgaaggaacttccggaactaccaacctactacaacccgaagggacctaccgtaacctaaaacggaaccgggttaggtacccttaacgaacgtcgaaccgaccagtacggaacttccgtacgttaggaacctacgagggctaacgaagtttacttactcgtacgaccaccgtaccctaggttcctaggtccggtactaccggcgaagggaaaacaggtaactggtaacttcggtcggggacctagggtactttccggaccaacccggtcctaccccgagtcccctcccgtacccgtaacccgggg

SEQ ID NO: 2689 - DNA, 704 bp, Homo sapiens
  misc_feature: GYAE6OF01AHQZC.26.21.B10.1.454.CMB.1.raw
  modified_base (174)..(174): a, c, t, g, unknown or other
  misc_feature (174)..(174): n is a, c, g, or t
  modified_base (238)..(238): a, c, t, g, unknown or other
  misc_feature (238)..(238): n is a, c, g, or t
  modified_base (299)..(299): a, c, t, g, unknown or other
  misc_feature (299)..(299): n is a, c, g, or t
  modified_base (598)..(598): a, c, t, g, unknown or other
  misc_feature (598)..(598): n is a, c, g, or t
tcagagactatactcacgaccggtgctcgatttagtgtcgtcgcaagagaggagggggggcctcaggaagcagcatcggaggtgcctcagccatggcatggatcctctcttcctcggcgtccttgcttactgcacaggatccgtggccttcgatgagctgattcagtcaccctnagtgtccgtgtcccccaggacagacacgtccaccatcacctgctcggcagactaaagttggganatagaaatgtctgcctggtataccaggtagccaggcctagtccccttagttttcggtactntaccttcaagataaggaacgccggacccttagacgggtactcccgttacgaacccgttaatttcgacggtcctaccctaacgtaccgtacggggaaccacgaaccggtccctaacgttcccgtacggaccctaacgtccgacgggaccccgggcccctaacgggaccccgtaacggggacctagggaacgggtacggtaaccttaccgttacgttacgtaccggacggtacgggtacgggaagttaacgttaacgttcgtttaggtaacgggttgttacgggtaccgggtagacccggnggtaccgttacggaccgttaccggtaccggtccgaaccggtcccggtagtccccggttcccgccctaccggtcctaccgtcccttccggtcccctcccgttacccg

SEQ ID NO: 2690 - DNA, 698 bp, Homo sapiens
  misc_feature: GYAE6OF01BCT70.26.21.B10.1.454.CMB.1.raw
  modified_base (178)..(178): a, c, t, g, unknown or other
  misc_feature (178)..(178): n is a, c, g, or t
  modified_base (250)..(250): a, c, t, g, unknown or other
  misc_feature (250)..(250): n is a, c, g, or t
  modified_base (361)..(361): a, c, t, g, unknown or other
  misc_feature (361)..(361): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctnagttcgtcccgtcgtcccccaggacagaccagcccaccatccacctgcctcggacagactaaagttgggaanataagaaatgctgcctaggtactacagacggccaggccacgtcccctatttggacattctacaagataagacgccgcctgacggtactcccgtagacccgtaattttccgnggtaccctacctaacgtccgtacgggaaactaccgacgtaccctacgttctacgaacccattccgacggacccgggacccacggacccggaaacggagtacgggaacggaacgtaaccttaacgttagttacggtaccgtaggggtaccggtaagggtaagtaaagttaccgttaagtttacgggttaggttcgggtttagggacgggtacgggaccgacgggtccgtacgggaccgttaccggtaacggtccgtaacggacccgtacggtcccctaccggtccccccgttacgtcccgtaccgtacccggttcccgttccccggtcccttaccccg

SEQ ID NO: 2691 - DNA, 698 bp, Homo sapiens
  misc_feature: GYAE6OF01CLYDJ.26.21.B10.1.454.CMB.1.raw
  modified_base (250)..(250): a, c, t, g, unknown or other
  misc_feature (250)..(250): n is a, c, g, or t
  modified_base (326)..(326): a, c, t, g, unknown or other
  misc_feature (326)..(326): n is a, c, g, or t
tcagagactatactcacgaccggtgctcgatttagtgtcgtcgcaagagaggaggggggggcctcaggaagcagcatcggaggtgcctcagccatggcagtggactccctctcttccgtcggcgtccttgcttactgcacaggactccggtgtccttgatgagctgtactcgacgccctaccctgagttcgtccgtcgtccccaggacagacacgccacatcacctgctcggacagaactaagtgggaanataagaatgactcgtctagtaactacgagacgccgacggcctacgttccttagtttcggctacttcctacaagtanaaggacgccgtaccagacggcctccgaagtacgttattcgacgtcctaaccaacgtcgaacggaacaccgactacctactacgtacgacctacgcggaccgggcccgggtaccacggaaccggtaacggagtacggaacggaactacttacggtataggccggtaagggcgtaagggaataacgttagttgttacgggttaggttaggggtaacgggacgggtacgggtaaccgtagggtcccttacgggaccccgttacggtaacggtacccgacccgggtaaccgtacggtccccttaccccgggggaccccttttccgaacccgttcccttacccggtttaacccccgtcccccgttaacccgttaccg

SEQ ID NO: 2692 - DNA, 756 bp, Homo sapiens
  misc_feature: GYAE6OF01D5NR3.26.21.B10.1.454.CMB.1.raw
tcagagactatactcacgaccggtgctcgatttagtgtcgtcgcaagagaggagggggactgggccctcaggaagcagcatcggaggtgcctcagccatggcatggatccctctcttcctcggcgtccttgcttactgcacaggactccgtggccttcgatgagctgattcagccaccctcagtgtccgtcgtccccgaggacagacagccaccatcacctgctcggcagacaaagttggagatagaaatgctgcctggtacttacagaggccaggccacgtccccttagttttcggtctatctacaagagtaacgagccggccctacgaacgggactcccgtagaaccgtaatttccgtacggtcctacccgtaaactccgtacggggaaaccaccgacgacccctaactcctacgaacccactccgacgggacccggggaccccaacggaccccgaaacgggacgtacgggaacgggaacgtaaccgttaacgtacgtttcggaccgtaagggtcgggtaacggggaagtaaacgtttaaccgttaaggtttacggtttaagggtttacgggttttacggggtacggggttaacggggacccggtaacggggtaccgggttaccgggtaacccggttcccgggttaacgggttacccgaaccgggtacccccgaaacggggtccccgttacccggacccccccgtttacgggttaccccttacccggttcccgttccccggtttaccccccccg

SEQ ID NO: 2693 - DNA, 653 bp, Homo sapiens
  misc_feature: GYAE6OF01B38CF.26.21.B10.1.454.CMB.1.raw
  modified_base (240)..(240): a, c, t, g, unknown or other
  misc_feature (240)..(240): n is a, c, g, or t
  modified_base (458)..(458): a, c, t, g, unknown or other
  misc_feature (458)..(458): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggactccgtggccttcgatgagctgattcacgcccaccctcagtcgtccgtcgtccccaggacagacacgccaccatccactgctcggcagacaagtggganatagaatgactgcctgtattaccagacggccaggccagtccctagtttcgcatctacaagtataagagcgccagaggtactccgtagaccgtaatttcgcggaccttacccgaacgttccgtacgggaaaccaccgacgacccaacgttcctacgaaccagtacccgacggcccggggacccaaccggacccgtaaacgggacgtacggaacgggtanaaccgttactagttcggtacgacgggcggtacgggaagtaacgttacttagtacgttaggttcggttagggcggagggtacgacggtcgtcgggacgttccgtaggtaccgacggtacccgaacggtcccgtcccggtaccccccgttcggtaccctacccgttcccttacccgttccccgtaccccgttacccg

SEQ ID NO: 2694 - DNA, 721 bp, Homo sapiens
  misc_feature: GYAE6OF01CEDEV.26.21.B10.1.454.CMB.1.raw
  modified_base (239)..(239): a, c, t, g, unknown or other
  misc_feature (239)..(239): n is a, c, g, or t
tcagagactatactcacgaccggtgctcgatttagtgtcgtcgcaagagaggagggggggggcctcaggaagcagcatcggaggtgcctcagccatggcatggatccctctcttcctcggcgtccttgcttactgcacaggatccgtggccttcgatgagctgattcagcccacctcagtgtccgtcgtccccaggacagacacgccacatcacctgctcggcagaacaagttgggaanataagaatgctcgaccgttaggtacttaaccgagacggccacggccacgttccccttagttttcggctattcctaccaagagtaagacgccgtacctacgacgggtactcccacggtacctaagtttcgtcggcctaccaactcgtacggaaccacacgcctactcctacgaccatccggacggcccgggacccacggacccgaaacggagtacgggacgggtaacgtaaccgttacgtagtttcggacggtaggggaccgggtttaagggaacgttaaacgttacgtttaggtttaacggttacgggtttgggttacggggaccggggtacgggtaaccggtagggtccgtacgggtacccggttaccgtacgggtaccgtaaccgtaccccgggtacggtccccgtccccgggtacccccgtttacgggtacccttaacccgttcccgttaccccggttccccctaaccccgtttacccg

SEQ ID NO: 2695 - DNA, 674 bp, Homo sapiens
  misc_feature: GYAE6OF01EPFCN.26.21.B10.1.454.CMB.1.raw
  modified_base (237)..(237): a, c, t, g, unknown or other
  misc_feature (237)..(237): n is a, c, g, or t
  modified_base (348)..(348): a, c, t, g, unknown or other
  misc_feature (348)..(348): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttgatgagctgattcagcccaccctcagtcgtccgtcgtccccaggacagacacgccaccatcacctgctcggcagacaagtggganatagaatgctgcctggtattaccgagaggccaggccagtccccttattttgcatcttaccaagtataagaacgccggccctacagggactcccgtagacccgtaatttcgnggtcctaccaactcgtacggaacacgacgacccactcgtacgaccagtaccgagggcccgggtacccagaccccgaagggtagtaggaacgggatacgtaacgttagttacgacgtacgggacggtagggaactaagttacgttaagtttggtaaggttgggtttacgggaccggggtaggaacccggtagggtccgtacggtaacccgggttcgtaacgggttaccgaccggtacccggaacgggtccctaccccgggttcccccgtacgggttaccccaaccccgttttccgtccccggtttccccccgcccccgtttacccgg

SEQ ID NO: 2696 - DNA, 755 bp, Homo sapiens
  misc_feature: GYAE6OF01EO10J.26.21.B10.1.454.CMB.1.raw
  modified_base (242)..(242): a, c, t, g, unknown or other
  misc_feature (242)..(242): n is a, c, g, or t
  modified_base (363)..(363): a, c, t, g, unknown or other
  misc_feature (363)..(363): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggactccgtggccttcgatgagctgattcagccaccctcagtgtccgtcgtccccaggacagacacgccaccatcacctgcctcggacagactaaagttggganatagaatgctgctggtacttaccagacgccagccacgttccccttagtttcgtactactcttaccaagtataacgacggccggtaccctcgacgggtactcccgtagtaccgtaatttcgngtacctacctaaccgtcgtacggaacaccgacgccctactcgacgaacctacgtaccgacgggccccgggtacccacgacccgaacgggtagtacgggaacgggtaacgtaaccgttaagttcgttacggtaccggtagggtaccgggtacgggtaaagttaacgtttaacgttaggttttacgggttaggttttacggggttacggggtaccggggtaaccggggtaaccgtaggggtacccgtaccgggttaccccggttacccggttaacgggtacccggtaacccgggtaccccggtaacgggtccccgttacccccggtccccccggttaccggttcccgttacccgttccccggttccccggttccccccgtccccgttaccccgg

SEQ ID NO: 2697 - DNA, 684 bp, Homo sapiens
  misc_feature: GYAE6OF01C0443.26.21.B10.1.454.CMB.1.raw
  modified_base (218)..(218): a, c, t, g, unknown or other
  misc_feature (218)..(218): n is a, c, g, or t
  modified_base (254)..(254): a, c, t, g, unknown or other
  misc_feature (254)..(254): n is a, c, g, or t
tcagagactatactcacgaccggtgctcgatttagtgtcgtcgcaagaggaggagggggggcctcaggaagcagcatcggaggtgcctcagccatggcatggactccctctcttcctcggcgtccttgcttactgcacaggatccgtggccttcgatcgagctgattcacgcccaccctcagtcgtccgtgtccccaggacagacacgcccaaccgtntcacctgccgtcggaccgaagactaaagttgggganaattaacggaaatgctgcgtaggtactacgagacggccaggacctacggtccccttagttttcggctacgttccttaccgaaagtacgaaggaaccgtcggccccttagacgggactcccgtagacccgtaagtttccgcgacctaccgaacgttcgacgggaacacgaacgtccaacgtcgtacgaccgtagccgaacggcccggaccacgaccgaaacggagtacggaacgggtacgaactacgttaaggttcgtacgggaacggtcgggtagaagttaaacgtaagttagttaggttacggtggttagggaccgggtacggaccgtaggccgtacggaccggtcgtacgtaaccgtccggaccgtacggccttcccggaccccgttgggaccctacgttcccgtacccgttcccctcccgttaaccg

SEQ ID NO: 2698 - DNA, 554 bp, Homo sapiens
  misc_feature: GYAE6OF01APJ8G.26.21.B10.1.454.CMB.1.raw
  modified_base (174)..(174): a, c, t, g, unknown or other
  misc_feature (174)..(174): n is a, c, g, or t
  modified_base (205)..(205): a, c, t, g, unknown or other
  misc_feature (205)..(205): n is a, c, g, or t
  modified_base (234)..(234): a, c, t, g, unknown or other
  misc_feature (234)..(234): n is a, c, g, or t
  modified_base (324)..(324): a, c, t, g, unknown or other
  misc_feature (324)..(324): n is a, c, g, or t
  modified_base (362)..(362): a, c, t, g, unknown or other
  misc_feature (362)..(362): n is a, c, g, or t
  modified_base (380)..(380): a, c, t, g, unknown or other
  misc_feature (380)..(380): n is a, c, g, or t
  modified_base (492)..(492): a, c, t, g, unknown or other
  misc_feature (492)..(492): n is a, c, g, or t
  modified_base (539)..(539): a, c, t, g, unknown or other
  misc_feature (539)..(539): n is a, c, g, or t
tcagagactatactcacgaccggtgctcgatttagtgtcgtcgcagaggagaggggctggcctcagagcagcatcggaggtgcctcagccatggcatggatccctctcttcctcggccgtccttgccttactgcacaggatccgtggccttcgatgagctgattcagcaccctnagtgtccgtgtcccccaggaccagacagccnccatcacctgctcggcagcaaattggganatagaaatgctgcctggtattaccagaggccaggccagtccccctaattttggtcatcttcctaagactaagaagtcggccctcaggggntaccctgaccgaatttctgggctccaactctgggaacncagcccactctcgtaccnctcacgcggggccccagccctaacggatcggaggacggactaacctagttacgttcgacggcgtgggacggaataaccgtattgtagtcgttttgccggtaggaccgacggntccgaccgtcctacgggtctagccccgaagccttacgcccctcggtnactctcgttcccccg

SEQ ID NO: 2699 - DNA, 832 bp, Homo sapiens
  misc_feature: GYAE6OF01BGHZJ.26.21.B10.1.454.CMB.1.raw
  modified_base (244)..(244): a, c, t, g, unknown or other
  misc_feature (244)..(244): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggactccgtggccttcgatgagctgattcacgcccaccctcagtcgtccgtgtccccaggacagacacgccaccatccacctgcctcggcagactaaagttggganataagaatgactgccgtaggtacttaccgagtacggaccacggccacgttcccccttagttttcggtctacttccttaccaaagtaactaaacggaacggccggtaccctacggaacgggtacctccccgtacgtaacccgtaactttccgtcggacccttacccgtaaccgtcgtaacgggaaaccaccgacgaccctactcgtacgacctacgtcgaccgggcccggggacccaacggacccgtaaacgggtacgtagggaacgggtaactaccgttaacgttcggtttaacggtccggacgggtaccggggtacgggtaagttaaacgttacgttaagtttaggttagggtttcggggtttacgggggaccggggttaaacgggacccggtaacgggtccggtaccgggtaaccccgggttaccgtaaccggggtacccggtaacccgggtaaccccggtaaacccggggttccccgttacccccgggttaccccccccgttaccggggttaacccccttacccggttttaccccgggttaccccccggtttacccccccgggttccccccgtttaacccccggg

SEQ ID NO: 2700 - DNA, 931 bp, Homo sapiens
  misc_feature: GYAE6OF01DQTUY.26.21.B10.1.454.CMB.1.raw
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagcccaccctcagtcgtccgtcgtccccaggacagacacgccaccatcacctgctcggacagacaagttggagatagaaatgctgcctagtacttaccgagacggccacggtccacgttaccccttagtttcggtactacttccttaccaaagtaactaaacggaacggccggtaccctacggaacgggtacctaccccgtacggtaacccgttaacgttttccgtacggtacccttaaccgtaacccgttaccggttaacggggaaaaccctaccgaacgtaccccgtaaccgttacccgtaaccggtaaacccctaacgtacccgggaaccgggggtacccccgggggacccccgaaaccgggtaaccccggaaaaccggggtaacggttaacgggggaaaccgggggtaaacgtaaccccgtttaacccgtttaaggttttaccgggtaccgggtaacgggggttaccgggttaaacggggaacgttaaaccgtttaacgggtttaagttttaaggggtttaaacgggttttgggggtttaccggggggtacgggggaaaccggggttaccggaccggggttacccggttaaccgggtaaccccggttaacccgggttaacggggtaccccggtaaaccggtacccccgggtaaaccgggtccccgtaccccccgggttacccccccggttaccgggttcccgttaacccccgttacccggtttaccccccggttacccccccgtaccccctttaccccggg

SEQ ID NO: 2701 - DNA, 565 bp, Homo sapiens
  misc_feature: GYAE6OF01CNEMM.26.21.B10.1.454.CMB.1.raw
  modified_base (236)..(236): a, c, t, g, unknown or other
  misc_feature (236)..(236): n is a, c, g, or t
  modified_base (411)..(411): a, c, t, g, unknown or other
  misc_feature (411)..(411): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttaccgcacaggatccgtggccttcgatgagctgattcagccaccctcagtgtcccgtgtccccaggacagacagccaccatcacctgctcggcagacaaattggganatagaaatgctgcctggtataccagagccaggccagtccctatttggtcatcttaccaagactaagaagcggccctcgagggatcccgtagaccgtaattctggctacaaactcgtacgggaacacacgaccactctagaccatcgagcgggacccacgacaacggatgaggaanacgtactatcgtcgaggcgtggagtaagtactagttagtaaggttgttgggtacggaagggtaccgaaggccgtgaccgtcctagggtccaggtcccgaaaggcgtccggtccccctcggtacctactccgtgttcccccgcccgtccctaccg

SEQ ID NO: 2702 - DNA, 666 bp, Homo sapiens
  misc_feature: GYAE6OF01CVVHO.26.21.B10.1.454.CMB.1.raw
  modified_base (178)..(178): a, c, t, g, unknown or other
  misc_feature (178)..(178): n is a, c, g, or t
  modified_base (239)..(239): a, c, t, g, unknown or other
  misc_feature (239)..(239): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgttccttgcttactgcacaggatccgtggccttcgatgagctgattcagcccaccctnagtcgtccgtcgtccccaggacagacacgccacatcactgctcggacagacaagtgggaanataagaatgctcgctaggtactacgagacggccaggcctacgtccccttagtttcgtctacttccttaccaagtaagtaacgaacgccggtaccctcggacggtactcccgtagaaccgttaacgtttcgacgtaccctaccgtaaaccgttcggaacgggaaccacgacgaccctaacgtcacggaccacgtaccggacggacccgggaccgaacggaccgaaacggagtaggaacgggactaacgtactagtcgtagacgggtagtaggaacgtatacgttagttcggtagttgtagggacggtaggacgtaggtccgtcgacccgtacggtacgggtaccacgggaacccgtcgggtacccgttaccccggcccccgttacggtaccctacccggtttcccttccccggttccccgtacccccg

SEQ ID NO: 2703 - DNA, 737 bp, Homo sapiens
  misc_feature: GYAE6OF01EZO2F.26.21.B10.1.454.CMB.1.raw
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaagtggagatagaaatgctgcctggtattaccgagaggccaggcccagttcccccttagttttgggtacctattcctttaccaaagtaactaaaggaacgccggcccctacgacgggacttcccctagtaacccgtatttccgcggtacctacctaacgtcgtacgggaaaccacgaacgaccctactcctacgaaccctagttccgaacgggcccgggggtaccccaacgggaccccgaaacgggtagtacgggaacggggaacgtaaccgttacgtaagtttcggtacgacggggtcgtagggtaagtaataacgttagtttaggtaggtttggtttacggggacgggtaacggggtaacccgagggtccgtaacgggtaccccggtttaccggtaacgggttaccgaacccggtaccccggaaagggttcccccgtaccgggttcccccccgtacggttacccctaccgtttcccgttccccggtttcccccgtcccccgtttaccccg

SEQ ID NO: 2704 - DNA, 674 bp, Homo sapiens
  misc_feature: GYAE6OF01DAH6D.26.21.B10.1.454.CMB.1.raw
  modified_base (246)..(246): a, c, t, g, unknown or other
  misc_feature (246)..(246): n is a, c, g, or t
  modified_base (306)..(306): a, c, t, g, unknown or other
  misc_feature (306)..(306): n is a, c, g, or t
  modified_base (447)..(447): a, c, t, g, unknown or other
  misc_feature (447)..(447): n is a, c, g, or t
tcagagactatactcacgaccggtgctcgatttagtgtcgtcgcaagagaggaggggggggcctcaggaagcagcatcggaggtgcctcagccatggcatggactccctctcttcctcggcgtccttgcttactgcacaggactccgtggccttcgatgagctgattcacgcccaccctcagtgtcccgtcgtccccgaaggacagacacgcccaccatccacctgctcggacagacaaagtgganatagaatgctgcctgtactacgagagccagccacgtcccttagtttcgcatctacaaganaagacgccgacctgagggtacctccgtagaccgttaactttcgtcggtacctacctaacttccggtacgggaaaccaccgacgccctactctacgaacccatccggaacgggcccgggacccaacggacccgtaaacgggngtacggaagggtaactacgttacgttagttcgacgagggtacggtagggaactaattacgtaagtttcggttaaggtttcgggttacgggacgggtaacgggtacacggggtctaacccgggtaccgtacggtacggtaccgtacggaccccgtaaggtccccgtacccggtcccccgtacgggttaccctaaccgttcccggttccgttccccccgtccctaccgg

SEQ ID NO: 2705 - DNA, 675 bp, Homo sapiens
  misc_feature: GYAE6OF01AXX92.26.21.B10.1.454.CMB.1.raw
  modified_base (234)..(234): a, c, t, g, unknown or other
  misc_feature (234)..(234): n is a, c, g, or t
  modified_base (344)..(344): a, c, t, g, unknown or other
  misc_feature (344)..(344): n is a, c, g, or t
  modified_base (365)..(365): a, c, t, g, unknown or other
  misc_feature (365)..(365): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccggtggccttcgatgagctgattcagccacctcagtcgtccgtcgtccccaggacagacagccacatcacctgctcggcagacaagtgganatagaatgactgcctaggtataccgagacggaccaggcctacgtaccccttagtttggctactccttaccaagtataagaacgcgccctagaggactcctgacctattcngctacactctacggacacacnccatcacacatccgacggccgggacccaggacccaaggtacgtagggaaggaactacgtacgttagtcgtacgagggtaccgtagggtaagtaacttaacgtagtttagggttaggtttacgggtttcggggaacgggtaacgggtaccggtacggtaccgttaccgggtaacccggtaccggttaacggggtacccgtaacccgggaccccggtaaagggtcccgtacccccggtcccccggttaacccgggttaccctaaccgttttcccgttaccccgttcccccgttaacccccgtttaaccccgg

SEQ ID NO: 2706 - DNA, 666 bp, Homo sapiens
  misc_feature: GYAE6OF01ATJ2K.26.21.B10.1.454.CMB.1.raw
  modified_base (175)..(175): a, c, t, g, unknown or other
  misc_feature (175)..(175): n is a, c, g, or t
  modified_base (234)..(234): a, c, t, g, unknown or other
  misc_feature (234)..(234): n is a, c, g, or t
  modified_base (258)..(258): a, c, t, g, unknown or other
  misc_feature (258)..(258): n is a, c, g, or t
  modified_base (437)..(437): a, c, t, g, unknown or other
  misc_feature (437)..(437): n is a, c, g, or t
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggatccgtggccttcgatgagctgattcagccaccctnagtgtccgtgtccccaggacagacacgccaccatcacctgctcggcagacaaattgganatagaatgactgctgtataccagngccaggccagtcccctatttggcattcctacaagtataaagaacgccggtcccgtcggggactcccgtaggtaacccgtaattttccgcggccttacccgaaactccgtagggaaacctacgagccctactctacgaccactcgacgccggggaccagccgaaggactaggaacggganactaacctagttcgtacgaggcgttagggaactaagtacttagttaggtaaggttgtttacggggacgggtaacgggtaccgtaggtaccggtggtaacccgttccggttaaacgggtcccgaaccggtacccccggaaacgggtcccgttaacccggtcccccccgttacgggtacccgtacccttacccggttacccgtttacccccccaccgttcccccgttaacg

SEQ ID NO: 2707 - DNA, 746 bp, Homo sapiens
  misc_feature: GYAE6OF01AML9J.26.21.B10.1.454.CMB.1.raw
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttgatgagctgattcagcccaccctcagtgtccgtgtccccaggacagacagcccaccatccacctgcctcggcagactaagttgggagatagaatgctgccgtggtactaccgagacggtccaggccctacgttacccctagttttcggactactccgttaccaagtataaacggaacgtccggtacccctggtacggtacctccccgtaggaacccgttaatttccgtacggtacctaccctaacgttaccgtaccgggaactaccggaccgtacccgtaccttaccgtacgtacccgtaacgtccgtaacgggcccgggtacccgtaacggtaccgaacgggtacgtacgggaacgggtaaccgtacgttacgtacgttcggacgagggtccggttaagggacgtaacttaggttacgttacgggtttagttcggggtttaggaccggggtaagggacccgttagggaccgttaccggtaccggttaccgtaccgggtacgtaccggtaccccgtacggtcccggttaacccggcccccgttaacgggtcccttaccggttcccgtttacccggtccccctccccggttaccg

SEQ ID NO: 2708 - DNA, 705 bp, Homo sapiens
  misc_feature: GYAE6OF01BD25G.26.21.B10.1.454.CMB.1.raw
  modified_base (177)..(177): a, c, t, g, unknown or other
  misc_feature (177)..(177): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgccaccctnagtcgtccgtcgtcccaggacagacacgccaccatcacctgcctcggacagactaagttggagatagaatgctcgctgtactacgagacggccacggccacgttccccttagtttcgctactctacaagataacgacgcgccagacggactcctagacgtattcgcgcctacacgtcgtacggaaccacgacgacctactcgtacgacctataccggacggcccgggacccacggacccgaaacgggtcgaacggggtaacgggaacgtaacgttaacttacggttacggtacggaacggggtacgggtaagggtaacgtaacgttacgttaaggtttacgggttaggtttacggggtttacgggacggggtaacgggtacccggtacgggtaccgttccgggtaaccccggttccggttaaccgggtaccgaacgggtaccccggacgggtccccgttaccccggcccccggttaccggtaccctttaccgtacccgtttccccggtaccccctaccccgttacccg

SEQ ID NO: 2709 - DNA, 734 bp, Homo sapiens
  misc_feature: GYAE6OF01ALLPK.26.21.B10.1.454.CMB.1.raw
  modified_base (266)..(266): a, c, t, g, unknown or other
  misc_feature (266)..(266): n is a, c, g, or t
tcagagactatactcacgaccggtgctcgatttagtgtcgtcgcaagtaggtaggagggggcctacaggaagcagcattcggacggtgccgtccagccaactggcatggatccctcttcttcctcggcgtccttgcttactcgcacaggactccgtaggtccttcgatgagctgacttcacgcccaccctcagttgtcccgtcggtccccgaaggaccacgaccacgtccaccgatcgacctgctcggcacgacaaagttcggganatacgaaagtcgctgctggtacttaccgagacggccacggccacgtcccctattttcggtcctgtccttccaacgacgtaacggacgcggccctacgacgggtactcccgtacgtaccgtaatttcgtcggaccttaccgaacgttcgtacggggaaccacgtacgtcccctaacgttcctacgaaccctagtccgacgggcccggggaccctacgggtacccaacgggatacgggaaggtacgtaacttacgtagttcgtacgagggtacggtacgggaacgtaacgtaacgttagttagggtaggttcggtttacgggacgggttagggtaacccggtacgggtccgttaccgggacccggttaccggtaacgggtcgtaaccggacccgtaacgggtcccgtacccggtcccccggttcgttacccgtaccgttacccgttcccgttccccgtcccgttaccccg

SEQ ID NO: 2710 - DNA, 685 bp, Homo sapiens
  misc_feature: GYAE6OF01AOTBG.26.21.B10.1.454.CMB.1.raw
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccggtggccttcgatgagctgattcagcccaccctcaggttcgtccgtcgtcccccaggaccagacagcccacatccactgctcggctaagactaaagtgggataatagaatgctgccgtaggtactaccgagacggccgacggcctacgttcccttagtttcggactactccttacgaagtaataacggaacgccgtcctacgacggtacctcccgacgtaaccgtagtttccgacgtacctaccgtaacgtcgtacgggaaacaccgacgcccgtactccgtacgacctataccggacgggccccgggacccaacgacccggtaaacggacgtaggggaacgggtaacctacgttaacggtttaacgtcggtacggagggtaccggtagggtaaacgtaattaccgtttaagttaggtttaagggtttcgggtacgggacgggtaccggacggtacgtcggtaccggtaccgtacgtacggtcaccggaccggtaggcccgtcccgtcccgtacgtctaccgtcgtcccggtaccctcccg

SEQ ID NO: 2711 - DNA, 811 bp, Homo sapiens
  misc_feature: GYAE6OF01D0ZEC.26.21.B10.1.454.CMB.1.raw
  modified_base (149)..(149): a, c, t, g, unknown or other
  misc_feature (149)..(149): n is a, c, g, or t
  modified_base (166)..(166): a, c, t, g, unknown or other
  misc_feature (166)..(166): n is a, c, g, or t
tcagagactatactcacgaccggtgctcgatttagtgtcgtcgcaagagaggagggggcgtgggcctcaggaagcagcatcggaggtgcctcagccatggcatggactccctcttcttcccgtcggcgtccttgcttactgcacgaggntccggtgccttgatganctgatcacgcccaacccgtgtacgtcggtcccgtcgtaccccgaggaccacggacacaccctaacctatccaccgtgcctcggacaagaacgtaaaggttggaagtaagtaaacgtaaagtcgtctcggtaccgttaaggtactaccgaagggaccggaccgaaaccgggtcctaacccggtttccccttttaggtttttaccggaccttacgttacccttaaccgaaagtaacgtaaacggaccggtacccgtccgtacggaacgggtaccttaccgtacggtaacttacgttcgaccggtacctacccgtaacgtcgggtaacaaccacgtacgtccctaaccgtcgtacaaccggtacgaccggtaaccgggacccgggaccctaacggaacgaacgggtaggtacgggaaagggtacctaacgtaccgtttcgttacgggacgagggtaggtaacgaagttacgtttaagtaacggtttagttacgggtttacggggtacgtacggggggtacgtaccggtaacggtacgttacccggtacccgttacggtacccgggtacgaacccggttacccggaaccggtcccgtacccggtaccccggttcgtaaccccgtccgttacccgtacccgttcccccgg

SEQ ID NO: 2712 - DNA, 723 bp, Homo sapiens
  misc_feature: GYAE6OF01DDCXC.26.21.B10.1.454.CMB.1.raw
tcagagactatactcacgaccggtgctcgatttagtgtcgtcgcaagagaggagggggctgggcctcaggaagcagcatcggaggtgcctcagccatggcatggatccctctcttcctcggcgtttccttgcttactgcacaggatccgtggccttgatgagctgattcagcccacctcagtcgtccgtgtccccaggacagacagccaccatccactgctcggatagaacaaagttgggaatagaatgctgctaggtactaccgagacgccaggcctacgtccccttagtttcggtactacttctacaaagtataaagaacgccggaccctacgaagggtacctcccgtacggaacccgttaattccgtacggacctacccgtaaacgttccggaacgggaaccacgacgtaccctaacgttccacggaccagtaccgacgggcccggggacccaacgacccgaaacggagtacgggaacgggtaacacgttaacgttaacgtagtaccggagggtacgggtagggaaacgtaagttaacgttaaggtttacggttaaggttacgggtttacgggaccggggtaacggggtaaccgacggggtaccgtaccgggtacccggttaccgggtaacggtaaccgaccggaccccggtaaacggtccccgtacccggtccccccggttacggtaccctaccgttccccgttcccgttacccccccg

SEQ ID NO: 2713 - DNA, 779 bp, Homo sapiens
  misc_feature: GYAE6OF01BFQLA.26.21.B10.1.454.CMB.1.raw
  modified_base (227)..(227): a, c, t, g, unknown or other
  misc_feature (227)..(227): n is a, c, g, or t
tcagagactatactcacgaccggtgctcgatttagtgtcgtcgcaagagaggaggggggggcctcaggaagcagcatcggaggtgcctcagggccatggcatggactccctctcttcctcggcgtccttgcttactgcacaggatccgtgccttcgatgagctgattcagcccaccctcgagtcgtccgtcgtccccgaggacagacacgccacatcactgctcggnacgacaagttgggagatagaatgactgtacctggtaataccgagacggccaggcctacggttccccttagtttcggtactacttaccgtaaccgaaagtaataaacggacgtaccggtacccgtacggacggggtaactccccggttaacggaacccgtttaacgtttccggtaccggtaccctaaccccgttaacccggtaccggttaccggggaaaaacccacgtaccggtaccctaacgttccgtaacgaccctagtacccgtacgggaccccggggacccaacggtacccggaaacggtaggtaacgggaagggtacctaaccgttacgttaaggttcggtacgtacgggagtacgggaaagtaacttaacggtagtttacggtaggtttcgggttacggggtacgggtaaccgggtacgtacggggacctacgggtacccttagggtacccgtcgaacccgggtacccggacggtccccgttaccggtccccccggtacgtacccgtacccggttacccgtttccgggtcccccttcccggttaacc

SEQ ID NO: 2714 - DNA, 681 bp, Homo sapiens
  misc_feature: GYAE6OF01CT09B.26.21.B10.1.454.CMB.1.raw
  modified_base (232)..(232): a, c, t, g, unknown or other
  misc_feature (232)..(232): n is a, c, g, or t
  modified_base (323)..(323): a, c, t, g, unknown or other
  misc_feature (323)..(323): n is a, c, g, or t
tcagagactatactcacgaccggtgctcgatttagtgtcgtcgcaagagaggagggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatcactgctcggcagacaatggganatagaaatgctgcctggtatacagagccaggccagtccctatttgcatctcaagataagagcgcctgaggatccctagaccgtaatttcgnggactaccaactcgtacgggaacacagcccactctagaccatcgacggccggggacccaacggacccgaaacgggtagtaggaaggggaacgtaaccttaacgttaagttcggtacgaacgggtcggtaaggggaagtaaacgttaacgttaagtttaggttaaggttagggttttacggggaccggggtaacggggtaacccggaacgggtaccgtacgggtaaccccggttacccgttaaggggtacccgaacggtacccccgaaacggggtcccgttaccccggacccccccgttaccgggttacccgaacccgtttcccgtttacccggttccccccctacccccgttaccccg

SEQ ID NO: 2715 - DNA, 670 bp, Homo sapiens
  misc_feature: GYAE6OF01BUZ03.26.21.B10.1.454.CMB.1.raw
  modified_base (238)..(238): a, c, t, g, unknown or other
  misc_feature (238)..(238): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctcagtcgtccgtacgtccccaggacagacagccaccatcactgctcggcagactaagtgganatagaatgctgctggtatacgagacgccaggcctacgtcccttaatttcggcacttctaccaaagactaaagaacgccgcctacgaggactccgtagaacgtatttcgcggtacctaccaaagttcgacgggaacacgacgaccctactcacgaccaagtccgacgggccgggacccacggtaccgaaggacgtagggaagggaacgtaacttacgtagttggtacgaagggtcggtaagggaacgtaattaacgttaaggttaggtacggtttacgggttacgggacgggaacgggtacccacgggtccgttacggtacccgtaccggttaaggccgtaaccggacccgtaacgggtcccgaccccggtacccccgttacgggtaccctaacccggttccctttacccggttcccccctaacccgttcccg

SEQ ID NO: 2716 - DNA, 688 bp, Homo sapiens
  misc_feature: GYAE6OF01CYCG8.26.21.B10.1.454.CMB.1.raw
  modified_base (445)..(445): a, c, t, g, unknown or other
  misc_feature (445)..(445): n is a, c, g, or t
  modified_base (472)..(472): a, c, t, g, unknown or other
  misc_feature (472)..(472): n is a, c, g, or t
  modified_base (485)..(485): a, c, t, g, unknown or other
  misc_feature (485)..(485): n is a, c, g, or t
tcagagactatactcacgaccggtgctcgatttagtgtcgtcgcaagagaggagggggcctcgaggaagcagcatcgggaggtgcctcagccatggcatggatccctctcttccgtcggcgtccttgcttactgcacaggactccgtggtccttgatgagctgtattcacgcccaccctcagtcgtccgtcgccccgaggacagacacgccactatccacctgctcggacagaactaagtgggaatataagaactgctgcctaggttaactacgagcggaccacggacctacgtccttagtttcggactacttcctaacgaaagtagtaaacgaacgcccggtaccgtacgaacgggtactaccccgtaggtaaccgttaacgtttccgacggtaccctacccgtaacgtacgtacggaacacgacacctacctcgtacgaccancggacggccgggacctaggaccgaagngtaggaacggtanaacttagtcgtacgacggacggtagtaggaatacgtaacgtttgaggtttaggtggttcgggacgggtaacgacgacggtacgtaccggtaccggtccgtaaggacccgtaccggacccggtaaccggtcccgtaccccggtcccccgttacgggtaccccttaccgttacccgtttccccgtacccccgtacccgttaccgg

SEQ ID NO: 2717 - DNA, 726 bp, Homo sapiens
  misc_feature: GYAE6OF01B2WYK.26.21.B10.1.454.CMB.1.raw
  modified_base (245)..(245): a, c, t, g, unknown or other
  misc_feature (245)..(245): n is a, c, g, or t
  modified_base (258)..(258): a, c, t, g, unknown or other
  misc_feature (258)..(258): n is a, c, g, or t
tcagagactatactcacgaccggtgctcgatttagtgtcgtcgcaagagagacgggggctgggcctcaggaagcagcatcgggaggtgcctcagccatggcatggatccctctcttcctcggcgtccttgcttactgcacaggactccgtggccttcgagtgagctgattcacgcccacctcagtcgtccgtcgtcccgaggacagacacgccacatcacgtcgactcggacagacaagttgganataggaatcgacncgacgtggttactaccgagacgccgacgaccgtacgttccccttaagttttcggtacaccttcttaccgaaagtaacgtaacggacggtaccgtccctacggaacgggttaacctcccgaacgtaccggtaactttccgtacggcctaccgtaactccggtaggaaccacgaccgtcaccgtactacgaccttacgacgaccggccggacccgacgacccgaacggtagacgtaacgggactaccttacgtacgttcgacgaacggtcggtaacgggtagttaaacgtacgttaggtttaggtttacggttgggtttacgggacggtacgggaaccgtaccgggtgttaccccggtaacggttacccgtacggttacccgaaccgtaccccggtaaccgggtccccgaacccgggttccccccgttaggtacccccgtacccgtttcccgtccccgtttaccccccgg

SEQ ID NO: 2718 - DNA, 709 bp, Homo sapiens
  misc_feature: GYAE6OF01ASN5Q.26.21.B10.1.454.CMB.1.raw
  modified_base (245)..(245): a, c, t, g, unknown or other
  misc_feature (245)..(245): n is a, c, g, or t
tcagagactatactcacgaccggtgctcgatttagtgtcgtcgcaagagaggagggggggggcctcaggaagcagcatcggaggtgcctcagccatggcatggatccctctcttcctcggcgtcctgcttactgcacaggatccgtggccttcgatgagctgattcagcccaccctcagtcgtccgtcgtccccaggacacgacacgccaccatccacctgcctcggactagacaaagttggganatagaatgactcgctggtataccgagacgccaggccacgttccccttattttcggctacttcgttaccaaagataaacggacgccggaccctacgagggtacctccgtacgaccgttaatttccgtacgtacctccgtaaaccgttccgtaacgggtaaaccacctaacggccctaaccttacgtacggaccctaacgtaccggacgggacccggggtacccgaccgaccgaacgggagtacggaacgggactactacgttagttacgtaggacgggtagtacgggaataacgttactaggttagtaggttgttacgggcgggtaacggacggtagtccggtacgacccgttaggaccgtacggaccggacccgtaaccgggtccccttacccggtacccccggttaccggtaacccttcccggttaccccttacccccggttaccccttcccccgttaacccg

SEQ ID NO: 2719 - DNA, 741 bp, Homo sapiens
  misc_feature: GYAE6OF01C8GRU.26.21.B10.1.454.CMB.1.raw
  modified_base (177)..(177): a, c, t, g, unknown or other
  misc_feature (177)..(177): n is a, c, g, or t
  modified_base (240)..(240): a, c, t, g, unknown or other
  misc_feature (240)..(240): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagcccaccctnagtcgtccgtcgtccccaggacagacagcccacatccacctgctcgacagaacaagtgggaanatagaatgctgctgtactacgagacgccaggcctacgtcccttagtttcgctatctacaagtataagacgccggacctagacggtactcccgtgtaaccgtatttcgacggtacctaccgaaacgttccgtaacgggaaacctacgaccgtcctaaccgtccgtaacgaaccctacgtaccggacgggtaccccgggggaccccaacgggtaccccgaaacgggtagtacgggaacgggtaacgtacgttacgttaacgttcggtaccgtaggggtaccggtaaggggaacttaacgttaacgtttaggtttagggttagggtttacgggtttacgggggacgggtaacgggtacccggtagggtaccgttaccgggtaccccggtacggttaacgggtccgaaacccggtcccggtaaacgggcccttacccccggtacccccgttcggtacccgttacccgttcccggttacccccggttccccgtacccccgttaccg

SEQ ID NO: 2720 - DNA, 828 bp, Homo sapiens
  misc_feature: GYAE6OF01D2ZWM.26.21.B10.1.454.CMB.1.raw
tcagagactatactcacgaccggtgctcgatttagtgtcgtcgcaagagaggagggggggcctcaggaagcagcatcggaggtgcctcagccatggcatggactccctctcttcctcggcgtccttgcttactgcacaggactccgtggccttcgatgagctgattcacgcccaccctcgacgtcgtcccggtcgtaccccgaggacacgaccacgcccaacctactccacccgtgccgtcgggacaacggaacgtaaaggttgggaagtaataagaaagtcgactggtaccgtaggttaacttaaccggaggacggacccgacggaccctacgttacccctttagttttcggtcctacttaccgttacctaaagtaacgtaaacggaccggtcccgtacccgtacggacgggttaccctaccgtaccggtaaccgttaagtttccgtaccggtacttacccgaaccgttccggtaacggaaacctaccgacgtaccctacttacgacgaccacgtccgacgggcccggacccgaacggtacccggaaacggtgtaacgggaacgggttacgtaacccgttaacgtttacggttacggtacggtacggggtaccggtaagggtaacgttaaacgttacgtttaaggtttacgggttacggttcggggtttacggggaaccgggtaccggggtaaccgtaggggtacccgtaccggtacccggtacccgtacggaccgaaccgggtaccccgtacggtccccgtacccggtccccgttacggtaccccttaccgtcccctttacccggtttcccccacccgttaacccg

SEQ ID NO: 2721 - DNA, 786 bp, Homo sapiens
  misc_feature: GYAE6OF01D1W3S.26.21.B10.1.454.CMB.1.raw
  modified_base (181)..(181): a, c, t, g, unknown or other
  misc_feature (181)..(181): n is a, c, g, or t
tcagagactatactcacgaccggtgctcgatttagtgtcgtcgcaagaggagagggggctgggcctcaggaagcagcatcggaggtgcctcaggcccatggcatggatccctctcttcctcggcgtcctgacttctgcacaggatccgtggccttcgatgagctgacttcagcccaccctnagtcgtccgtcgtaccccgaggacacgacacgcccaaccataccaccgtgccgtccggacaagaactaaaggttgggaataaagtagaaagtcgtacgtacgacgttagtaactacgagaacggaccgacgtaaccttccgttaccgtacgtttggtactacgtacctacgaaagtaacggtaaacgtacggcccgggtacccgtaccgggaaggtttaccctacccggtaaggggtaacccctttaagtttccgggaaggttacccctaacggaaccgttcgggaaacggtaacctacggaccgtaccctacgtacgaaccgaacctcgtaaccggaccgggtcccggaccgaccgggaacccgtaaacggtacgtaacggggacgaacgtaacgttaacgttacggttaccgaacggtacggtacgggtaaggtaacgttaacgttacgttaggttaaggttacggttacgggtacgggtaccgggtaacggacggtacggtaccggtaaccggtaccggtacggtacgaccggtacccggtaccggtaccggtcccgtaccccggtacccggtacccgtacccgttccgtcccgttaccccg

SEQ ID NO: 2722 - DNA, 678 bp, Homo sapiens
  misc_feature: GYAE6OF01B6HEV.26.21.B10.1.454.CMB.1.raw
  modified_base (239)..(239): a, c, t, g, unknown or other
  misc_feature (239)..(239): n is a, c, g, or t
  modified_base (654)..(654): a, c, t, g, unknown or other
  misc_feature (654)..(654): n is a, c, g, or t
tcagagactatactcacgaccggtgctcgatttagtgtcgtcgcaagaggagaggggctgggcctcaggaagcagcatcggaggtgcctcagccatggcatggatccctctcttcctcggcgtccttgcttactgcacaggatccgtggccttcgatcgagctgattcagcccacctcacgtcgtccgtgtccccaggacacgacagccaccatcacctgctcggcagacaagttgganagtagaaatgactgcctggttattaccgagacggccacggccacggtccccttagttttcggacctacttccttaccaacgtaagtaagaacgccggtcccctagaccgggtaactcccgtacggacccgttaacgtttcgtcggtacctcctaacgtccgtacgggaacctacgacgaccctacgtcgtacaccctacgtaccacggccggggaccccaggccccgaaacgggtactcgggaaggactacgttactacgttagtacgagggtccgtagggaactaagttaacgttagttacggtaggttcggtttagggcgggtacggggtaccgtaacgggtccgtacgtaacccgggttcgtacgggtactcggtacccgacggtccgtaccggtcccccgttacggtaccnccgtttcccgtccgttaacccccg

SEQ ID NO: 2723 - DNA, 814 bp, Homo sapiens
  misc_feature: GYAE6OF01BRX3F.26.21.B10.1.454.CMB.1.raw
  modified_base (177)..(177): a, c, t, g, unknown or other
  misc_feature (177)..(177): n is a, c, g, or t
  modified_base (229)..(229): a, c, t, g, unknown or other
  misc_feature (229)..(229): n is a, c, g, or t
  modified_base (244)..(244): a, c, t, g, unknown or other
  misc_feature (244)..(244): n is a, c, g, or t
tcagagactatactcacgaccggtgctcgatttagtgtcgtcgcaagagaggaggggggggcctcaggagcagcatcggaggtgcctcagccatggcatggatccctctcttcctcggcgtccttgcttactgcacaggatccgtggccttcgatgagctgattcacgcccaccctnagtgttcccgtcgtcccccgaggacagacacgccaccatccacctgctcggnagaactaattggganaatagaatgctagtcctggtacttaccgagacggccaggcctacggttaccccttagtttcggtactacttaccgtacaaacggaactaacggaacggcccggtacccctacgacgggtaccttcccgtaacgtacccgtaacgttttccgacggtacctaccctaaccgttccgtaacgggaaacaccgtactacccgtaccgttacgtacgaccgaacgtaccggaccgggacccgggacccgaccggaaccgtaacgggtaacgtacgggacgggaataacccgttagtacgtttacggtacgtacggggtacggtaggggtaacgttaacgttaacgttaacgtttacgggtttagggttacgggttttacgggggaccggggttaacggggtaacccggtacggggtacccggttaccgggtaacccgggttacccggttaaggggtaccccggacggtacccccgtaaccggggttcccggtaccccgggtaccccccggttcggtaccccgttaacccgggttcccgtttcccccggtttacccccgtcccccgtttacccgg

SEQ ID NO: 2724 - DNA, 790 bp, Homo sapiens
  misc_feature: GYAE6OF01C7K5H.26.21.B10.1.454.CMB.1.raw
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccacctcagtgtccgtcgtcccaggacagacacgccaccatcacctgctcggacagacaagttggagatagaaatgctacgcctaggtattaccgagacggccaggccacgtcccctatttcggctagttcttaccaagtaacgtaacgaacgtccggacccttacggaacgggtaccttaccccgtacggtaacccggttaactttccgtacgggtacccttaacccgtaaaccgttcggtaacgggaaaacccaccgtaaccggtaccctaaccgttaccgtaacgaccctaacggtacccgaccggggacccgggacccgaacggacccgaaaccgggtacggtacgggaacgggtaacgtaaccgttacgttacgttacggtacgtacgggtacggtaacggggggtaactaacgttacgttaacgttaggttacggttacgggtttacgggacgggtaacgggtaccggtaccgggacgttaaccggtaacccggtaccggttaccggtaccggaaccggtacccgtaacgggttcccggtacccggtacccccggttacccggttacccgtaacccgttcccgtttaaccccgttccccgtaccccgttaaccccg

SEQ ID NO: 2725 - DNA, 701 bp, Homo sapiens
  misc_feature: GYAE6OF01DE83W.26.21.B10.1.454.CMB.1.raw
  modified_base (178)..(178): a, c, t, g, unknown or other
  misc_feature (178)..(178): n is a, c, g, or t
  modified_base (243)..(243): a, c, t, g, unknown or other
  misc_feature (243)..(243): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggactccgtggccttcgatgagctgattcagcccaccctnagtcgtccgtcgtaccccaggacagacacgccaaccatccacctgctcggcagacaaagtggganatagaatgctgcctggtataccagaggccaggccacgtcccctattttcggctatcttaccaagataagacgcggccctagaggctccctgtaccgtaatttctggcctaccaactcgtacggaacacacgcctactcgtcaccactcgacggtccgggacccacgaccgaacgggacgtaggaacgggtaactaccgttaactacgtttacggcgacgggtacgggtacgggtaacgaaacgtttaacgttaacgtttagggttaaggtttgggttttacggggaccgggtacggggtaaccggtacgggtaccgttacccgggtacccggtttcccggtaagggttaccccgtaacgggacccccggtaagggtccccgttacccgcccccccggtttcgggtaccccttaacccgttccggtttacccccgtacccccgttccccgttaccccgg

SEQ ID NO: 2726 - DNA, 742 bp, Homo sapiens
  misc_feature: GYAE6OF01D2J8Y.26.21.B10.1.454.CMB.1.raw
  modified_base (388)..(388): a, c, t, g, unknown or other
  misc_feature (388)..(388): n is a, c, g, or t
  modified_base (561)..(561): a, c, t, g, unknown or other
  misc_feature (561)..(561): n is a, c, g, or t
tcagagactatactcacgaccggtgctcgatttagtgtcgtcgcaagagaggagggggagtgactcctgtcgccccaccatggacacgtctttgctccacgctcctgctgctgaccactcccttcagtgggtcttgtccagatcacttagaaggtagtcgtggtcctgcgtcgtggtcggacgcccacgcacgtaccctcacgtctacgacctgccgtccgttactcgttcgtacttcctactacctaccaccgacgtacgttggaggtagtaacgttggtcggtccggttcgggtcccggtaccggaacccggggaacccccgggtaacgggtccgtagggtacggttcggtccgttcgaccgtactttacgttaacgtttaacggnggttagtacgtactcgtaacgtaacggtacgtaactaccgttccgtactacggtaggaacgtacgtctaccacgacctacaccgaaccggaacgacctacccgtaacggaaccgggttccggttacgtactaacgacgaccgaaccatatacggtactcggtagacgacacgntacctatagtttatcgtcaactcaacgtaccgttcgaacgtcggacgttaacgccgaaaagtaaggtaaaactgttacgtaacgggtaacgttaggggtaaccgggtcggttaaagggttttcccttacccggacccgttacccgtacccccttcccgacgtaacccccggttaaacccgg

SEQ ID NO: 2727 - DNA, 729 bp, Homo sapiens
  misc_feature: GYAE6OF01CGIKM.26.21.B10.1.454.CMB.1.raw
  modified_base (134)..(134): a, c, t, g, unknown or other
  misc_feature (134)..(134): n is a, c, g, or t
  modified_base (178)..(178): a, c, t, g, unknown or other
  misc_feature (178)..(178): n is a, c, g, or t
  modified_base (239)..(239): a, c, t, g, unknown or other
  misc_feature (239)..(239): n is a, c, g, or t
tcagagactatactcacgaccggtgctcgatttagtgtcgtcgcaagagaggaggggggggcctcaggaagcagcatcggaggtgcctcagccatggcatggactccctctcttcctcggcgtccttgcttacngcacaggatccgtggccttcgatgagctgattcacgccaccctnagtcgtccgtcgtcccaggacagacacgccacatccactgctcggacagacaagtgggaanataagaatcgactgaccgtaggtaacttacgaggacggccacggcctacgtccccttagttttcggctactcttaccaagtaactaaggaacgtccggccctacggacggtacctacccgacggaaccgttaactttccgacggtcctaccgtaacgtcgtaacgggaaccacgacgtaccaacgttcgacgacctagtccggaccgggccgggacccaggacccgaaggagtacgggaacgggaactacgttaacgttagttcggaccgagggtacggtagggtaactaacgttaacgttggttacggtagggtttccggggttaagggaccgggtagggaacccgtagggtaccgtacggtaacccggttaccggtacggttaccggaacccgtacccgggaacggtccccgttaccccgggtccccccgttagggtccccttaaccgttcccggtttacccgttccccccggtaccctttaccccgg

SEQ ID NO: 2728 - DNA, 755 bp, Homo sapiens
  misc_feature: GYAE6OF01BQV0R.26.21.B10.1.454.CMB.1.raw
  modified_base (180)..(180): a, c, t, g, unknown or other
  misc_feature (180)..(180): n is a, c, g, or t
  modified_base (237)..(237): a, c, t, g, unknown or other
  misc_feature (237)..(237): n is a, c, g, or t
  modified_base (255)..(255): a, c, t, g, unknown or other
  misc_feature (255)..(255): n is a, c, g, or t
tcagagactatactcacgaccggtgctcgatttagtgtcgtcgcaagagaggaggggggggcctcaggaagcagcatcggaggtgcctcagccatggcatggactccctctcttcctcggcgtccttgcttactgcacaggatccgtggccttcgatgagctgacttcacgcccaccctnagttcgtcccgtcgtccccaggaccagaccacgcccaaccatccacctgcctcgganaagtacgaagttgggaanatagaatgactggcgttggtactacaggacgccgacggcctaccgtccttatttcggactacttactaccgtaagaagtaacgacgacccggtacctacggacggtacctacccgtacggtaaccgttactttaccgacggtcctaacccgtaactcggtaacggaaacctacgacctacccgtacctacgtaaccgaacctacgtaccgaaccgggccccgggaaccctaaccgggaacccgtaaacgggcggtaacggaacggtaacgtaaccgttacgttaggtcggtaaccggtagggtaccggtaagggtaactaacggttattacggtttaaggtttacggttagggttaccggggaacggttacgggaccgtacgggtacgttacccgggaaccgttccggttaacggtcccgtacgggtacccctaaggtcccccgtccggtaccccgttacggacccttccgtccgttccccgtccccgtccgttaacccg

SEQ ID NO: 2729 - DNA, 733 bp, Homo sapiens
  misc_feature: GYAE6OF01DRXKS.26.21.B10.1.454.CMB.1.raw
  modified_base (243)..(243): a, c, t, g, unknown or other
  misc_feature (243)..(243): n is a, c, g, or t
tcagagactatactcacgaccggtgctcgatttagtgtcgtcgcaagagaggagggggctgggcctcaggaagcagcatcggaggtgcctcagccatggcatggatccctctcttcctcggcgtccttgcttactgcacaggactccgtggccttcgatgagctgattcagccaccctcagtcgtccgtcgtccccaggacagacacgccaccatcacctgctcggcagacaaagttgggaanataagaaatgctagccgtagtacttaccagacgccgacggcctacgttccccttagtttcggtctacttaccgttacccaaaggtaacgtaaacggaacggtacccggtaccccgtacgaacggggtactaccccggtacgtaacccggtaattttccgtacgggtaccttaccgaacgtacgtacgggaacaccgtaacgccctacgtccgtacgaaccctagtccggacggcccggggaccctacggacccgaaacggtacgtacgggaacgggaacgtacgttaacgttaacgttcggtacgacgggtaccgggtagggtaacgtaaacgttaacgttaggttacggttagggtttagggtttacgggaccggggaacgggtaacgacgggtaccgtccggtaccggtaccgtacgggaccaacggtcccgacggtaccccgtccgtacccccggttgtaccccgtacgttcccgtcccgttacccc

SEQ ID NO: 2730 - DNA, 932 bp, Homo sapiens
  misc_feature: GYAE6OF01EMAT9.26.21.B10.1.454.CMB.1.raw
tcagagactatactcacgaccggtgctcgatttagtgtcgtcgcaagagaggaggggggggcctcaggaagcagcatcggaggtgcctcagccatggcatggactccctctcttccgtcggctccttgcttactgcacgaggtactccggtggtccttcgatggacgtctaggtacttaccgaccgtacccctaccccgttacgtacggttccgttacccggttcccgtacccccgaaacgggaccaaccggaccgaaccgcccctaaccgtacctacccgtaccctcggtacccgtccggggaaccgaaaccgtaaacgtaaaggttacggggaaagtaagtaagttaaacgtcgtaccgttcggtaccgttacggttaaccgttaaccgacggtaccggaccgaaccggtaccccgttaccgtttaccccgttttagtttaccggtacctaccttaccgttaaccgaaagtaacggtaacgacccgcggtaccctaggaccggtacctccgtaacgtaccttagttccgtacgaccttaccgtacgtacggtaaccggaacactaccgtaccctacgtcctaacgaccgtacgtaccggacgggaccccgggaccgaccggaaccggaacggtaacggtaacgggaacggtaaccgttaaccgttacgttacgggttaaccggtaggtacggggacgggttaacgggtaaccgtaacgttttaacgttacggtttaagggttaccgggtttggggtacggggtaacccggtacgggtaaccggtacccgggttacgtaccgggttacccggtaacggtttacggtaccccggtaacggtacccggttaccggtcccccggttacccgccccggttccgttaccgttaccccgttccgttaacccccggtttccctacccccggttaaccg

SEQ ID NO: 2731 - DNA, 717 bp, Homo sapiens
  misc_feature: GYAE6OF01AZPTX.26.21.B10.1.454.CMB.1.raw
  modified_base (237)..(237): a, c, t, g, unknown or other
  misc_feature (237)..(237): n is a, c, g, or t
  modified_base (296)..(296): a, c, t, g, unknown or other
  misc_feature (296)..(296): n is a, c, g, or t
  modified_base (338)..(338): a, c, t, g, unknown or other
  misc_feature (338)..(338): n is a, c, g, or t
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggactccgtggccttcgatgagctgatcagccaccctcagtcgtccgtcgtccccgaggacagacacgcccacactcacctgctcggcagacaagtgganatagaatgctgctggtactaccagacgcaggccagtcccttattggcattctaccaagntaagacgcggaccctgacgggactcccgagtaccgtattcgnggcctaccaacgtcgacggaacactcgaccacgtctacgacctgtaccgacggccggggacccacggacccgtaaacgggtacggtaggaacgggtactaaccgttaacgttacgtttacgggacgtacgggtgggtacgggtaacgtaaacgtttacggttaacgtttgggttaaggtttacggggttttaccggggacgggggtaacggggtaaccctacggggtaccgttaccgggtaccccgttaccgggtaaccggtaccgtaccgggaaccccgtaaaggggtcccccgttcccgggtaacccccccgttcccggggttacctaacccccgttacccggtttcccgtcccccccgggtcccctttaaccccgg

SEQ ID NO: 2732 - DNA, 857 bp, Homo sapiens
  misc_feature: GYAE6OF01CMERL.26.21.B10.1.454.CMB.1.raw
  modified_base (149)..(149): a, c, t, g, unknown or other
  misc_feature (149)..(149): n is a, c, g, or t
  modified_base (819)..(819): a, c, t, g, unknown or other
  misc_feature (819)..(819): n is a, c, g, or t
tcagagactatactcacgaccggtgctcgatttagtgtcgtcgcaagagaggagggggcgtgggcctcaggaagcagcatcggaggtgcctcagccatggcatggactccctcttccttcctcggccgttccttgcttactgcacaggntccgtgccttcgatgagctgattcacgcccaccctcgacgtcgtccgtcgtcccgaggacagacacgaccacatccactcgctcggacaagaacgaagtgggaataataagaatcgactcgtccgttaggtactacgacgacggccacggtacctaccgttaccctttagtttcgtctacttacttacgaacgtagaacgacggtcccggacctacggtacgggtaccctccgtaacgtaccgttacttcgtcggtaccctaccgtaacgtaccgtaacggaacctaaccgaccgtacctacgtaccgtacgaaccgttacgtccgggaccgggaccccggggaacccctaaccggggtaaccgaaacggggttacggtaacggggaacggggttaacctaaccggtttaacttacgggtttccgggaaacggtcggggtaacgggttaacggggaaactttaaaccgtttaggtttaaccggtttaggggttttaacgggttccggggggtttaacggaccggggtaaaccgggcccgggttaacggggttacccgtaccccgggttaaccgggtttaacccggttacccggggaacctaaacccgggcccccgttaaacggggtccccctttaaacccccggggtccccccggttcggtttaaacccncccccggttttcccccggttaacccgtttacccccccg

SEQ ID NO: 2733 - DNA, 690 bp, Homo sapiens
  misc_feature: GYAE6OF01CKDH0.26.21.B10.1.454.CMB.1.raw
  modified_base (150)..(150): a, c, t, g, unknown or other
  misc_feature (150)..(150): n is a, c, g, or t
  modified_base (168)..(168): a, c, t, g, unknown or other
  misc_feature (168)..(168): n is a, c, g, or t
tcagagactatactcacgaccggtgctcgatttagtgtcgtcgcaagagaggaggggggactcctgtcgccccaccatggacacgctttgctccacgctcctgctgctgaccatcccttcatgggtcttgtcccagatcaccttgaaggngtctggtcctgcgctggnggacgcccacgcacgaccctcacgctcgacctgcctccgtctctaggtacttctcacctcaaccaacgtctggagtgaagtggtcggccgtcgggtccgaccgaccggaccccggaaacggccgtaggagtcggtctcgactactctatttacgtggtatgactcacgtaagcggtaactaacgtccgtactcgtaggaacggtactacgtactaccaacactaccgaaccgtaacgggaaccaaccgtaaccgaaacggtacccgggtagtacctaacgtaacgtacggaaccaacgtacgtacgtaactaccgtacggtacgaaaccgtacgacgactaactaattacgtaactgtacgacctaacgacgtacgtaccgtacgcgaacgtaacgaaggaaagtaaaacgagtacgtagtaacgttaggtacgggtaaccggttaggttaacggtttcccggtaaccgtacccggtacccctaacccgaaccgtccctaaacccggaacccggtaacccgg

SEQ ID NO: 2734 - DNA, 754 bp, Homo sapiens
  misc_feature: GYAE6OF01A88Z9.26.21.B10.1.454.CMB.1.raw
tcagagactatactcacgaccggtgctcgatttagtgtcgtcgcaagagaggagggggggggcctcaggaagcagcatcggaggtgcctcagccatggcatggactccctctcttcctcggcgtccttgtcttactgcacagggggggggacttccggtcggtccttcgagtggacgcttgtattcacgccctaccctctagtcgtccgtcgtcccgaggacagacacgccaccactccacctgccgtcggacaagaacgtaaagttgggaagtaataagaaagtgacgtcgacgttaggtactaccgaggacggaccgacgcctacgttcccgttatttcggtctacttctaccgaaagtacgtaaacgacggccgtacccgtacgaacgggtaccttaccccgtaacggtaacccgttaacgtttccggtaccgtaccgttaacccgtaaccgtacggtaaccggaaacctaaccggaccgtaccctacgtaccgtaaccgaccgtacgtaccggacggtcccggggaccctaacgacccggtaaggacgtagggaacggtacgtaccttaattcgttacggacgtagggcggtaagggtactaagttacgtagtttggtaggtttcggtagggacgggtacggtacgacggtcgtcggtacccggtcgttacggacgacccggtcggaccggtcccgttcccgtacccgttcgttccctacgttaccttacccgtccccttccgttacccg

SEQ ID NO: 2735 - DNA, 728 bp, Homo sapiens
  misc_feature: GYAE6OF01DSQJP.26.21.B10.1.454.CMB.1.raw
  modified_base (328)..(328): a, c, t, g, unknown or other
  misc_feature (328)..(328): n is a, c, g, or t
tcagagactatactcacgaccggtgctcgatttagtgtcgtcgcaagagaggaggggggactcctgtgccccaccatggacacgctttgctccacgctcctgctgctgaccatcccttcatgggtcttgtcccagatcaccttgaaggagtctggtcctgcgctggtggacgcccagcacgaccctcacgctgacctgcctccgtctctgtacttctcactcaccacgactgagtagagtgtcggccgtcgggtcccgtcgaaccgggaccccggaaaggtcccgtagggtacgtcggtcttcgacctacgttacttaacgtttacgnggtagtacgacgttcctaacggaacggtccgtaactaacgttcccgtctacgtaggaacgtaacgacgtactaccaacctataccgaaaccggaacggaaccctaaccgtaccggaaaacgggtaccgggtttacgtaaccttaaacgaacgtacggaaccgtaactaagttaacgtaaacgttcgtaggtaacgaccgaacgacgactaacgtaatttacgttacgtgacacctaacgactaccgtacgtcggtaccgaacgtaacggacgtaaaagaaaacgttactaacggtacgtaacgtaagggttcggggtaaccttaaggggtttaactttccggacccttaccccgtccaaccccgtacgtacccccgtaaacgtacccggtaaacccgggg

SEQ ID NO: 2736 - DNA, 585 bp, Homo sapiens
  misc_feature: GYAE6OF01D2PFM.26.21.B10.1.454.CMB.1.raw
  modified_base (234)..(234): a, c, t, g, unknown or other
  misc_feature (234)..(234): n is a, c, g, or t
  modified_base (336)..(336): a, c, t, g, unknown or other
  misc_feature (336)..(336): n is a, c, g, or t
  modified_base (402)..(402): a, c, t, g, unknown or other
  misc_feature (402)..(402): n is a, c, g, or t
tcagagactatactcacgaccggtgctcgatttagtgtcgtcgcaagagaggagggggggggcctcaggaagcagcatcggaggtgcctcagccatggcatggatccctctcttcctcggcgtccttgcttactgcacaggatccgtggccttcgatgagctgattcagcccaccctcagtgtccgtcgtccccaggacagacacgccacatcacctgctcgcagacaatgganatagaatgctgcctggtacttaccagaggccaggccagtccccttatttggcattctcaagataagaagcgcctgagggactcccgtagaccgtaatttcgnggcctaccaactcgtaggaacacacgccactctacgacatcgacggccgggcccaagccgaaggtntaggaggacacctatacgttgtcgaggcgtaggaataatactattgtagttgttggacggtaggacctaggctacggacccgttcgtaacggtaccgacggtacccgaagggtcccgtacccgggtccccccgttcggtaccctacccgttccgttacccggttcccccgccccgttaccccg

SEQ ID NO: 2737 - DNA, 689 bp, Homo sapiens
  misc_feature: GYAE6OF01EBGX8.26.21.B10.1.454.CMB.1.raw
  modified_base (336)..(336): a, c, t, g, unknown or other
  misc_feature (336)..(336): n is a, c, g, or t
  modified_base (347)..(347): a, c, t, g, unknown or other
  misc_feature (347)..(347): n is a, c, g, or t
  modified_base (370)..(370): a, c, t, g, unknown or other
  misc_feature (370)..(370): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggactccgtggccttcgatgagctgattcagccaccctcagtcgtcccgtcgtccccaggacagacacgccaccatccacctgcctcggcaagaactaagttgggaatatagaatgctgcctaggtacttaccagacgcaggccacgtccccttagtttcgcacttcttacaagtataagacgcgcctgaggctccgngaccgtattcncggtctacactcgtacggaaccncgacgcctactcacgaccagtcgacgggcccggaccctacgaccgaaacgggtagtacgggaacggggaacaccgttaacgtagtttacgggacgtacgggaccggttagggaaacgtaacgttacgttaacgtttagggttacggtttcggggtttacgggaccgggtaacgggtaccggtacgggtccgtaccgggtaaccccgtcggttaaccggtccggaacccggacccggtaccggtcccgtaccccgggtcccccgttaccgggttccctacccgttcccgtttccccgtcccccgtacccgttaaccccgg

SEQ ID NO: 2738 - DNA, 745 bp, Homo sapiens
  misc_feature: GYAE6OF01BQ2A5.26.21.B10.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtcgtccgtcgtccccaggacagacagccaccatcacctgctcgcagacaaagttgganataagaatgctgctggtactacgagacgccaggcctacgttccccttagttttcggtactacttccttaccaagtaacgtaaacggacgccggccctagaacgggtactcccgtagtaccgttaactttcgtacggtacctaccgtaacgttcgtaacgggaaaccaaccgaccggtaccctaaccgttccgttaacggaaccctaacgtacccgggaacgggccccgggggacccaaccgggacccgtaaacgggtagtacgggaacgggtaacgtaaccttaacgttagtttacggacgtacgggtacggtagggtaagtaacgttacgttaagtttaggttaggtttcgggtacgggtacgggtaacgggtaccggtacggtccgttacggtacccggttaccggttacggtaccgaacccggtacccggtacgggtccctcccgggtacccccgttcggtacccttacccgtttacccgttcccgttccccctaccccgttaccg

SEQ ID NO: 2739 - DNA, 893 bp, Homo sapiens
  misc_feature: GYAE6OF01CR2YT.26.21.B10.1.454.CMB.1.raw
  modified_base (204)..(204): a, c, t, g, unknown or other
  misc_feature (204)..(204): n is a, c, g, or t
  modified_base (241)..(241): a, c, t, g, unknown or other
  misc_feature (241)..(241): n is a, c, g, or t
tcagagactatactcacgaccggtgctcgatttagtgtcgtcgcaagagaggagggggctgggcctcaggaagcagcatcggaggtgcctcagccatggcatggatccctctcttcctcggcgtccttgcttactgcacaggatccgtggccttcgatgagctgattcagcccaccctcagtgtccgtcgtcccaggacagacngccaccatcacctgctcggacagacgaaagttggganatagaatgctgcctggttaactaccgaggacggaccgacggccacgttccccttagttttcggtactacttccgtaccaaaggtaacttaaacggaaacggccgggtaccccctacggaaacggggtaccttaccccggtacggtaacccgttaaagttttcccgtacgggtacccttaacccgtaaaccggttacggtaacggggaaaccctaccgtaaccggtacccctacgtcccgtaacggaccctaacggttaccggaaccgggggaccccgggggaacccccgaacgggtaaaccccggtaaacggggtaacggttaacgggggaaccggggtaacgtaacccgtttaaacgttaacggtttacgggtaccggtaacggggggtaccgggttaaacggggtaaacggttaaacgtttaaccgttaggttttaacgggggttaaggtttacggggttttacgggggaaccggggtaacgggtaacccgggtaccgggtccgttaaccggggtacccggttaaccgggtaccgggttaacccgaccggggtaaccccggtaacggggttaccccttcccccggggttaccccccgttacggggttacccctaaccccggtttcccgttcccccggtttaacccccccg

SEQ ID NO: 2740 - DNA, 660 bp, Homo sapiens
  misc_feature: GYAE6OF01ER6YN.26.21.B10.1.454.CMB.1.raw
  modified_base (247)..(247): a, c, t, g, unknown or other
  misc_feature (247)..(247): n is a, c, g, or t
  modified_base (397)..(397): a, c, t, g, unknown or other
  misc_feature (397)..(397): n is a, c, g, or t
  modified_base (458)..(458): a, c, t, g, unknown or other
  misc_feature (458)..(458): n is a, c, g, or t
  modified_base (553)..(553): a, c, t, g, unknown or other
  misc_feature (553)..(553): n is a, c, g, or t
tcagagactatactcacgaccggtgctcgatttagtgtcgtcgcaagagaggaggggggggcctcaggaagcagcatcggaggtgcctcagccatggcatggatccctcttccttcctcggcgtccttgcttactgcacaggatccgtggccttcgatgagctgattcacgccaccctgacgtcgtcccgtcgtccccaggacagacacgccacatccacctgcctcggacagaactaagttggganataagaatgactgcctaggtataccgagaggccaggccacgtccccttatttgctactctaccaagtaataaggacgccgtccctgaggtcctccgacgtacgtaactttcgcggtacctaccgaacgttccggtaacggaacctaccgntacccgacttactacgaccctagtaccgtcgggacccgggtacccaacggacctaaacggngtaaggaggaactactaacgtgtacgtacgaggtcggtaggtaactagtacgttagttacggtagttgggttacgggacgggtacggtaaccggnggtaccggttacggtacccgtaccggtaggtaccgaccggaccgacggtccccgacccggtccctaccggtccttacccgtcttacccggtccccctaccgtacccg

SEQ ID NO: 2741 - DNA, 631 bp, Homo sapiens
  misc_feature: GYAE6OF01BJEAS.26.21.B10.1.454.CMB.1.raw
  modified_base (235)..(235): a, c, t, g, unknown or other
  misc_feature (235)..(235): n is a, c, g, or t
  modified_base (300)..(300): a, c, t, g, unknown or other
  misc_feature (300)..(300): n is a, c, g, or t
  modified_base (320)..(320): a, c, t, g, unknown or other
  misc_feature (320)..(320): n is a, c, g, or t
  modified_base (339)..(339): a, c, t, g, unknown or other
  misc_feature (339)..(339): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccacctcagtgtccgtgtccccaggacagacacgccaccatcacctgctcggcagacaagttggganatagaatgctgctgtatacagagcacgccacgtccctatttgcacttctacaagatagagcgccngaggactcctgacctattcngtctcactcgtacggaacncgacgacctactcgacgtaccacgtacgacgggtaccgggacccaaggacccgaacggacgtacgggaacgggacgtaacttacgttacgttaggtaccgtagggtcggtagggtactaacgttacgtagtttacggttacggttgggtttacgggaccggtacgggtaccgtacgggtccgtacgggtacccgttacgtacggtccgaaccggtacccgaacgggtcccgttacccggtccccccggttaggttcccacgttcccgtcccgttccccgtccccgttacccg

SEQ ID NO: 2742 - DNA, 762 bp, Homo sapiens
  misc_feature: GYAE6OF01EJ8OY.26.21.B10.1.454.CMB.1.raw
  modified_base (258)..(258): a, c, t, g, unknown or other
  misc_feature (258)..(258): n is a, c, g, or t
  modified_base (751)..(751): a, c, t, g, unknown or other
  misc_feature (751)..(751): n is a, c, g, or t
tcagagactatactcacgaccggtgctcgatttagtgtcgtcgcaagaggaggaggggggggcctcaggaagcagcatcggaggtgcctcagccatggcatggatccctctcttcctcggcgtccttgcttactgcacaggactccgtggtccttcgatgagctgattcacgccaccctgagttgttccgcgtccccaggaccaggacacgccactagtccacctgcctcgacagactaagtggaatagtaagaagtncgtcgtccgttaggtacttaccgaagtacggtaccaggtcctacgttacccccgtttagttttacggtctacttccttacgaaagtaactaacggtacgccggtacccgtacgtacgggtacccttacccgtacgtaacccttaagtttcgtccgtacttaccctaccgtacgttacgggaaacctaccgactacccgtactctacggaacctacttaccgggaccggtcccgggaacccaggtaccccgaaacgggtacgtaacgggaacggtacgtaaccttaacgttaggtttaccggtacggtaccgggtcgggtaaacgggtaacgtaacgtttaacgtagttttaccgggttaggtttcccgggttaaggggtaccgggacggtaacggcggtcgtaacggcccgtttaccggacgttacgacccggtacccgtaaggcccctacccggtcccccgtacggtaccttacctccgtttcccctccccncccgttaccgg

SEQ ID NO: 2743 - DNA, 911 bp, Homo sapiens
  misc_feature: GYAE6OF01C8QX6.26.21.B10.1.454.CMB.1.raw
  modified_base (182)..(182): a, c, t, g, unknown or other
  misc_feature (182)..(182): n is a, c, g, or t
  modified_base (263)..(263): a, c, t, g, unknown or other
  misc_feature (263)..(263): n is a, c, g, or t
tcagagactatactcacgaccggtgctcgatttagtgtcgtcgcaagagaggagggggctgggcctcaggaagcagcatcggaggtgcctcagccatggcatggactccctctcttcctcggctccttgcttactgcacaggatccgtggtccttcgatgagctgtattcacgcccaccctnagtcgtccgtcgtccccgaggaccacgacacgcccaacctatccaccgtcgccgtcggacaagaactaaaggttggggaanaataagaaagttgcctggtaccgttacgggttaacttaaccgaggaaccggtaccgacggaccctaccgtttcccccttaagtttttccggtcctacttaccgttaccgaaaggtaacgtaaaggtaaccggtacccggtaccccgttacggaaacggggtacccttaccggtaccgttaaccgttaacgtttccgtacggtacccttaccgtaaaccgtttccggaaccgggtaaacccaccggtaacgtcccctaaccggtttaccgtaccgtaacccctaacgtacccgggtacccgggtacccccgggggaaccccgtaaccggaaccccggtaaaccgggacggtttaaacggggacgggttaaccgtaaaccgtttaaccgtttacgggtttacggtaaccggtacggggtaaccgggttagggtaaaccgggtaaatttacccggttttaaggttaggggtttacggtttacggggttttacggggaaccggggtagggaacccggttaaggggtaccgtaaccgggttacccgggttaccggtacccgggtacggaaccgggtaccccggaaccggttcccgtaccccggtacccccggttacccgaccctttacccgtcccgttccccgttaccccccg

SEQ ID NO: 2744 - DNA, 645 bp, Homo sapiens
  misc_feature: GYAE6OF01DO17Q.26.21.B10.1.454.CMB.1.raw
  modified_base (176)..(176): a, c, t, g, unknown or other
  misc_feature (176)..(176): n is a, c, g, or t
  modified_base (235)..(235): a, c, t, g, unknown or other
  misc_feature (235)..(235): n is a, c, g, or t
tcagagactatactcacgaccggtgctcgatttagtgtcgtcgcaagagaggagggggggggcctcaggaagcagcatcggaggtgcctcagccatggcatggatccctctcttcctcggcgtccttgcttactgcacaggatccgtggccttgatgagctgattcacgccacctnagtgtccgtcgtccccaggacagacacgccaccatccactgctcgcagacaaatggganatagaaatgactgcctaggtacttacgagacggccacggccacgttccccttagtttcggtcctattccttaccaaagataaaggaacgccggacccctagacgggtacctcccgtagaaccgttaactttccgtggtccctaccctaactcggtaacgggaaaccacgtacgccctactccgtacacctagtcgaccggccgggacccacgacccgaaggactacggaaggactaactactagtcggcgtaggcgtagggaactattacttagtaggttagttcggttaggggaccggtacgggtacaggtaccgtcggtacccgtcgtaagggccaacggacccaacggtccctcccggaccccgttcggtcccaccttcggttacccctccccgtacccgttacccg

SEQ ID NO: 2745 - DNA, 633 bp, Homo sapiens
  misc_feature: GYAE6OF01C9FWU.26.21.B10.1.454.CMB.1.raw
  modified_base (240)..(240): a, c, t, g, unknown or other
  misc_feature (240)..(240): n is a, c, g, or t
  modified_base (462)..(462): a, c, t, g, unknown or other
  misc_feature (462)..(462): n is a, c, g, or t
tcagagactatactcacgaccggtgctcgatttagtgtcgtcgcaagagaggagggggctggcctcaggaagcagcatcggaggtgcctcagccatggcatggactccctctcttcctcggcgtccttgcttactgcacgaggatccggtggccttcgatgagctgattcagccaccctcagtcgtccgtcgtccccaggacagacagccaccatcacctgcgtcgcagacaagtggganatagaatgctgctggtactacagacgcaggccacgttccccttatttcgctacttccttacaagtataacgaacgccggtaccctgacgggtactccgtagaccgttaattcgtacggcctaccaacgtcgtaacggaacacacgcctaactcacgaccacgtccgacggccgggacccacgacccgaaggagtacggacggactactagttacgtgtacgnggcggtacgggtataacgtactaggttgtaggttcggttcgggacggtaggaccgtaggtaccgtccggtaaccgtccggtaaacggtcgaaccggtacccggtaaccggtccgttccccggtacccccgttacgggacccttaacccgtccgttccccggttaccccccc

SEQ ID NO: 2746 - DNA, 719 bp, Homo sapiens
  misc_feature: GYAE6OF01DP1KR.26.21.B10.1.454.CMB.1.raw
  modified_base (239)..(239): a, c, t, g, unknown or other
  misc_feature (239)..(239): n is a, c, g, or t
tcagagactatactcacgaccggtgctcgatttagtgtcgtcgcaagagaggagggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacacgccaccatcacctgctcgcagacaaagttgggaanatagaaatgctgccgtgtaacttaccagacggccacggaccacgttccccctttaagttttcggtctattcctttaccgaagtaataaggaacgccggtaccctcgacgggtactccccgtagacctaatttcgtacggccttacccgaacttcggtaggaaccacgaacgccctactcacgaccatcgacggacccgggtacccaacgtaccgaaacggggtagtggggaacgggtaaagtaaccgttaacgtttagtttaccggtaaccggacgggttagggtaaacggggtaaacgtaaagtttaaccgttaaggtttcggttaaggtttgggtttaggggaccggggtacgggtaacgacgggttcggtaaccgtaccggtaccggtacggtaccgtacggaccccgtaagggcccttaccggtacccccgtcggtaccctaccttcccgttacccgtccccctacccgttacccg

SEQ ID NO: 2747 - DNA, 797 bp, Homo sapiens
  misc_feature: GYAE6OF01EVJJO.26.21.B10.1.454.CMB.1.raw
  modified_base (181)..(181): a, c, t, g, unknown or other
  misc_feature (181)..(181): n is a, c, g, or t
tcagagactatactcacgaccggtgctcgatttagtgtcgtcgcaagagaggaggggggggcctcaggaagcagcatcggaggtgcctcagccatggcatggactccctctcttcctcggcgtccttgcttactgcacaggactccgtggccttcgatgagctgacttcacgcccaccctnagtcgtccgtcgtccccaggacagacacgcccaccatccacctgccgtcggacaagaactaagtggaatataagatcgctgctagtactacgagacgaccgacggtccacgttccctttagtttcgactactccttaacgaagtacaacggaccgccgtccaggtacggtacctaccgtagtaccgttacttcgcggtacctaccgtacgtcgtaacggaaccacgactaccctacgtaccgtaccgaacctacgtaccgggtaaccgggccccgggtaacccaaccggaaccggtaaaacggtgggtaacgggaacgggtaccgttaaaccttaacgtttaggttaccgtacggggtaccgggtaacgggtaacgggtaaacgttaaacgtttacggtttagttttacggggttaacgggtttcgggttaacggggacccgggttaaacgggtacccgaacgggttcccggttaacggtaacccggttacccggtaaggtacccccgtaacggggaccccgttaacccggtccccgttaaccccccgggtccccggttaccggttacccttcccgtttaccccgggttcccccttccccccggtactttacccgg

SEQ ID NO: 2748 - DNA, 717 bp, Homo sapiens
  misc_feature: GYAE6OF01DM2FO.26.21.B10.1.454.CMB.1.raw
  modified_base (118)..(118): a, c, t, g, unknown or other
  misc_feature (118)..(118): n is a, c, g, or t
  modified_base (148)..(148): a, c, t, g, unknown or other
  misc_feature (148)..(148): n is a, c, g, or t
  modified_base (167)..(167): a, c, t, g, unknown or other
  misc_feature (167)..(167): n is a, c, g, or t
  modified_base (606)..(606): a, c, t, g, unknown or other
  misc_feature (606)..(606): n is a, c, g, or t
tcagagactatactcacgaccggtgctcgatttagtgtcgtcgcaagagaggaggggggactcctgtgccccacatggacacgctttgctccacgctcctgctgctgaccatcccttnatgggtcttgtcccagatcacttgaacggngtctggtcctgcgcgtggnggacgcccacgcacgaccctcacgctcgacctgcctccgtctgtgacttctcacctcaccagactggaggtgaagtggtcggccgttacgggtcccgtacggacccgggacccccggaaaggcccggttagggacggtggtccttacgcctacgttacttaacgttttaccggtggacgtttacgacttaccgtacgaaggtccggtaactaacgttcccgttctaccgtaggtaacgtaacctacgtaccttacgaaccctactaccgaaacgtaccgggacctaacccgtaccgggaaacggtaccgggttacttactaacgagtaccgaaccactagtacgacgtcgtaggacgacacgtacgactacgtattaacgttctggtacacaacgtcgtaacgtccgtacggacctacgaacggtaacgaaaggttaanaagtacggtagtaacgttacggggttcgggaaccgtttaagggtttcgtcccggttacccgtacccggtaccctacccggacccgtaccctacccggaaccggtacccccg

SEQ ID NO: 2749 - DNA, 754 bp, Homo sapiens
  misc_feature: GYAE6OF01DATQA.26.21.B10.1.454.CMB.1.raw
  modified_base (217)..(217): a, c, t, g, unknown or other
  misc_feature (217)..(217): n is a, c, g, or t
tcagagactatactcacgaccggtgctcgatttagtgtcgtcgcaagagaggagggggggggcctcaggaagcagcatcggaggtgcctcagccatggcatggatccctctcttcctcggcgtccttgcttactgcacaggctccgtggccttcgatgagctgattcacgcccacctcaggttcgtccgtcgtccccgaggacagacacgaccaccntaccacctgctcggacagaactaaggttgggaagtaacgtaagaaagtcgtacgtacgtaccgttaggttaactaacgaggtaccgggaccacggtcctacgttaccccgtttagttttcggctacgttactaccgaaaggtaactaacggtaaccgccggacctacggaaggtacccgtaccgtaccggaacgtttacgttcgtaccggtacctacctaacgttcgaacggtaaccacgtacgtacctacaccgtagaaccgtagtacccgacggacccggggaccctaacggaaccggaaacggacgtacgggaacggtaaccgtacgttagttacgtcggtacggacgggtaggtaacgggtaagtacttacgtttaacgttagggttacgtttcgggttagggaccgggtaacgggtaccggtacggtaccggtacgttacccggtaccggttaggacccgacggtacccgacggttcccggtacccgtcccggtccgtacctaccgttccgtacccgtcccgtcccgtaccg

SEQ ID NO: 2750 - DNA, 973 bp, Homo sapiens
  misc_feature: GYAE6OF01CYOSL.26.21.B10.1.454.CMB.1.raw
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggatccgtggccttcgatgagctgacttcacgccaccctcagtcgtccgtcgtccccaggacagacagccaccatccacctgcctcggacagaactaagttggagtaagtaagaatcgcgtgtaccgttaggttacttaaccgacggaacggcccgtaacgggacccctaccggttaccccctttaggttttccggttactaacgtttacctaaccgtaaaagtaagtaaaacggaacggtcccggtaacccctacggaaccgggtaccctacccggtaaggtacccggtttaaacttttccggtacggtaccctttaacccgaaaccggtttacccgggtaaacgggtaaacccaacccgtaaccgggtacccccttaaacgtttacccggtaacccggtaacctaaccgggttaccccggggaaccgggggacccccgggggttaaacccccgaaaccggggaacccccggtaaaacccgggggtaagggttaaacccgggggaacggggtaaaacccgttaaccggtttaaccggtttaaccgggtttaccgggtaacccggggtaaccgggggttaaccggggttaaggggtaaaccgttaaaaccgtttaacggtttaacgggttttacggttaggggttttacgggttacggggaaccgggggtacggtaccggtacgggtaccgtacggggtacccgttacccgggtaacgtaccgggtaccccgtaaccgggaaccggttcccccgttacccccggggacccccttcgggtaccccgttacccgttcccggttaccccccgttaccccctaccccgttttaaccccgg

SEQ ID NO: 2751 - DNA, 726 bp, Homo sapiens
  misc_feature: GYAE6OF01ER1R3.26.21.B10.1.454.CMB.1.raw
  modified_base (243)..(243): a, c, t, g, unknown or other
  misc_feature (243)..(243): n is a, c, g, or t
  modified_base (251)..(251): a, c, t, g, unknown or other
  misc_feature (251)..(251): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctcagtcgtccgtcgtccccaggacagacacgccaccatccacctgcctcggacagacaagttggganataagaangctgctaggtactacgagacgaccacggcctacgttccccttagttttcggtactacttaccttaccgaaagtaagtaaaggacgccggtaccctacggaacgggtaccttacccgtacgaccgttaactttcgtcggtacctaccgaactcgtacggaacacgacacctactctacgacctagtaccgacggaccgggacccgaaccgaccgaacggtacgtacggacggaacgtaactacgttacgttacgtacggtacgggtacggtaggtaacggtaacgttacgttagttaggttaggtttagggttacgggtacgggtacgggtaaccggtacggtaccgtaccggtaccggttaccggtacggtaccggtaccggtacccggaccggtcccggtaaaaaaaacccggtccccggtacccggttaccgtacccgttacccgttcccgttcccccgtccccgttaccccg

SEQ ID NO: 2752 - DNA, 732 bp, Homo sapiens
  misc_feature: GYAE6OF01C3C1Q.26.21.B10.1.454.CMB.1.raw
  modified_base (204)..(204): a, c, t, g, unknown or other
  misc_feature (204)..(204): n is a, c, g, or t
  modified_base (239)..(239): a, c, t, g, unknown or other
  misc_feature (239)..(239): n is a, c, g, or t
  modified_base (249)..(249): a, c, t, g, unknown or other
  misc_feature (249)..(249): n is a, c, g, or t
  modified_base (312)..(312): a, c, t, g, unknown or other
  misc_feature (312)..(312): n is a, c, g, or t
tcagagactatactcacgaccggtgctcgatttagtgtcgtcgcaagagaggaggggggggcctcaggaagcagcatcggaggtgcctcagccatggcatggactccctctcttcctcggcgtccttgcttactgcacaggatccgtggccttgatgagctgattcacgcccacctcagtcgtccgtcgtccccaggacagacncgaccacatccactgctcgacaggactaagtgganatagaatgcngctaggtactacgagacggccacggcctacgtcccttagtttcggcctatcctaacgaagtanaacggacgtccggacctacggaggtacctccgtacggtaacctagtttcctcggtaccttacccaacgttcgtaacgggaacctacgaccgaccctaccgtacgtacgaacccgtaacgtaccggaccgggacccggggaccccgtaaccgggaaccccgtaaacgggacgggtacgggaacggggaaccgttaacgtacgttaacgtttccgggacgtacgggacggttagggaagtaacgttagttacgttaggtttaggttggggtttacgggacgggtacgggtaccgacgggtacgtaccggtacgtacccggtaaggccgaacccggtcccgtacgggtccccgttcccggtcccccgttacggtacccgtttaaccctcccgtttcccccgggtccccttcccggtacccccg

SEQ ID NO: 2753 - DNA, 765 bp, Homo sapiens
  misc_feature: GYAE6OF01BYRK7.26.21.B10.1.454.CMB.1.raw
  modified_base (239)..(239): a, c, t, g, unknown or other
  misc_feature (239)..(239): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgccaccctcagtgtcccgtgtcccccaggacagacacgccaccatcacctgctcggcagactaagtggganaatagaatgactgcgtgtactacagacgccgacggccacgtccccttagtttcggtctacttcctaccaaggtaataagaacggccggaccctcgacgggtactccccgtagtaaccgtaactttcgtcggtacctacctaacgttccgtaacgggtaaccaacgaccggacctaccgtactaccgtacccgtacgtaccggaccgggcccgggaccccgacggaacccgtaacgggacgtacgggaaggggtaaccgtacgttaacgttacgttacggtaccggtaacggggtaccggtaggggtaacgtaaagttaacgtttaggtttaacggttgggtttacgggtttacggggacgggtaaccgggtaacccgggtacgggtaccggtaccggttacccggttaccgtaccgggtacccggaccggtacccggaacggtcccggttaccccggtacccccggttcgggttaccctacccggttacctttacccccggttcccccgtccccgtttaaccccgg

SEQ ID NO: 2754 - DNA, 808 bp, Homo sapiens
  misc_feature: GYAE6OF01END2E.26.21.B10.1.454.CMB.1.raw
  modified_base (180)..(180): a, c, t, g, unknown or other
  misc_feature (180)..(180): n is a, c, g, or t
  modified_base (556)..(556): a, c, t, g, unknown or other
  misc_feature (556)..(556): n is a, c, g, or t
  modified_base (769)..(769): a, c, t, g, unknown or other
  misc_feature (769)..(769): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacgaggatccggtggccttcgatgagctgattcacgcccaccctnagttcgtccgtcgtaccccgaggaccagacacgcccaccagtccaccgtgcgtcgacaacgaactaaggttgggatagtaacgaaagtcgtactcggtaccgttaggtaacttaccgaaggacggaccgacggccctacgttaccccctttagtttggtacctacgttaccttaccgaaaagtagtaaacggtaaccggccggtaccccgtacggaacgggtaccttaccccgtacggtaacccggttaaatttcccggtacggtaccctaacccgtaacctacgggtaaccggaaacctaaccgacgtaacccacttccgaacgacctacgtccgtaacgggacccggggtacccgaaccgtaccggaaaacggngtaacgggtaacgggaactaaccgttaacgttacgttcggtacggaacgggtcgggtaacgggtaacggaacttacgttaagtttacggggttaggttagggtttacggggacggtacggggtaccgtagggtacccgtagggtacccgttcggtaaccgtccgaacccggtaccgtacgggtccccgtacccgtcccccggtaccgttaccnccgttacccggtttccccgtcccccgtcccgttaacccg

SEQ ID NO: 2755 - DNA, 681 bp, Homo sapiens
  misc_feature: GYAE6OF01DPA8H.26.21.B10.1.454.CMB.1.raw
  modified_base (178)..(178): a, c, t, g, unknown or other
  misc_feature (178)..(178): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctnagtcgtccgtcgtccccaggacacgacacgcctaccatccacctgctcggacagaactaagttgggaatatagaatgctgccgtaggtaacttaccgaggacggtccaacggcctacgttccccttagttttcggtctacttccttaccgaaagtagtaaacgaacgtccggccctaggacgggtacctcccgtacgtaaccgttactttcgtacggtaccttacccaacgtcgtacggaaaccacgacgaccctactcgtacgacctagtcgacgggccggaccacgaccgaacggagtaggaacggaagtactacgttagttacgcgacgggtcgtagggaactaagttacttagttacggtaggtttgggttacgggacgggtacgggaccgtgggaccgtacggtaccgttaccggtacgtccggaccgtacccgaacggtccctacccggtccccgttcgtccctacgttcccgttccctaccccgttccgttacccg

SEQ ID NO: 2756 - DNA, 747 bp, Homo sapiens
  misc_feature: GYAE6OF01AWFEB.26.21.B10.1.454.CMB.1.raw
tcagagactatactcacgaccggtgctcgatttagtgtcgtcgcaagagaggagggggggggcctcaggaagcagcatcggaggtgcctcagccatggcatggatccctctcttcctcggcgtcctgcttactgcacaggatccggtggtccttcgatgagtctgattcacgcccaccctcagtcgtccgtcgtccccgaggacacgacacgccacatccacctgcctcggacaacgaactaaggttgggaactaataagaatcgctgtccgttagtactacgagacgccgacggtccgtacgttaccctttagtttcggtctacgttacctaccgaagtagtaaaggaccgtaccggtcctacggaacggtaccttcccgtacgtaacctacgtttcggacggtccctaacgtacgtcgtaacggaaaccacgtacgtaccctacgttaccgtaccgaccgtaacgtaccggaaccgggcccgggtaacccgacccgaacccggtaccgggtaacggtaacggggtaaccgggtaaccgttaaccgttaccgttaaggttcccgggaacgtacggggtccgttaaggggaaaccttacgttaacgggtttagtttaacgggttgggtttaacgggtttcggggaaacgggtacgggtaccgtaggtacccggtcgtaccggttcgacggtacgccgtaccgacggtcccgtcccgaccgttcgctaccgtcgtcctcccgcctacg

SEQ ID NO: 2757 - DNA, 832 bp, Homo sapiens
  misc_feature: GYAE6OF01DJ2TQ.26.21.B10.1.454.CMB.1.raw
  modified_base (153)..(153): a, c, t, g, unknown or other
  misc_feature (153)..(153): n is a, c, g, or t
  modified_base (172)..(172): a, c, t, g, unknown or other
  misc_feature (172)..(172): n is a, c, g, or t
tcagagactatactcacgaccggtgctcgatttagtgtcgtcgcaagagaggaggggggactcctgtcgccccaccatggacacgctttgctccacgctcctgctgctgaccacttccccttcatgggtcttgtcccagatcaccttgaaggngtctggtctgcgcgtgggngacgcccacgcacgaccctcacgctcgacctgcctccgtctcgtgtacttctcacctaccaccacgacgtggtaaggttagaagtggtccggtaccgttccgggtacccgtaccggaacccggggacccccggaaacggtcccggtagggtacggtcggtaccttggaccttaccgtacttaacgtttacggtgggtaacgtacgacgtaccgtacgtaacggtaccggtaactaaccgttccggttacgtacgtaggaacggtaactccgtaacctaccaaccgtactaccgaaccggaacggaaccctaaacccgtaaccggtaaacgggtaacccggtttacgttaacccgtaaacgtacgtaaccgaaccgtaaccgtaacgttaacgtaacgttcccggttaacgaacgggtaaccgacggaaccgtactaaaccgttaattaccgtttaacgtcgtaccgaactaacgtaacgtaccggttaccgtaccggtaccgaacggttaaaccgaaggaaagtaaaacgtaacgtaacgtacgttaggtaacggttaaccggggtaacgttaagggtttaaccgttccggttaaccccgtacccgttacccccgtaacccgtacccgtaaccccgtaaccggacccgggtaaaccccgg

SEQ ID NO: 2758 - DNA, 770 bp, Homo sapiens
  misc_feature: GYAE6OF01D54GW.26.21.B10.1.454.CMB.1.raw
  modified_base (209)..(209): a, c, t, g, unknown or other
  misc_feature (209)..(209): n is a, c, g, or t
  modified_base (226)..(226): a, c, t, g, unknown or other
  misc_feature (226)..(226): n is a, c, g, or t
tcagagactatactcacgaccggtgctcgatttagtgtcgtcgcaagagaggagggggggggcctcaggaagcagcatcggaggtgcctcagccatggcatggatccctctcttcctcggctcctgcttactgcacaggctccggtggtccttcgatgagtctagacttcacgcccaccctcagtcgtccgtcgtcccgaggacagacncgccacactccaccgtncgtcggacaacgaactaaggtgggaagaacgtaagaattcgcgtcgaccgttacggtaacttaaccgacggacggacccgacggtaccctaaccgttacccccgtttagttttcggtactactttaccttaccgaaagtaacggtaacgaacggccggtaccctacggtaacgggtaccttaccgtcgtaaacccgttatttccgacgtacccttaaccgtaccgtacggtaacggaacctacgaccgtaccctaccgttaccgtacgaacccgtacgtaccggaccgggtccccgggacccgaccgggaccgtaaaccggagtacgggaacggtacgtaaccgttacgttagttccggacggtacgggtacgggtacggtaagtaacgttacgttaggtttaggttacggtttagggtttcgggacgggtaacggaccggtacggtcgtaccggtacgtccggtacgtaccgacgtacccggaacgtcccgacccgtcccggaccgttaccacccttcgttacccggttcccctcgttacccg

SEQ ID NO: 2759 - DNA, 861 bp, Homo sapiens
  misc_feature: GYAE6OF01B9H7Y.26.21.B10.1.454.CMB.1.raw
  modified_base (176)..(176): a, c, t, g, unknown or other
  misc_feature (176)..(176): n is a, c, g, or t
tcagagactatactcacgaccggtgctcgatttagtgtcgtcgcaagagaggaggggggggcctcaggaagcagcatcggaggtgcctcagccatggcatggatcctctcttcctcggcgtccttgcttactgcacaggatccgtggccttcgatgagctgattcacgcccacctnacgtcgtcccgtcgtcccccgaggacacgacagcccaaccatcaccgtgcgtcggacagaacgtaaagttggggatagtaagaagtgactcgaccgtaggttactaccgaggacggccgaggccctacgttccccgttagtttttggcctaactttccgtactaaaacgagtaaacgaacggcccggaccctaggaacgggtaccttccctacggtaaccgttaatttccgtcggtacccttaaccgaaccggttcgtaacgggaaacctacgtaaccggtacccctacttacccggtaccgaaccgtacgtacccggaccgggtaccccggggaccccgaaccgggtaacccggaaaccgggttacggtaacggggtaacgggtaaccgttaaccttaacgggtttaaccgtttaccgggtacggtaaccgggtcgggtaaacgggttaacggtaaacgttttaacgttagttttaagggttacggtttaccgggtttacggggtaaccggtaacggggtaacccggtacggttaccgggtaccgttaccccgggttacggtaaccgggttaccggaacccgggtaccccgaaccggtcccgttaccccccggtacccggtacccggtttacccgtaaccccgtttcccggtttaccccgttcccggtaccccctttacccggg

SEQ ID NO: 2760 - DNA, 848 bp, Homo sapiens
  misc_feature: GYAE6OF01BL0Z3.26.21.B10.1.454.CMB.1.raw
  modified_base (178)..(178): a, c, t, g, unknown or other
  misc_feature (178)..(178): n is a, c, g, or t
  modified_base (221)..(221): a, c, t, g, unknown or other
  misc_feature (221)..(221): n is a, c, g, or t
  modified_base (242)..(242): a, c, t, g, unknown or other
  misc_feature (242)..(242): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccctaccctnagtgtccgtcgtccccaggacagacacgccacatcacctgccncggacagaactaagttggganataagaatgctgcctggtactacgagacggccacggcctacgtcccctttagtttcggtactacttccttaaccgaaagtaacgtaaacggaacggtacccggaccccgttacgaacggggtaccttccccgtaacggtaaccgttaaccgtttcgtccggtaccctacccgtaaacctaccgggtaacgggaaacccaacgtaccgtaccctaccttaccgtacgaaccgtacgtaccggaccgggacccggggaccccacgggaccccgtaaacgggtacggtacgggaaacggggtaacgtaacccgttaccgtttaaggttaccggtccggtaagggtccggggtaagggtaaaccgtaagttaacggttagtttacgggttaagggtttcgggtttacgggggaccggggttaacgggtaaccggtacgggttacccggttacgggtaaccccggttttacggaaccgggttaacccgtaccgggtaccccgggttaaacgggtcccccggttacccccggttaccccccggttacccgggttaccctacccccggtttaccggtttcccccccggttaccccgtccccccgtttacccgg

SEQ ID NO: 2761 - DNA, 855 bp, Homo sapiens
  misc_feature: GYAE6OF01E1FDV.26.21.B10.1.454.CMB.1.raw
  modified_base (231)..(231): a, c, t, g, unknown or other
  misc_feature (231)..(231): n is a, c, g, or t
tcagagactatactcacgaccggtgctcgatttagtgtcgtcgcaagaagagggggctgggcctcaggaagcagcatcggaggtgcctcagccatggcatggatccctctcttccgtcggcgttccttgccttactgcacgaggactccgtcggtccttcgagtgagtctgtacttcaaccgcccaccctcgagtcggtccgtcgtccccagggacacgacacgacccacntccacgtgtcctcgacaagataagtgggatatagtaatcgctgcctaggtacctacgagcggaccacggcctaccgttccctttagtttcggtacttacttaccttaacgaaggtaacgtaaacggaccggtcccggtaccccgtaagggtaccggtaccgttacccgtaaggtacccgtttaactttcggcccgttacccttaaccgtaccggtaccgtaccggaaccgtaacacccgtaccctacgttaccgacgtacccgtacgtaccggacccgggtaccccggggaacctacccgggtaacccgggtaaaggtaccgggtacgggaaacggggtaacctttaaccggtacgtttacggttcggtacgggttacgggtaacgggttacgggtaaggttaaacctttgggttttaacggtttacggttggggttttacgggtttaaggggacccggggtttaccggtaaacgggtccggtacccggttaccgggttaaccccggttaccgggtacggttacccggaacccgggtacccggtcccggaccccgtttcccccggtaccccgttcccgggttacttaccccggttcccgtttacccccgttccccccgtacccg

SEQ ID NO: 2762 - DNA, 683 bp, Homo sapiens
  misc_feature: GYAE6OF01BRHVX.26.21.B10.1.454.CMB.1.raw
  modified_base (246)..(246): a, c, t, g, unknown or other
  misc_feature (246)..(246): n is a, c, g, or t
  modified_base (252)..(252): a, c, t, g, unknown or other
  misc_feature (252)..(252): n is a, c, g, or t
tcagagactatactcacgaccggtgctcgatttagtgtcgtcgcaagagaggaggggggggcctcaggaagcagcatcggaggtgcctcagccatggcatggactccctctcttcctcggcgtccttgcttactgcacaggactccgtggtcccttgatgagctgattcagccaccctcgagtcgtccgtcgcccgagacgagacacgccacactcacctgcctcgcaacgactaagtgggaaganaagaangctgcgtaggtactacgaggacgccgacggcctacgttccgttagtttgtctacttacgttaaccgaagtaagtaacgaacgccgaccgtcgacggtacctccgtacgtaaccgtagtttcgacggtcctaacctaacgtcgacgggaacctacgacgacctcgtacctacgaccagtaccggaccgggccggacccaaccgaccgaacggtagacgggaagggtaacctaacggttactacggtcggtacggacggtcgggtaaggtaagttaacgtacgttgttaacggttcggttagggtacgggacgggtacgggaacgacgggtaccgtacggaccgttcggtacgggtccgaccgtaccggacggtcccgacccgttccccgtaccgttaccgaccttccgttaccccctcccgtaacccgtccg

SEQ ID NO: 2763 - DNA, 868 bp, Homo sapiens
  misc_feature: GYAE6OF01CMPYY.26.21.B10.1.454.CMB.1.raw
  modified_base (181)..(181): a, c, t, g, unknown or other
  misc_feature (181)..(181): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggactccgtggcccttgatggagctgattcacgccctaccctnagtcgtccgtcgtccccaggacacgacgacgcccaaccatccacctgccgtcggacaacgaaacgtaagttgggaagtataaagtaagtgtacctcggtaccgttaggttaacttaaccgaacggacggaccgacggtacccgtaccggtttaccccctttaggttttcgggtaccttaacgttaccgttaaccgtaaaggtaacgttaaacgggaaccggtaccccggttaccccgtaaccggtacggggtaccctaccccgttaacggtaacccgttaagttttccgaccggttacccttacccgaaccgttacggaaccgggtaacccacgtaccgcccttaaccgtaccgtacccgaaccttaccggacccggcccgggtaccccgggtaacccccgaacgggtaacccccgggaaggtaaacccgggtacgggtaaaccggggtaaaccgttaaccgtttaaccgtttaacgggtttaccgggtacccgggtaacggggttacgggtaaacgggttaacgtaaacggttttaacgtttaagggtttacggttgggtttacgggttacggggacgggtaacgtacggtacggtacgtccgtaccggtacgtacggtaccgaccggtacgaccgtccggttaccccgaccgtcgtaccctccgtccgttccctcccgtcctccg

SEQ ID NO: 2764 - DNA, 795 bp, Homo sapiens
  misc_feature: GYAE6OF01DK62V.26.21.B10.1.454.CMB.1.raw
  modified_base (178)..(178): a, c, t, g, unknown or other
  misc_feature (178)..(178): n is a, c, g, or t
  modified_base (202)..(202): a, c, t, g, unknown or other
  misc_feature (202)..(202): n is a, c, g, or t
  modified_base (259)..(259): a, c, t, g, unknown or other
  misc_feature (259)..(259): n is a, c, g, or t
tcagagactatactcacgaccggtgctcgatttagtgtcgtcgcaagagaggaggggggggcctcaggaagcagcatcggaggtgcctcagccatggcatggactccctctccttcctcggcgtccttgcttactgcacaggactccgtggccttcgatgagctgatcagcccacctnagtcgtccgtcgtccccgaggacncgacacgaccaaccatccaccgtcgtcgtccggacaacgtaactaaaggtgggaaanataagaaatcgactgaccgttaggtaacttaccgaagaccggccaggccctacgttccccttagtttcggactactccttacaagtagtaacgacgccggaccctacggaggtcctacccgtagtaaccgttacgtttcgcggtaccttaccgaacgtcgtaacggacaccgacgcctactcgtacgaacctagtaccgacgggtcccgggacccaagggacccgaaagggacgtacggggaaacggtacgttacgtaaccttaggttccggtcggtaacgggtcggtaaggggtaactaacggtttaacgttagtttacggttaacgggtttggggttacgggacggggttaacgggtacccggtacggtaccggttaaccggtacccgggttacccgtaacggggtaccctaaacccgggtaccccggtaacgggttcccctcccccccgggttaccccgttaccccgggttacccttacccccgggttttcccgggttcccccggttcccccccggttcccctttaccccggg

SEQ ID NO: 2765 - DNA, 651 bp, Homo sapiens
  misc_feature: GYAE6OF01C0AQT.26.21.B10.1.454.CMB.1.raw
  modified_base (249)..(249): a, c, t, g, unknown or other
  misc_feature (249)..(249): n is a, c, g, or t
  modified_base (397)..(397): a, c, t, g, unknown or other
  misc_feature (397)..(397): n is a, c, g, or t
  modified_base (403)..(403): a, c, t, g, unknown or other
  misc_feature (403)..(403): n is a, c, g, or t
  modified_base (414)..(414): a, c, t, g, unknown or other
  misc_feature (414)..(414): n is a, c, g, or t
tcagagactatactcacgaccggtgctcgatttagtgtcgtcgcaagagaggagggggggggcctcaggaagcagcatcgggaggtgcctcagccatggcatggactccctctcttcctcggcgtccttgcttactgcacaggactccgtggtccttcgatgagctgattcacgcccacctcagtcgtccgtcgtcccaggacacgacacgccacactccactcgcgtcgacagtaactaagtcggaanagtagaatcgctgtcgtagttactacgagacggccacgacctacgttccttagtttcgactagttactacgaagaagtaacgacggtccgcctacggaggacctccgtacgaccgttattcgacgtcctaccgactcggaacggaacncgtacnctactcgtacncctagcgacggcccggaccaacgaccgaaggcggtaaggacggtactacttacgtagttacggtacgagggtacgtaacgggtaactaacgttaggttaagtttacgggttaggttacgggttgggaccgggtacggtacggcggtacgtacgtacccgtacgacggtaccgacgtacccggacggtcccgtaccgcccgttcgtacctacgttcccgtcgtccccctacgttaccg

SEQ ID NO: 2766 - DNA, 762 bp, Homo sapiens
  misc_feature: GYAE6OF01AN117.26.21.B10.1.454.CMB.1.raw
  modified_base (179)..(179): a, c, t, g, unknown or other
  misc_feature (179)..(179): n is a, c, g, or t
  modified_base (247)..(247): a, c, t, g, unknown or other
  misc_feature (247)..(247): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctagattcacgcccaccctnaggtcgtccgtcgtcccccaggacagaccagcccaccatcacctgcctcgactagaacaagttggganataagaatgctgccgtggtataccgagacgccaggccacgtcccctagtttcggtctatccttacaagataacgacgtccggaccctacgacgggtactcccgtacggtacccgttaatttccgtacgggttccctaacccgtaaccgttccggtaacgggtaaaccacccgtaaccggtcccctaacctccgttacaaccctagtacccggacggacccgggaccccaaccggaccccgaaaccggtaggtaacggaacggggtactaacccgttacgtaacgtttccgggacgtagggtccgggttaacgggaataaccgtttaacgttagtttacgggttaggttgggttaccggacggggtaccgggtaccgtacggtacccgtacgggaccccgttacgggtaaccggaccggtaaccccggtaccggaccgggtacccctcccccgggtacccccgttcgggttacccctacgtcccccgtttcccgttaccccccgtccccttacccg

SEQ ID NO: 2767 - DNA, 823 bp, Homo sapiens
  misc_feature: GYAE6OF01BYJN5.26.21.B10.1.454.CMB.1.raw
  modified_base (249)..(249): a, c, t, g, unknown or other
  misc_feature (249)..(249): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctcagtcgtccgtcgtcccgaggacagacacgccaaccatccacctgccgtccggacacgaactaagtgggaanaataagaatgcgtcgtcctaggttaactaccgaaggacggccgacggtcccctacggttccccttagttttcggtactacttaccgttaaccaaagtaataaacggaccggccggaccccgttacgaacgggtacctacccgtacgtaacccgttaactttccgtaccggtacctaacctaaccgtcgtaacggaaccacgaccgacctacgtactacgaccacgtccggacggtcccggggaccccaaggaacccggtaaggtacggacggggtaacggtaacgtaaaccgtacgttacgttaccggacggtacggggtacggttaacggggaactttaaacggttaacgtttacggtttaagggttaagggtttggggtttaccgggaacgggggttaaccggacccgggtaggtaacccggtaccgggttaacccgttaccggtaacgggttcccgaacccgggttaccccgtaacccgggtccccggaccccgggtttacccccgaccgggttaccccgtttaccgttccccggttaccccggttccccccgtaccccgtttaacccggg

SEQ ID NO: 2768 - DNA, 834 bp, Homo sapiens
  misc_feature: GYAE6OF01ARL50.26.21.B10.1.454.CMB.1.raw
tcagagactatactcacgaccggtgctcgatttagtgtcgtcgcaagagaggagggggctgggcctcaggaagcagcatcgggaggtcgcctcagccatggcatggactccctctcttccgtcggcgtcttgcttactgcacgaggactccggtggtccttcgatgagtctgtacttccgacgtacccctacccgtcgtacggttccgttcccgttccgtacccccgaggaaccgacgaccgaccgacccacctaactaccctaccgtcgtccggtaccggacctaacggaaacgttaaacggttaggggaaagtaagtaaacggtaaacgtcgtccgtacggtaccgttaggttaaccgtaacggacggacggcccgaccggtacccttaccgttccccgtttagtttccgactaccgttacctaacgaagtaacgtaacggaccgtcccggtaccgtacgacggtacctccgtacgtaacgttcgttacgcgtacctactaccgtagaccgacacgctacctactccgtacgaaccgcgtaccgggaccgggtaccccggacgtaacgggaacccggtaaggtcggaacgggtaacggtactaaccggttagtaccggtcgggtaacggcgggttaaggtacggtaaacgtacgtttacggttaggttcgggttaccgggttagggtcccgggaacggggacgtaaccgggtcggaccggttacccggtaacggtaccggtccgaacccggtcccggaccgtaaccgggttccccaccccggttcccgttaccggtaccctttcccgggttccccttaccccggttaccccg

SEQ ID NO: 2769 - DNA, 765 bp, Homo sapiens
  misc_feature: GYAE6OF01CDP9E.26.21.B10.1.454.CMB.1.raw
  modified_base (259)..(259): a, c, t, g, unknown or other
  misc_feature (259)..(259): n is a, c, g, or t
  modified_base (666)..(666): a, c, t, g, unknown or other
  misc_feature (666)..(666): n is a, c, g, or t
tcagagactatactcacgaccggtgctcgatttagtgtcgtcgcaagagaggagggggctgggcctcaggaagcagcatcggaggtgcctcagccatggcatggactccctctcttcctcggcgtccttgcttactgcacgagggactccggtggtcccttcgagtcgagctgattcgacgcccaccctgagttcgtcccgtcgtcccccgaaggaccaagaccgacgcccaacctatcccaccgttgacctccggganaacggaactaaggttggggaagtataaaggtaacgttggcttacggtccgtaggttaactaaccgaggtacggccgaacggcccgtaaccttccccgtttagtttccgggacctagttacccgttacaaagtacgtaaaggtacgcccgtaccgtggaacgggtaccttccgtacggaaccgtttacgtttcgcggtaccctaacgtacgtcggtaacggaacacgaccgcctacgttcgaccgacacgtccggacgggcccggaccggaacgaccgtaagggtacaacggggaacggtacgtaacgtttacgtacggtcgacggaagggttccggtaagggaacttaaggttaaccggtttaggtagggtttagggtcgggttaacgggaccgggtagtaacccgngggtaccgtaccgtcggtaccggtacgtaccgaacccgttcggaccgggtcctcccccgggtacccgtcggtaccctccggtccgttcccccgtacccg

SEQ ID NO: 2770 - DNA, 650 bp, Homo sapiens
  misc_feature: GYAE6OF01BQV2Y.26.21.B10.1.454.CMB.1.raw
  modified_base (205)..(205): a, c, t, g, unknown or other
  misc_feature (205)..(205): n is a, c, g, or t
  modified_base (213)..(213): a, c, t, g, unknown or other
  misc_feature (213)..(213): n is a, c, g, or t
  modified_base (236)..(236): a, c, t, g, unknown or other
  misc_feature (236)..(236): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctcagtcgtccgtcgtccccaggacagacncgccacancacctgctcgcagacaagtgganatagaatgctgctagtactacagacgcagccacgtccccttatttcggtcatctacaagactaagacgccgcctagacggctccgtacgactaattcgacgtcctacctaacgtcgtacggaacacgacgcctactcgtacgaccatccgacggccgggaccaccggacgaacggtagtaacgggaggtaacgtacttacgtacgttacggacgtaggtcgggtagggaagttaacgttacgttagttaggttacgggtttgggttacggggaaccgggtacgggtacccggaggtaccggtcgggtaaccccgttcggtaacggtccgaacggaccccggtacgtcccgtcccggtacccccgtccggttaccacccgtttcccgtacccggttccccgtacccgttaccccg

SEQ ID NO: 2771 - DNA, 764 bp, Homo sapiens
  misc_feature: GYAE6OF01D79M4.26.21.B10.1.454.CMB.1.raw
  modified_base (181)..(181): a, c, t, g, unknown or other
  misc_feature (181)..(181): n is a, c, g, or t
  modified_base (252)..(252): a, c, t, g, unknown or other
  misc_feature (252)..(252): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgctttactgcacgaggactccgtggccttcgatgagctgattcacgcccaccctnagttcgtccgtcgtcccaggacagaccacgacccaccatccacctgccgtacgacaagaactaagtggaanataagaatgctgtcgtagtactaccgaggacgaccgacggcctacgtccccgtttagtttcggactacttaccttaacgaaaggtaacgtaaacggacgcccggtacctacgacggtacctcccgtacgtaccgtaacgtttcgacgtacctaccgtaacgtcgtaacggaacacgacgtacccacgtacgtacgaaccgtacgtcccggaacgggtccccgggtaacccaacgggtaaccccgaaaggggtacgtaccggggtaaacgggaaccttaaccgttaacgttacggttacgggtaccggtaagggttacgggtaacggtaaactaaacgttacgttaaggttttacggtagggttcggggttacgggacgggtacggacccggttaggtcccgtacgggtacccgtccgtaaggtcccgtaacgacccggtacggtccccgtaccccggtccccggttcgtaccctcccgttaccggtttaccccgtcccccgccttaacccgg

SEQ ID NO: 2772 - DNA, 974 bp, Homo sapiens
  misc_feature: GYAE6OF01ECYY9.26.21.B10.1.454.CMB.1.raw
tcagagactatactcacgaccggtgctcgatttagtgtcgtcgcaagagaggaggggggggcctcaggaagcagcatcggaggtgcctcagccatggcatggactccctctccttcctcggcgtccttgcttactgcacaggatccgtggtccttcgatgagcttgattcacgccctaccctcagttcggtcccgtcgtcccccaggacaaggaccacgcccaaccagtaccacccgtgcctcgggacaacgaactaaaggttgggaagtaaactaagtaaaattcggtaccttcggtcccgttaaggttaccttaaaccccgaaggaacggacccgaaccggtcccgtaaccgtttacccccgttttagttttccgggtaccttaacgtttaccgtttaacccggaaagtaaaacgtaaacggtaaccgggcccggtaccccgtaacggtacgggtacccttaccccgtaacgtaacccgtttaaccgtttcgtacggtccctaacccgtaacgtccggtaaccggaaacgaacccgacgtaaccccgacccgttacgtaacccgaacccgtaacgtcccgggaaacgggtcccccggggaaccccgaacggtaaccccggaaaccggggttaagtaaacggggaaacgggtaaccgtaaacccggttaaacgttttacggtaaacggttacccgggaaggggtaccgggtaaggttaacgttaaaccgttaacggtttaaggttaacggtttaacgggtcggggttttacgggaaaccggggttaccgggtaccgggtaagggttccccggtaacgggtacccccggtttacgggtaaccggtttcccggaaacccggtaccccgggaaacccggtcccggttaccccccgttaccccccggtaacccggttcccttaaaccccgtttccccgggttccccctttaccccccggtaacccccgtttacccgg

SEQ ID NO: 2773 - DNA, 571 bp, Homo sapiens
  misc_feature: GYAE6OF01AV1PH.26.21.B10.1.454.CMB.1.raw
  modified_base (305)..(305): a, c, t, g, unknown or other
  misc_feature (305)..(305): n is a, c, g, or t
  modified_base (353)..(353): a, c, t, g, unknown or other
  misc_feature (353)..(353): n is a, c, g, or t
  modified_base (407)..(407): a, c, t, g, unknown or other
  misc_feature (407)..(407): n is a, c, g, or t
tcagagactatactcacgaccggtgctcgatttagtgtcgtcgcaagaggagaggggcctcaggaagcagcatcggaggtgcctcagccatggcatggatccctctcgttcctcggcgtccttgcttactgcacaggatccgtggccttcgatgagctgattcagccaccctcagtgtccgtgtccccaggacagacagtccaccgatcacctgcctcggcagacaaattgggacgatagaaatgctgcctggtattaccagaggccaggccagtcccctatttggtcatcttcaagataagaancgcctcagggatccgtgaccgtaattcctggctccaacgtctggaacncgagccactctagaccatacagcgggcccaggccaaacggactaggacgggtanaaccgtaactattgcgaggcggtaggagaagtactaacgttagtacgtagtttggacgagggtaccaggctggaacccgtcgtaaggtccacggacccaacgggcctcggaccccccgttcggtaccctacgttcccgtacgttcccccgtacccgttaccccg

SEQ ID NO: 2774 - DNA, 761 bp, Homo sapiens
  misc_feature: GYAE6OF01CAJZV.26.21.B10.1.454.CMB.1.raw
  modified_base (168)..(168): a, c, t, g, unknown or other
  misc_feature (168)..(168): n is a, c, g, or t
  modified_base (236)..(236): a, c, t, g, unknown or other
  misc_feature (236)..(236): n is a, c, g, or t
  modified_base (445)..(445): a, c, t, g, unknown or other
  misc_feature (445)..(445): n is a, c, g, or t
tcagagactatactcacgaccggtgctcgatttagtgtcgtcgcaagagaggagggggggcctcaggaagcagcatcggaggtgcctcagccatggcatggactccctcttcttccgtcggcgtccttgcttactgcacaggatccgtgcgtcgtagtgtagcgtgtntactacgaccgaccctcctacgtcgttccgtccgtcccgacgacgaacgacgacgaccaccaactacncctacgtcgacgtcgacgaacgtaagtaggaaggataagaagtacgcgtacgtccgttaagtagttaacacggacggccgacgtaccgtaccgttaccccgttattttcggtatacgttactaccgaaaagtataacggaaacgcgtaccccgtaacgaggaccgtaccctacggtaaccgtactttacgtcgaccctcgtaaacccgnggtaacgggaaacaccgaacctaccgtactaccgtcggaaactccgacggaccgggaccggacccggaccgacgaacgtaggaggtaacggacggtaactacgttgtacgtacggtcggaacgggtagaagggtaacttaacgttagttaagggtttcggttaggttcggggtacggtaaccggacggtacggtcggttaaccctcgggttaaaccgtcgggtaaccgccggtaaccggtaaccggccgtcccggttaacccccggtcctacccgggttaccctcccgttaccgtcccccgttaacccccgttacg

SEQ ID NO: 2775 - DNA, 671 bp, Homo sapiens
  misc_feature: GYAE6OF01D3GAR.26.21.B10.1.454.CMB.1.raw
  modified_base (250)..(250): a, c, t, g, unknown or other
  misc_feature (250)..(250): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcacgcccaccctcagtcgtccgtcgtccccaggacacgacacgccaaccatccaccgtgcgtccggcaagaactaaagttggganaataagaatgctgtacgtaggtaactaccgaggacggccgacggaccctacgttacccctttagttttcggtactacttccgttaccgaaaggtacgtaacggacgtcccggaccctacggaacgggtaccttacccgtacgtaccgttaactttcgtaccgtacctacctaacgtcgtaacgggaaccacgacgtacctaactctacgacacgtcggacggccggaccgacgaccgaacgagacggaggacgtacgtacgtagtagtcgagggtcgtaggataatacgttgttaggttggttggttgggacggacggtacgacggtccgtcgtacccgtacgtacgtaccgaccgaccgtccggccgttcccgaccccgttcgtacccttaccgttcccgttcccgttccccgtaccccg

SEQ ID NO: 2776 - DNA, 742 bp, Homo sapiens
  misc_feature: GYAE6OF01CIQNA.26.21.B10.1.454.CMB.1.raw
tcagagactatactcacgaccggtgctcgatttagtgtcgtcgcaagagaggagggggggggcctcaggaagcagcatcggaggtcgcctcagcctatgcatggactccctctcttccgtcggccgttccttgcttactgcacaggactccgtcgccttgatcgagtctgtactcgacgccaccgtgtacggtccgtccgtcgtaccccaggacacgacaccgccaccatcctactcgctacggacaacgtaactaaggttacggaagtacgtaaggtaatcggacgtacgtaccgtaagtaacgttaaccgacggtacggtaccgacggtccctaacgttccccgtttaagtttcggactaaccttccgtaacggtaacgtaacgtaccgtaccggccggtacctaggacggtacctccgtaagtacgttacgttcgtacgtacctaacccgtaacgtcgtaaggaaccactacctaccgtaacttcaaccgcacggtcggacgggtccggaccgtacgaacggtaacgtacggtacgggacgtaacgtacgttacgtacgttaggaccggtaggtacggtagtaacgtaagttacgtttaggttagttagggttacggttcgggacgggtaacggtacgtacggccggtacggtaccgtacgtcggtaaccgccggtacccgtacgtcccggacccttccccgtagtcccgttacgttcctaccctccccgtcttaaccg

SEQ ID NO: 2777 - DNA, 864 bp, Homo sapiens
  misc_feature: GYAE6OF01BL9D6.26.21.B10.1.454.CMB.1.raw
  modified_base (134)..(134): a, c, t, g, unknown or other
  misc_feature (134)..(134): n is a, c, g, or t
  modified_base (139)..(139): a, c, t, g, unknown or other
  misc_feature (139)..(139): n is a, c, g, or t
  modified_base (275)..(275): a, c, t, g, unknown or other
  misc_feature (275)..(275): n is a, c, g, or t
tcagagactatactcacgaccggtgctcgatttagtgtcgtcgcaagaggagaggggggggcctcaggaagcagcatcggaggtcgcctcagccatggcatggactccctctcttcctcggcgtccttgcttangcagnggtattccgtggccttcgattggagtctgtattcacgcctacccgtcaggttcggtccgtcggtccccgaaggggccaggaccacgccctaccgtagtccaccgttgcctcggactaaggacaaaaggttgggaanataagaaatcgtctgaccgttaggtaactaccgaggccggtaccgacggtcccacggttcccctttaggttttcggacctacgtccgttacgaagtaagtaacggacggtccggtcctagggttacggaccttaccccgtaggttaaccgtaacgttttcgcggttacctacccgtaaactcgggtaaacggaaccacgtaccgcctaccgttacctacgaccctagtcccgaggtacccgggacctaaccggaccgtaaaccgggtacgtacggaacgggtaacgtaaaccgttacgttacgttaaggttaccggaacgggttaccgggtaagggtaacgttaaaccgttaacgtttaagggtttacggtttacgggtacggggttttaaccggggcggggttaacggggttaccggttacgggtaccggttaaccggggtaacccggttacgggttaaccgggggtaccgtaacggggtaccccggtaacggggtccccgttccccgggttacccccgttaccggttaacccccggtttacgttaccccggttttccccttaacccccgggtcccgtttaacccggg

SEQ ID NO: 2778 - DNA, 725 bp, Homo sapiens
  misc_feature: GYAE6OF01ER5VC.26.21.B10.1.454.CMB.1.raw
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagtctgattcagcccaccctcacgtgtccgtcgtacccccaggacagacacgcccaccatccgacctgcctcggacagaaactaaaggttgggaagtaataaggaaatgcgtcgtaccgtgttaaccttaccgaggacggacccgacgggcccacgtttaccccctttagtttcgacttactccttaccaagtagtaaacgaacgccgggtccctacggtaggtacctcccgtacgtacgtaactttcgtcggtacctacccgtaactcgtacgggaacctacgccgaccctaccttcgactaccgcgtccgacggcccggggtacccacgaccggaacggagtaggacggtctaaccgtattaacgttcgtcggaagggtccgggaaggtaacgtacgttaacgttgtttaagggtcggtttaggttcggggacgggtacgggaccgaggtaccgtcgggtaccgttacccggtaggtaccgtacggaaccccggtaggtcccgtacccggcccccggttcggtaccttaccccgttccgtttcccccggttccctccccgttaccg

SEQ ID NO: 2779 - DNA, 864 bp, Homo sapiens
  misc_feature: GYAE6OF01BWKNF.26.21.B10.1.454.CMB.1.raw
tcagagactatactcacgaccggtgctcgatttagtgtcgtcgcaagagaggagggggcctcaggaagcagcatcggaggtgcctcacgccatggcatggactccctctccttccgtcggcgtccttgtcttactgcacgaggacttccgtggtccttcggatgacgctgtacttcacgccctaccctcgaggttcgttcccgtccgtcccgaggacacgacacgaccaccactccaccgtcgtccgtcggaccgaacgtaacgtaaaggttgggaagtaacgtaaagtaacgtcggttaccgtcggtaccgttacggtaaccttaaccggaacggtaaccgggccgtacgggtaccccgtaccggtttacccccttttaggttttcggtaccgttacttacccggttaaccgaaaggtaacgtaacggtaaccgggcccgtacccgtaggacgggttactaccccggtagtacccgttaagtttccgtaccggtacttaccccgtaacggtaccgtacgggaaactaccgtaccgacccgttactacccggtacgaaccgtacgtaccggaccggggtaccccggacccgtaccggaaccggtaacggtagggtaacgggaaccgggtaactacccggtttaacgttcgtacgggaacggtacggggtagacggggtaaagtcgtttaacgtttaggtttacgggttagggttgggttaccggggaggggtaaccgtcggtacgggtcccgtacggtacccggttacgggtaccgacggtaccccgaccgggtaccgttcccgggtccctaccccggtacggtcccttaccggttcccttacccggttcccctacccgttacg

SEQ ID NO: 2780 - DNA, 875 bp, Homo sapiens
  misc_feature: GYAE6OF01DAPYE.26.21.B10.1.454.CMB.1.raw
  modified_base (181)..(181): a, c, t, g, unknown or other
  misc_feature (181)..(181): n is a, c, g, or t
tcagagactatactcacgaccggtgctcgatttagtgtcgtcgcaagagaggagggggggcctcaggaagcagcatcggaggtgcctcagccatggcatggactccctctcttcctcggcgtccttgcttactgcacaggactccgtggccttcgatgacgctagattcacgcccaccctnagtcgtccgtcgtccccaggaccagaccagcccacactccaccgtcgcgtccggacgaagaaccgtaaaggttaggggaataagtaaggtaaacgtggtccttacggtacccgttacggggtttaaacttaacccggaacggaccggggaccccgtaacgggtaccccgttaaccggtttacccccctttttaaggttttttcccgggtaacccttacgtttaccccgttttaacccgaaaaaggttaacgtttaaaacgaaaccgggtccccggccccctttaacgggaacgggttacccttacccccgttacggtaaacccttaagttttcccgtacggacccttaaccctaaccgttcgtaaacgggaaccaacgacccgtacctaccttacgtaccgacctaacgcgtaccgggcccgggtacccacggaacccggaaggtacgtaacggaacgggacctaagtaacgttgttaccggacggtacgggtaggtacgggaataactttaacgttagtttacgggttttacggtgggtttaccggggacggttaacgggtacccgacgggttaccgtaccggggtacccgtacggttggtaacccgccggtaccggaccggtaccgttccccggtacccccgtacggtaccgtttacccctccgtttccccggttcccccgacccgttcccg

SEQ ID NO: 2781 - DNA, 903 bp, Homo sapiens
  misc_feature: GYAE6OF01EAEH9.26.21.B10.1.454.CMB.1.raw
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgcccaccctcagtcgtccgtcgtccccaggacacgacacgccaccatccacctgcctcggcagaactaaagttgggaagaataagaaatgctcgtccgttaggtacttaaccgaggacggaccgacggccctaccgttcccctttagttttcggtctacttccttaccgaagtaataaacggaacggtccgtacccgtacgacgggtaccttaccccgtaggtaacccgttaatttccgtcggtaccctaccctaaccgttcggtacggaaccaccgacgaccctacctcgtacgaaccctacgtacccggacgggtacccggggaccccaacgggaacccgtaaacgggtacgtacggggaacgggtaacgtaaccgttaaccgtttacgtttacgggaccggtaaggggtaccgggttaacggggtaagttaaaccgttaacgttttaacggtttagggtttaacggggttttacggggttttaccgggggaaccggggtaaccgggggtaacccgtacgggggtacccgttaacccgggttaaccccggggttacccggttaaaccggggttacccggtaacccgggtaaccccccgggtaaacggggtcccccccgtttacccccgggtaccccccccggttttacccggggttaaccccctttacccccggttttacccccgggtttcccccccgggtttcccccccccggttccccccggttaaccccg

SEQ ID NO: 2782 - DNA, 734 bp, Homo sapiens
  misc_feature: GYAE6OF01BFLTX.26.21.B10.1.454.CMB.1.raw
  modified_base (179)..(179): a, c, t, g, unknown or other
  misc_feature (179)..(179): n is a, c, g, or t
  modified_base (517)..(517): a, c, t, g, unknown or other
  misc_feature (517)..(517): n is a, c, g, or t
tcagagactatactcacgaccggtgctcgatttagtgtcgtcgcaagagaggagggggggggcctcaggaagcagcatcggaggtgcctcagccatggcatggatccctctcttcctcggcgtccttgcttactgcacaggatccgtggccttcgatgagctgacttcagcccaccctnagtgtccgtcgcccaggacagacacgccacatccaccgtgcctcggacaacgaactaaggttgggaatataaggaaagtgccgtcgtacgttaggtaacttaaccgagtacggccgaacggcccctaccggttaccccctttagttttcgggtacctaacgttaccgttaaccgaaaggtaacgtaaacggaaccggcccggtaccccgttacgaacggggtacctacccggtaacggtacctagtttctcggtacctacctactcgtacggaacaccgacgaccctacgtctcgaactacgtacgacggccgggacccacggtaacccgaagggtanacgggaacggactaaccgtacttcgtggtacgacgggtacgacgggtaataatacggttagttaaggttagggttggttacgggtacgggaaccggtaggccgtaccgtaccgtaccgttaccgtacggtaccgtacggacccggtaagtccccgtacccgtcccccgtacggtccccttacggttacccccgtccgttcccccgtcccgttacccg

SEQ ID NO: 2783 - DNA, 667 bp, Homo sapiens
  misc_feature: GYAE6OF01CQVRF.26.21.B10.1.454.CMB.1.raw
  modified_base (187)..(187): a, c, t, g, unknown or other
  misc_feature (187)..(187): n is a, c, g, or t
  modified_base (236)..(236): a, c, t, g, unknown or other
  misc_feature (236)..(236): n is a, c, g, or t
  modified_base (240)..(240): a, c, t, g, unknown or other
  misc_feature (240)..(240): n is a, c, g, or t
  modified_base (265)..(265): a, c, t, g, unknown or other
  misc_feature (265)..(265): n is a, c, g, or t
  modified_base (564)..(564): a, c, t, g, unknown or other
  misc_feature (564)..(564): n is a, c, g, or t
  modified_base (646)..(646): a, c, t, g, unknown or other
  misc_feature (646)..(646): n is a, c, g, or t
tcagagactatactcacgaccggtgctcgatttagtgtcgtcgcaagaaggagggggctgggcctcaggaatcagcatcggaggtgcctcagccatggcatggactccctctcttccgtcggcgtccttgccttactgacacgaggtctccgtggtccttgatgagtctgattcacgccctaccctnagttcgtccgtccgtacccgaggaccagacacgccactactcacctgcncganaagacgtaagtggatataagaagtntcgtcgtacgtattaacgtacgaacggaccggcgaaccggtaccgtaccgtttacccgtttagttttcgcttaacgttaccttaacgaagtaacgtaacggaacgcccgtaccgtacgacggtaccttccgacgtaaccgttattaccgtactcgtaacctaaccttcggaacgaacgactaccgcctacgtacgtaccgactacgaccggacgggtccggaccacggaaccgtaggcgtaggaacggacttacgtactgtaccggtcgaggtggtaaagacgtaacgtacgtttaagnggttagtacggtgggacgtacggcgtacgtcgtacgtccgtgaacggacctagggacctacgcccgttacccgcgtactacnccgttcaccggttccctaccg

SEQ ID NO: 2784 - DNA, 622 bp, Homo sapiens
  misc_feature: GYAE6OF01D7SG0.26.21.B10.1.454.CMB.1.raw
  modified_base (239)..(239): a, c, t, g, unknown or other
  misc_feature (239)..(239): n is a, c, g, or t
  modified_base (390)..(390): a, c, t, g, unknown or other
  misc_feature (390)..(390): n is a, c, g, or t
  modified_base (400)..(400): a, c, t, g, unknown or other
  misc_feature (400)..(400): n is a, c, g, or t
  modified_base (432)..(432): a, c, t, g, unknown or other
  misc_feature (432)..(432): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagcttagattcacgccaccctcagtcgtccgtcgtccccaggacagaccagccaccatcacctgctcgcagacaagttgganatagaatgctgcctggtactaccagacgcacggcctacgtccccttagtttcgactacttctacaagataagacgtcgtacctagacggtactacccgtacgtaccgtactttcacgtcctactacgtcgtacggaacacacgacctactntacgactacncgacgggacccggacccgaagtccgaaacggngtacgggaagggtactacgttacgttattacggtacgtagggacggtggtaactacgttacgttagttagggttagttgggttacgggacgggacgggaccgtaggcgtccggaccttccggagtccgtacgaccgaggtcccaccggtccccgtacgtccgtacctcttacccgttccctccctacccg

SEQ ID NO: 2785 - DNA, 798 bp, Homo sapiens
  misc_feature: GYAE6OF01CR47I.26.21.B10.1.454.CMB.1.raw
  modified_base (578)..(578): a, c, t, g, unknown or other
  misc_feature (578)..(578): n is a, c, g, or t
  modified_base (603)..(603): a, c, t, g, unknown or other
  misc_feature (603)..(603): n is a, c, g, or t
tcagagactatactcacgaccggtgctcgatttagtgtcgtcgcaagagaggaggggggactcctgtcgcccacatggacacgctttgctccacgctcctgctgctgaccacttcccttcagtgggttcttcgtacccagtatctaccttaggaaaggtgttctcggtcctgcggtcgtgggtcggaaccgcccacggcaccggaccctcaccgcgtacgtacctcggcctcccttctacgtggtctttcctaccaccgttccaacccaacggtacctagggtacggttagaagttcggtccgggtccgtcggggtcccgtacggaaccccggggaccccggaacggtcccggtagggtcggtcggtcttggcctacctacttacggtttacgtggtacggtagtcctaccgtaaccggaacggtaccgggtaaactacgttcccgttctacggtagaacggtacctcgacctaaccacactaccgacgaacggacctaaccgtaccgtaaacgggtcccgtcttaaaccgtataacgacgtaccgatactagtaacgttccgtacggaacgtaaccncggactacaacttcgttacttacgngtaccacgtaacctaacgtccgtaaccggtggtaccggaaccttaaggaaaccgtaagttaaagaacgtttacggaaccgttacggtacggttacgggggttacggtaaacgggttttcgtttaaccgggtcccttaaaccccgttcccgtacccgggtaccccttaacccgtacccgacccggttaacccgggg

SEQ ID NO: 2786 - DNA, 848 bp, Homo sapiens
  misc_feature: GYAE6OF01DEH0M.26.21.B10.1.454.CMB.1.raw
  modified_base (163)..(163): a, c, t, g, unknown or other
  misc_feature (163)..(163): n is a, c, g, or t
  modified_base (218)..(218): a, c, t, g, unknown or other
  misc_feature (218)..(218): n is a, c, g, or t
  modified_base (225)..(225): a, c, t, g, unknown or other
  misc_feature (225)..(225): n is a, c, g, or t
tcagagactatactcacgaccggtgctcgatttagtgtcgtcgcaagagaggaggggggggcctcaggaagcagcatcggaggtgcctcagccatggcatggactccctcttcttccgtcggcgtccttgcttactgcacaggctccgtggtccttacgatgntctgactcacgccctacctcgagtcgtccgtccgtcccgagacacgcacgccacnctccacncgtacgcgacagaactaaggtggagtaataacgtaagtccgtacgtcgtacgttaacggttaacgtaccgaacgggaccggtacccgaacggtccccgttaccgtttaccccgttttaggtttccggtaccttaaccgtttaccgtaaaccgaaagtaacggtaaacggacccgtacccgtaccgtacgggacgtaccctaccgtacgtaacgttacgttcgtaccgacttaaccgacgttaccgaacggacctacgtaccgtacctacctcaacgactaccgtcgggaaccggtcccggaaccacgacggtacggacgtaagggaccggtataaccgtacgtcggtacggaaccgggtggttaccgggtaaggttaaacgttaactttacggttaggtttacggggttaacgggtttcgggtaaccggggtaacgggacggtaccggggtaggtaaccccgttaccggggtaccccttaccgggtaaggtaaaccccggtacccgggtaccccggtaccccggtcccgggttaaccccccggttcccccgggttccgttaacccccttcccggtttaacccccgttcccccgtaaacccccccggttcccgttaaaccccgg

SEQ ID NO: 2787 - DNA, 763 bp, Homo sapiens
  misc_feature: GYAE6OF01BZ9M0.26.21.B10.1.454.CMB.1.raw
  modified_base (259)..(259): a, c, t, g, unknown or other
  misc_feature (259)..(259): n is a, c, g, or t
  modified_base (434)..(434): a, c, t, g, unknown or other
  misc_feature (434)..(434): n is a, c, g, or t
tcagagactatactcacgaccggtgctcgatttagtgtcgtcgcaagagaggaggggggggcctcaggaagcagcatcggaggtgcctcagccatggcatggactccctctcttccgtcggctccttgcttactgcacaggtactccgtggccttcgatagaactgactcacgcccacctcagtcgtccgtcgtcccaggacacgacacgccaaccacgtccaccgtgcctacggacaacgaacgtaaaggttgggaanaagtaaagtaaacgtcgcgtacgtaccgttaggttaactacggacggacggccgacggcctacgttcccttagtttcggactacgtaccttaacgaagaacgtaacggacgtcccgaccgtacgacggtacctccgtacgtaacgtattccgacgtcctacgactcgacggaacncgacgccgtactcgtaacgaccgtacgtaccgacggggcccggacctaacggaccgtaacggaggtacgggaacgtacgtaactttacgtacgttacggacggacgggttacgggtaaggtaaactttaacggtaaccggtttaaggttcggggtttaacggtttcggggtacgggggaaccgggtaaccgggtaacggacccgggttacgtacccggtaacccgggttacgaccggtacccgaaccgggtaccgtaccggtccccggtaccccgtcccgtccgttaccgttccctcccggttaccccgttccccctcgttacttacgg

SEQ ID NO: 2788 - DNA, 677 bp, Homo sapiens
  misc_feature: GYAE6OF01DMC6T.26.21.B10.1.454.CMB.1.raw
  modified_base (189)..(189): a, c, t, g, unknown or other
  misc_feature (189)..(189): n is a, c, g, or t
  modified_base (214)..(214): a, c, t, g, unknown or other
  misc_feature (214)..(214): n is a, c, g, or t
  modified_base (221)..(221): a, c, t, g, unknown or other
  misc_feature (221)..(221): n is a, c, g, or t
  modified_base (252)..(252): a, c, t, g, unknown or other
  misc_feature (252)..(252): n is a, c, g, or t
tcagagactatactcacgaccggtgctcgatttagtgtcgtcgcaagagaggagggggctgggcctcaggaagcagcatcggaggtgcctcagccatggcatggactccctctcttcctcggcgtccttgcttactgacacaggatcccggtggtcccttgatggagctgattccgacgccctaccctnagtcgtccgtcgtccccgaggaccngacgacnccacatccactcgctcgcagactaagtgganataagaatgctcgtaccttaggtactacgagacggaccgacggccctacgttaccccgtttagttcggtctacttcccgttaaccaagaagttaacggaaccggtccggacccgttacggaacggtaccttacccgtacggtaccttaagttcgtaccgtaccctaccctaagtccggtaacggaactccgaacgccctacgtctaccgacctacgtacggccggaccggcccaacgacccgtacgagacggacggtatacttacgtgtcgaccggtgggtacggtaggtaagtaacgttacgtttatacgggttaggttcggtagggtcggagtccggaacgtcgccggtacgtaccgtaggacctaaccggccgaacgtccggaccctccccggttacaccgtcccttccgtacccgtccccc

SEQ ID NO: 2789 - DNA, 752 bp, Homo sapiens
  misc_feature: GYAE6OF01BQQ0O.26.21.B10.1.454.CMB.1.raw
  modified_base (136)..(136): a, c, t, g, unknown or other
  misc_feature (136)..(136): n is a, c, g, or t
  modified_base (742)..(742): a, c, t, g, unknown or other
  misc_feature (742)..(742): n is a, c, g, or t
tcagagactatactcacgaccggtgctcgatttagtgtcgtcgcaagagaggaggggggggcctcaggaagcagcatcggaggtgcctcagccatggcatggactccctctcttccctcggcgttccttgcttacngcacaggactccggtggccttcgatgagctgattcagcccaccctcagttcgtccgtcgtcccccaggaccagaccgacgcccaccaagtccacctgccgtcggacagaacgtaaagttggggagtaataagaaactgactcgtccgttaggttaactaccgaggtacggcccgaagggcccctacgttccccgtttaagttttcggtactacttcctaaccaagtaataacgaacggcccggtaccctagacgggacctcccgtaggaaccgttatttcgtcgacctaccaacgttcgtaacgggaactacgacgtccctacgtccgtacgaaccagtacccggaacggacccgggacccgacgtaacccgaaacgggacggttaacgggaacgggtaacggtaaccttacgttacggtttacgacggtacgggtaccggtagggaacgtaacgttacgttagtttagggttagtttcgggttacgggacgggtaccgggtacgcggtaccgtccggtaaccgtccggtacggtcgaccgaccgtaacggtcccgtaccggtacccccgttcggttaccccaccgttcccctcccgtttcccccnccgtaccccg

SEQ ID NO: 2790 - DNA, 704 bp, Homo sapiens
  misc_feature: GYAE6OF01B3WZ6.26.21.B10.1.454.CMB.1.raw
  modified_base (242)..(242): a, c, t, g, unknown or other
  misc_feature (242)..(242): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcacgccaccctcgagtcgtccgtcgtccccaggacagacacgccacatccactgctcggacagactaaagtgggaanataagaatgactgcgtaggtactacgagacggccaggcctacgttcccttagttttcggactacttaccttaccaaagtacgtaaacggacgcccgggtccctacggaacggtacctcccgtaaggtaccttactttcgacgtccctacctaacgtcggtaacggaacacgacgccctacgtctacggacctagtaccgacggcccgggacccacggaccgaacggtagacggaacgggtactactacgttacgtacggtacggacgggtacgggtaggtaacgtaacgttacgttaggtttaggttaggttgggtttacgggacgggtacgggtaaccgtggtaccgacggtacccggtaccgtaggtcccgtaacggcccggtacggcccgttccccgggtaccccgttccggtaccgttaccccttacccggttccccgttcccctaccccgttacccg

SEQ ID NO: 2791 - DNA, 890 bp, Homo sapiens
  misc_feature: GYAE6OF01CULG8.26.21.B10.1.454.CMB.1.raw
  modified_base (183)..(183): a, c, t, g, unknown or other
  misc_feature (183)..(183): n is a, c, g, or t
  modified_base (212)..(212): a, c, t, g, unknown or other
  misc_feature (212)..(212): n is a, c, g, or t
  modified_base (447)..(447): a, c, t, g, unknown or other
  misc_feature (447)..(447): n is a, c, g, or t
tcagagactatactcacgaccggtgctcgatttagtgtcgtcgcaagagaggaggggggggcctcaggaagcagcatcggagtgcctcagccatggcatggactccctctccttcctcggcgtccttgcttactgcacagtactcccgtggtccttcgatgagctgattcgacgccaaccctnacgtcgtccgttcgccccaggacagaccncgccacactacccacgtcgtcgcggacaagaaccgtaaggttgggaataataaggaaacttcgacgtcgtccgtacggttaactacggacgaccggtaccaaccggtcccgtaccgttccccgtttagttttccgacttactaccgttacaaggtaagtaacggaagcccgtacccgtagacgctacccgactaacggttacttcgacgtacctaccgtactccgacggtaaacnccgaacgtccctaataccctacgaaccctacgtcggaacccggtccccgggacccgtaacccgggaccggtaaacggacgggttacgggaacggtaaaccggtacctttaaccggttagggtttaccgtacgggacggttaccggggtaaaggttacggtaaaacgttttaccggttaaggtttacggggttttacgggtttaggggtttacggggacccgggggttaaccgtaccccggggtaagggttaccggttaaccccgggttaaccccggggttaccgttaaccgggggttaccccgaacccggggttaaccccgttaaccccgggttccgggaacccccccccggtttccccgggttacccccggtttaaaccggttcccccccggtttacgtttacccccccccggttcccccgttaaccccgtttaaccccggg

SEQ ID NO: 2792 - DNA, 882 bp, Homo sapiens
  misc_feature: GYAE6OF01B6ZJJ.26.21.B10.1.454.CMB.1.raw
  modified_base (184)..(184): a, c, t, g, unknown or other
  misc_feature (184)..(184): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgccttactgcacgaggacttccgtggccttcgatgagctagattcacgcccaccctanagtcgtcccgtcgtacccccgaaggaccagacccgacgtacccaaccgtactacccgtaccccgttagcccgttacccgggacaaaccgtaaaccgtaaaaggtttcgggggaataaaggtaaagaaacgttggtccgtacggtaccggttacggttaacttaacccggagggaaccgggcccgaacggacccccgtttaccggttacccccgttttaaggtttttcggtacctaccgtttacccttaaccggaaagtacgttaaaacggaaccggtcccggtaccccgtaggacgggtaccctaccccggtagtaacccgttactttcgacggtaccttaccgtaaccgtcggtacgggaaaccacgtaaccaccgtaacctcgtacccgaactacggtcggacccgggcccggtaccccgacgtaaccgacgggtaacggacggtaacggggactaacgttaccgttaacggttcgtaacgggacggtaggggtaacggtaagtaacctttaggttaacggttttaggtagggttagggtttaccggggaacggtacgggacccgtaggggttccgacccgggtaccggttcgtaaccgtaccggaccggtacccggaacggtccccgtaccggtacccccggtttcccgtacccgtccgttacccgttcccccgttaccccgtcccttaaaccgg

SEQ ID NO: 2793 - DNA, 749 bp, Homo sapiens
  misc_feature: GYAE6OF01D3FX7.26.21.B10.1.454.CMB.1.raw
  modified_base (481)..(481): a, c, t, g, unknown or other
  misc_feature (481)..(481): n is a, c, g, or t
tcagagactatactcacgaccggtgctcgatttagtgtcgtcgcaagaagagggggctgggcctcaggaagcagcatcggaggtgcctcagccatggcatgactccctctcttcctcggcgtccttgcttactgcacgaggactccgtcggtccttacgatgagtctgattcacgcccaccctgacgttcgtccgtcgtcccaggaccagacacgccaacctctcaccgtgcgtcgacaagaacgtaaggtgggaataagtaacgaaagtcgcgtccgtcgttacggttaacttaccgaggtaccggaccgacggaccgtaccgtttaccccgtttagttttcggccttaacttcctttaaccgaaagtacgtaaacgtacgcccggtaccttaggaccggtacctcccgtaacgtaaccgtacttcgtacgaccgttaccgtaacgttccggaacgaaaccgtcgacctacccgtacgtnaacccgtacgtctacccggacgggcccggtaccgaacgaccggaacggtacggacgggtaggaacttacggtaacttacggttcgaggtaggtcggtaaggaagtagttaacgttaggttaggtgtttacggggttggaccggtacggtacggacgtaccgtcggtacccggacgttacggtacccgacgtacccgggtaaccgtcccgttacccggacccccgtcgttaccccgtaccggttccccgttccgtccccccggtttccg

SEQ ID NO: 2794 - DNA, 735 bp, Homo sapiens
  misc_feature: GYAE6OF01CNECX.26.21.B10.1.454.CMB.1.raw
  modified_base (218)..(218): a, c, t, g, unknown or other
  misc_feature (218)..(218): n is a, c, g, or t
  modified_base (224)..(224): a, c, t, g, unknown or other
  misc_feature (224)..(224): n is a, c, g, or t
  modified_base (678)..(678): a, c, t, g, unknown or other
  misc_feature (678)..(678): n is a, c, g, or t
tcagagactatactcacgaccggtgctcgatttagtgtcgtcgcaagagaggagggggcctcaggaagcagcatcggaggtgcctcagccatggcatggatccctctcttcctcggcgtccttgcttactgcacaggatcgtggccttcgatgagctgattcacgcccaccctgagtcgtcccgtcgccccaaggaccaggacacgccacatccactnctcggnagacaaagtgggatagtaacgaaattgcgtacgtaccgtagggttaacttaacccgaacgaacggccccgtaaggggtacccctaccggttacccccctttaaggttttttcgggtaacccgtttattacccgtttaaccccggaaaagtaaagttaaacggtaaaccgggacccgtaccccgtacggtaacgggtaccctaccccgtacgtaacccgtaaagtttccgtagggtacctaacccgtaacgttacggtaccgggtaaaccaacgtaaccggaccctaacgtccgtacgaaccgtactcggaacggcccggggacccaagacccgaaacggacgtaggaagggaacagtaactagttcgacgacgcggtagacgttaagacttaagttgtagttggtcggtcggagggaccagggccttaagtccgtacgtacggcgtacgaccgnggtacccgaccgtcccctaggtccctaacttccttacccgtcccctacccgtacccg

SEQ ID NO: 2795 - DNA, 898 bp, Homo sapiens
  misc_feature: GYAE6OF01B8BOU.26.21.B10.1.454.CMB.1.raw
tcagagactatactcacgaccggtgctcgatttagtgtcgtcgcaagaagagggggctgggcctcaggaagcagcatcggaggtgcctcagccatggcatggatccctctccttcctcggcgtccttgcttactgcacgaggactccgtggtccctttcgagtcgagctgattcacgcccaccctctaggtcgtccgtccgtccccaggacacgacacgccaccactaccaccgtcgccgtacggacgagaacgtaaaggttagggaagtaagtaagaaagtgtacgtccgtaccgttaggttaccttaacgacgggacggcccgacgggtaccccgtaaccgttaccccgttttacggttttccggtaacttacttccgttaacctaaacggtaacgtaacgggtaaccggcccggtaccccgtacggaaccgggtccttaccccggtacgtaaccgttacgtttccgtcgtaccctaacctaccgtacgtaacggaaccacgacccgtaccgtacctaccgcgtaacccgtacgttaccggaacccggggaccccgggtaccccggacccgtaaccgggtaacgggaaaccgggtacggggtaaaccgggttaacccggtaacgtttaacggttaccgttaccgggttacggaacggggttaccgggtaagggaacggttaaacgttaccggtttaaggttacgggtttaggggtttacggggttgggtaaccggggtaacggggaccgggtcgggtccgttacccgggtaccggttacccggttaacgggaccgtacccgggaacccggtccggtccccgggttacccccggtccccccgggtttacttccccggttaccgtttccccggtttccccgtaccccccgttaccccg

SEQ ID NO: 2796 - DNA, 881 bp, Homo sapiens
  misc_feature: GYAE6OF01CKLUQ.26.21.B10.1.454.CMB.1.raw
  modified_base (137)..(137): a, c, t, g, unknown or other
  misc_feature (137)..(137): n is a, c, g, or t
  modified_base (163)..(163): a, c, t, g, unknown or other
  misc_feature (163)..(163): n is a, c, g, or t
tcagagactatactcacgaccggtgctcgatttagtgtcgtcgcaagagaggagggggctgggcctcaggaagcagcagtcggaggtgcctcagccagtggcagtggactccctctcttcctcggctcctgcttacngcacaggactccgtggccttgatganctagacttcacgcccaccctgagtcgtccgtcgacccgagacacgaccgacgacccacctactccgacccgtgaccgtacggaacaacggtaaacgtaaaaggttggggaaataagtaacgtaaagtcgacgttcggtaccgttaagggttaacttaacccgaggtaccggacgacggtaccctaccgtttaccccgtttaggtttccggtactacgttacccttaacgaaaggtaacgtaaacggacggtccccggtacctacgggacgggtttacctaccccgtaacggtaacccgtagtttacccgcgtccctaaacccggtaacgtccggaacggtaaccaccgaccgtacccctaatacccggtacgaaccctacgtacccggacgggtaccccgggaaccccgaacggaaccccgtaaacgggtacgtaagggaaccggtaccgttaacgttaacgtacggttacgacggacgggttaacggtagggtaaacgtacgttaacggttaggttacggttttacgggttacgggtttacgggaacggggtaaccgggtaaccggtacgggtacccgtaaaccgggttccccggttaacgggtaccgggttaacccgacccgggttaaccccggtaccggtacccccgtaccccgggttaccccgttacccggtacccggttaaccccgtttcccggttccccgttacccccccgg

SEQ ID NO: 2797 - DNA, 662 bp, Homo sapiens
  misc_feature: GYAE6OF01EVJ5O.26.21.B10.1.454.CMB.1.raw
  modified_base (179)..(179): a, c, t, g, unknown or other
  misc_feature (179)..(179): n is a, c, g, or t
  modified_base (251)..(251): a, c, t, g, unknown or other
  misc_feature (251)..(251): n is a, c, g, or t
  modified_base (403)..(403): a, c, t, g, unknown or other
  misc_feature (403)..(403): n is a, c, g, or t
  modified_base (470)..(470): a, c, t, g, unknown or other
  misc_feature (470)..(470): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccggtggccttgagtgagctgattcgacgccaccctnagttcgtcccgtcgtccccaggacagacgacgccaccatccacctgccgtcggacaagaacaagttgggaanagtaagaatgctcgccgtaggtaacttacgagacggccaggcccacgttacccctttagtttcggctagtccttaaccgaagtaactaaggacggccggaccctgaagggtctccgagtactacttcgcgctacgactcgtaggacacgacncctagtactcgacctagacgacgggccgacccgacgacgaacggagacggaacggactactacgttntacgtaggacggcggtaagggaactagttacgttagtttacggttacggttaggttcgggacgggacgggtacgacgggtacgtaccggtaccgtacggtacggtccgtaccggtacccggacggtaccctccccgggtcccgttaccggtaccttaccgtccccgtttccgtaccccccgtcttaccccgg

SEQ ID NO: 2798 - DNA, 876 bp, Homo sapiens
  misc_feature: GYAE6OF01DADRL.26.21.B10.1.454.CMB.1.raw
  modified_base (275)..(275): a, c, t, g, unknown or other
  misc_feature (275)..(275): n is a, c, g, or t
tcagagactatactcacgaccggtgctcgatttagtgtcgtcgcaagagaggagggggctgggcctcgaggaagcagcatcgggaggtgccctcagccagtggcagtggacttccctcttcttcctcggccgttccttgtcttactgcacaggctccggtggtccttcgagtgagtctgtactcacgccacccgtgtcgtcgtccgtcgtcccgaggacagacacgcccactacgtcacctcgacgtcgacgaagtacgtaaaggttaggggaanaagttaaggaaagttcggcctacggtaccggtttaggttacttaaaccgaggtaaccggcgaccggtaccgttaaccgtttccccctttaggtttttccggactaccttacgttaaccgaaagtaaggtaaacggaccggtaccggtcccgtacggaacgggtaccctacgtacggtaaaccgttactttaccggtaccggtaccctttaaccggaaccgttacggtacggaaaacccctaccgacgtaaccctaccggttacaccgttaaccgaccgtacgaccgggccgggacccgaacggaaccccggaaacggacgggtaacggtaacggtaaccgtaaaccgtttttaaccggtacgtttacgggttaccggaacggggtttacgggtaaggggtaaaccgtaagtttaacgggtcgttttaaggggttcggttaagggggttttccgggaacggggttaggtaacccgggtaacgttccggtaaccgggtaccctacggggtaaccttacccgggaaccgccccggtaaggtcccccggtaaccccgtcccccgtttacggacccttaacccgttccgacccccgtttacccccg

SEQ ID NO: 2799 - DNA, 778 bp, Homo sapiens
  misc_feature: GYAE6OF01C37NS.26.21.B10.1.454.CMB.1.raw
  modified_base (86)..(86): a, c, t, g, unknown or other
  misc_feature (86)..(86): n is a, c, g, or t
  modified_base (140)..(140): a, c, t, g, unknown or other
  misc_feature (140)..(140): n is a, c, g, or t
  modified_base (745)..(745): a, c, t, g, unknown or other
  misc_feature (745)..(745): n is a, c, g, or t
  modified_base (772)..(772): a, c, t, g, unknown or other
  misc_feature (772)..(772): n is a, c, g, or t
tcagagactatactcacgaccggtgctcgatttagtgtcgtcgcaagagaggaggggggggcctcaggaagcagcatcggaggtcncctcagccatggcagtggacttccctcttcttccgtcggcgttccttgcttacngcacgaggtacttccggtggtccttgatggactctgtatcacgcccaccctgtacgtcgtccgcgtccccgaggacacgacacgaccaccagtaccacgtcggaccgtacgaccgaaggtaaacgtaaagggttggggaaactaaaagttaagggaaaacttcggaccgtcggtaccggttacggttaaaccgttaaccgacggaccggaccgaccggaccctaccgttacccctttaggttttacggacttacctactaaaccgtaaagtaacgtaaacggacgacccggccgtacggacgggaccttaccgacgtaacgttaacgttcgtccgtactacccgtaacgtacgaacgaacctacgtacgacctacacgtaacacgtacgaccgggacgggacccggaaccgacggtaaccggaaggtaggtacgaaacgggtaactaacgttacgtagttcggaacggtcggtaagggtaagggaacttaaagttaacgtttaggtacgtttaaggtcgggttacgggaacgggtaggaccgtagggtacaccgtcgggtacctagggcccaacggccggtacggccctcccggtcccggttacnccggttaccttccgcccgtttaacccncgttcc

SEQ ID NO: 2800 - DNA, 804 bp, Homo sapiens
  misc_feature: GYAE6OF01A7FT0.26.21.B10.1.454.CMB.1.raw
  modified_base (331)..(331): a, c, t, g, unknown or other
  misc_feature (331)..(331): n is a, c, g, or t
tcagagactatactcacgaccggtgctcgatttagtgtcgtcgcaagagagggggggactcctgtgccccaccatggacacgctttgctccacgctcctgctgctgaccatcccttcatgggtcttgtcccagatcaccttgaaggagtctggtcctgcgctgggtggacgcccacgcacgacccctcacgctgacctgcctccgtctctggactttcctaccactccaccacgtactggaggtgaagtggtcggccgtgggtccgtcacggggacccccggaaaggccctagggacgtcggtcttcgcgtaaccttcctagttttaccgngggtacgtgtacttacgtacgtaacggtcggtaactaacgtcccttatccgtaggaaggtaactcggtaacctaccgaacctactacccgaaccggtaacgggacctaacccgtacccggaaaacgggtacccggggttccgttaacccgttaacgaacgttaaccggaaccgtaactacgtaacgtaacgttccgttacggtacgaaaccgtcaacgggacctaacgtaacttatttaccgtaggttacggaccctaaccgtaacgttacccgttacccgttaacgggaccccgggtacgttaaacccgggaaccgaaaaggtaaaaacggtactaaggtaaccggttaacgttaaggggtaccggggtaaacccgtaggggtttaaccgttttcgggaccccttaacccgggtcccctccccggtaaccctcccctaaaccccgggaaccgttacccgggggtaacccccc

SEQ ID NO: 2801 - DNA, 674 bp, Homo sapiens
  misc_feature: GYAE6OF01B0TBY.26.21.B10.1.454.CMB.1.raw
  modified_base (138)..(138): a, c, t, g, unknown or other
  misc_feature (138)..(138): n is a, c, g, or t
  modified_base (143)..(143): a, c, t, g, unknown or other
  misc_feature (143)..(143): n is a, c, g, or t
  modified_base (179)..(179): a, c, t, g, unknown or other
  misc_feature (179)..(179): n is a, c, g, or t
  modified_base (400)..(400): a, c, t, g, unknown or other
  misc_feature (400)..(400): n is a, c, g, or t
tcagagactatactcacgaccggtgctcgatttagtgtcgtcgcaagaggaggagggggggcctcaggaagcagcatcggaggtgcctcagccatggcatggactccctctcttcctcggcgtccttgcttactgacncaggntccgtggccttgatgagctgacttcagccacccgtnagtcgtccgtcgtccccgaggacagactacgccaccgatccacgtagtctcggactaagactaaagttgggatataagaattcgactcgactcgtaataccagaggaccaggcctacgtccctaagtttcgacattccgtacaagactacgaacggtcgacctagacggtactcctacgacgtaacttccgtagcctaacgaactcggtaacgaaaccganacgtcccctaaatcccgtagacacgtgaccgacggaccctaacgaccgaaacgggactcgggaaggactaacgtaacgttacgtcgacggtacgggtacgtagggtaacgtaaacgttacgtaagttacgtacggtttcggttacgggaccggttacgggaactggtaccgtaggttacccgtaccggtacggtacgaacggaccccgttaggcctaacccggtcccccgacggttacccaccggttacctttccggtccccgttcccgtaccc

SEQ ID NO: 2802 - DNA, 682 bp, Homo sapiens
  misc_feature: GYAE6OF01A6WN9.26.21.B10.1.454.CMB.1.raw
  modified_base (177)..(177): a, c, t, g, unknown or other
  misc_feature (177)..(177): n is a, c, g, or t
  modified_base (238)..(238): a, c, t, g, unknown or other
  misc_feature (238)..(238): n is a, c, g, or t
  modified_base (260)..(260): a, c, t, g, unknown or other
  misc_feature (260)..(260): n is a, c, g, or t
tcagagactatactcacgaccggtgctcgatttagtgtcgtcgcaagagaggagggggctgggcctcaggaagcagcatcggaggtgcctcagccatggcatggatccctctcttcctcggcgtccttgcttactgcacaggatccgtggccttcgatgagctgattcagccacctnagtgtccgtgtccccaggacacgacacgccaccatcacctgctcggcagacaagttggganatagaatgctgcctgtatacgngacgccaggccacgtccccgttatttcggtcgtactccttacaagtataacgaacgccggaccctcgagggtactccctagaaccgtactttcgtggcctaccaactcgtacggaacacgacgccactcgtacacctagtccgacgggccgggaccccacggaccccgaaagggacgtagggaacgggtaacgtacgttaaccgtgttacgggtacgacggggtacggtagggaataacgttacgttaggttaggttagggttcggtttaggggaccggggtacgggtaaccgtgggtaccggttaccggtacccgggttacgtaccggggtaccgacccgggaccccggtaagggtccccgtcccggtaccccccggttcggtaccctacccgtttcccggttccccggttacccccccgg

SEQ ID NO: 2803 - DNA, 898 bp, Homo sapiens
  misc_feature: GYAE6OF01DVTGR.26.21.B10.1.454.CMB.1.raw
tcagagactatactcacgaccggtgctcgatttagtgtcgtcgcaagagaggaggggggggcctcaggaagcagcatcggaggtgcctcagccatggcatggatccctctcttccgtcggcgtccttgcttactgcacaggatccgtggccttcgatgagctgattcacgcccacctcaggtcgtcccgtcgtccccaggacgagaccgacgccaccctagtacccacctcgccgtccggacaacgtaaaccgtaaaggttgggaaagtagttaaagaacgtagctacgtccgttaggttacttacccgaaggacgacccgacggaccctaccgttaccccgtttagttttcgtactaccgtttacctaaccgaagtaacgtaaacggaccggaccggtacccctacggaacgggtacccgtaccccttacggtaacccggttaacgtttccgtacggtacctaaccctaaccgttcgtaaccgggaacaccgtacgaccctaccgtcgtaacgaccctaacgtaccggtaccgggacccggggaccccgacggaaccccgaacggggtaacgtacggggaaacgggaacgttaacccgttaacgttaacggttcggtaaccggacggggttacggtaacgggtaacgttaaacgtttacggtttaagtttagggtttacggtttacggggtttaccggggtacggggtaccggggttaaccgggtacggggtacccgttaccgggttaaaccccggtttaccgggtaaccgggttacccggacccggggtaccccggaacccggttcccggtacccccgggtccccccggttaccgggtacccctttaccgtaccccggttttacccggttaccccccgtccccgtttaacccccgg

SEQ ID NO: 2804 - DNA, 609 bp, Homo sapiens
  misc_feature: GYAE6OF01AKL9L.26.21.B10.1.454.CMB.1.raw
  modified_base (412)..(412): a, c, t, g, unknown or other
  misc_feature (412)..(412): n is a, c, g, or t
  modified_base (463)..(463): a, c, t, g, unknown or other
  misc_feature (463)..(463): n is a, c, g, or t
  modified_base (505)..(505): a, c, t, g, unknown or other
  misc_feature (505)..(505): n is a, c, g, or t
  modified_base (523)..(523): a, c, t, g, unknown or other
  misc_feature (523)..(523): n is a, c, g, or t
  modified_base (557)..(557): a, c, t, g, unknown or other
  misc_feature (557)..(557): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggtatccgtggccttgatgagctgattcagcccaccctcaggttcgtccgtcgtccccaggaccagaccagcccaccgattccaccgtgcctcggcagactaaagttcgggaagtatagaatgacctgcctaggtacttaccgagacggccgagccgtacgttccccttagtttcggtctactcttacgaagataacgaacgccgtacccgtgtacgggtacttcccgtagaaccgttactttcgcggtacctaccgacgtacgtacgggaacncgaccgacctacgtctacgaccacgtcgacgggcccggactacgacgacgngagacggtatactagttagtcggacgcggtaggagagtactntgtagttagtggttacgnggacggtcgagtcctacggctacggtactaccgngcccgaaggcgtccccgtcccgtctccgtactccgtccgtccctcccgtacg

SEQ ID NO: 2805 - DNA, 897 bp, Homo sapiens
  misc_feature: GYAE6OF01D91C0.26.21.B10.1.454.CMB.1.raw
tcagagactatactcacgaccggtgctcgatttagtgtcgtcgcaagagaggaggggggggcctcaggaagcagcatcggaggtgcctcagccatggcatggactccctctcttcctcggcgtccttgcttactgcacaggatccgtggtccttcgatgagctgattcacgccctaccctcacgttcgtccgtcgtccccaggacagacacgacccacactccacctgccgtcgacacgaactaaggttgggaagtaataagaaactcgacgtcgaccgttacggtaacttaccgaggacggacccgacggtaccctaccgttacccccgtttagtttttcggaccttaaccgttcccgtttaaccgaaaaggtaacgtaaaggaaccggccccgggtccctaacggacgggtaccttaccccgtaggtaacccgttaagttttcccgaacggttcctaacccgtaaccgttcgtaacgggaaacctaccgaacgtacccctacgttccgtaaccgtaaccgaccgtaccggaccgggaccccggggtacccaaccgggacccggtaaaacccgggttaggaacgggtaacgggaaaccgtttaaacccgttacgttttacggtacgggtaccggtaaccgggggttggtaacgggtaaacgtttaaccgtacgttttaacggtttcgggttaacggggtttcggggttaacggggacggggttaaccgggaccggttacgggtaccgttacccggaacccggtttcggaaaccgggtttaccggaaccccgtaacccggacgggttacccccgtcccggttacccccccggttacggttaccccgtcccggtttacccgttccccccggtttaccccctacccccggtttaacccg

SEQ ID NO: 2806 - DNA, 827 bp, Homo sapiens
  misc_feature: GYAE6OF01DSHD0.26.21.B10.1.454.CMB.1.raw
tcagagactatactcacgaccggtgctcgatttagtgtcgtcgcaagagaggagggggctgggcctcaggaagcagcatcggaggtgcctcagccatggcatggatccctctcttcctcggcgtccttgcttactgcacaggactccggtggtccttcgagtgagctgattcacgccctaccctcagtcgtccgtacgtccccaggaccagacacgcccaacatccacctgcctcggcagactaagtggataatagaatgctgtccgtagtactacgagtacgccgacggtaccctacgttaccccgtttagtttcggtactaccgttaccgttaccgaaaagtacgttaaacggaacgtaccccggtacccctacggaaacgggtaccctcccggttaacggtaacccggtttaattttcccggtacggtaaccctttaacccgaacggtttccggtaaacgggaaaccctaccgaaacggtacccctaaccgttccgtaaacgtaccctaacggtacccggaacgggaccccggggtaaccccaagggtaaacccccgtaggggtaacgtagggaacgggaaccttaaccgttaacgtaagtttccgggaaccgggtaaggttaccggggtaagtaaacgttaacgttaccgttagtttaacgggttcgggttacgggtttccggaaccggggtaggtaacccggtacgggtaacgttaccgggtaaccccggtttaccggtacggtaccgaaccggttacccgggaaccggtctacccccgggtacccgtaccggtactcccgttcccgtcccgttaacccccg

SEQ ID NO: 2807 - DNA, 825 bp, Homo sapiens
  misc_feature: GYAE6OF01BH9X8.26.21.B10.1.454.CMB.1.raw
  modified_base (710)..(710): a, c, t, g, unknown or other
  misc_feature (710)..(710): n is a, c, g, or t
  modified_base (789)..(789): a, c, t, g, unknown or other
  misc_feature (789)..(789): n is a, c, g, or t
tcagagactatactcacgaccggtgctcgatttagtgtcgtcgcaagagaggaggggggactcctgtcgccccaccatggacacgctttgctccacgctcctgctgctgacctactcccttcagtgggtcttcggtcccagtatctaccgttaggaaggagttctcggtcctgcgtcgtggtggacgcccgacgccacgacccctcacgctcgacctcgtccttccgtcttcgtgtacttctccacctaccaccacggacgtggaggtagtacgtcggtcggtccggttcgggtcccggtaccggaccgggaaccccgggaacggtccggtaggtcggtcggtcgttccgactaccttacgtaacgtttacgtggtacgtgtactcgtacgtacggtacgtaacgtaccgtccgttcgtacggtaggaacgtaacgtaccgtacctacctacgtaactaaccgaaccggtaaccggaaaccgtaacccggtaaaccggtaaaccgggtaccggggtttaaccgttaaacccgttaaacgtaaacggttacccggaaacctaaacggttacgtaaccgttaccggtttaacgggaacggtaaccggtaaaccacgggtaacctaacgtaaaccgtttaacgtttacgttacgtaccgtacgacctaacgacgtaaccgtacgtaccggacgtaacgaacgaacgggtaaanaattaacgtacgtacgggtaaggtcgggtacggtaagggtttaacttacgggttacccgtacccgtaacccggtacccncccgtaaccggacccctacggaacccgggtacccgg

SEQ ID NO: 2808 - DNA, 745 bp, Homo sapiens
  misc_feature: GYAE6OF01BV45A.26.21.B10.1.454.CMB.1.raw
  modified_base (182)..(182): a, c, t, g, unknown or other
  misc_feature (182)..(182): n is a, c, g, or t
  modified_base (250)..(250): a, c, t, g, unknown or other
  misc_feature (250)..(250): n is a, c, g, or t
  modified_base (578)..(578): a, c, t, g, unknown or other
  misc_feature (578)..(578): n is a, c, g, or t
tcagagactatactcacgaccggtgctcgatttagtgtcgtcgcaagagaggaggggggggcctcaggaagcagcatcggaggtgcctcagccagtggcatggactccctctcttccgtcggcgtccttgcttactgcacaggatccggtggccttcgatgagctgattcacgccacccgtnagttcgtccgtcgtccccgaggacagacacgccaccatccacctgctcggacagaactaagtgggaanataaggaactgcgtacgtccgtaggttaacttaccgaggacggacccgacgggtccctaccgttaccccgtttaagttttcgggtacctacgtttaccttaccgtaaaagtaacgtaaacggaacggtcccggtaccccgtacggacggtacccgtaccccgttaggtaacccgttaacgttcccgtaggtaccctaaccgaacgttccgtacggaaccacaccgtaccacgttccgtacgacacgtacgaccgggacccgggaccacgaaccgtaacggagtacgggaacggaacgtactacgtacgtacggtaccgagggtacggngggaacgtaatacgttagttggtacgttgggttcgggtaacgggaggtacccgaggtccgtacggacccggttaccggacggtacccggccgaccgtaacggtccgaccccggtcccgttaccggtaccctaccgtcccgttacccgtcccccgtaaccccgttccg

SEQ ID NO: 2809 - DNA, 821 bp, Homo sapiens
  misc_feature: GYAE6OF01BYR0J.26.21.B10.1.454.CMB.1.raw
tcagagactatactcacgaccggtgctcgatttagtgtcgtcgcaagagaggaggggggggcctcaggaagcagcatcggaggtgcctcagccatggcatggactccctctcttcctcggcgtcctgtcttactgcacaggactccgtcggccttcgatgagtctgtactcacgcccacctctagtcgtccgtcgtacccgaggacacgacacgacccactactccacgtcgcgtacgacaagtaacgtaaggttagggaaagtaagtaaagtaatcggtacgttcggtaccggttaggttaacctaccggaacggacgacccgacggacccttaccgttacccctttaggtttccgacttaccgttacctaacgaaagtaacgtaaacggaccggcccgtacctacggaacggtacctaccgtaacgtaccgttaacttcggaccgtacctaccgtaacgtcggtacgaaaccacgactacctactactaccgacctacgaccggaccgggacccggaccaaccggaaccggtaacggacggtaagggaaccggtaacttaacgtaccgtttaggtacggtaccggtaagggtaccggtaagggtaacttaacggttaaacgttttcggtaaggggtttcggtttagggggttaccggggaacccggggtaacgggtaaccgtaccggggtaccgttaaccgggtacccggtacggtacccggacccggtacccggaacccggtacgggcccccttaacccccgggcccggttaccgtacccggtccctttaccggtcccccgtcccgttacccgttacg

SEQ ID NO: 2810 - DNA, 823 bp, Homo sapiens
  misc_feature: GYAE6OF01BSZB1.26.21.B10.1.454.CMB.1.raw
  modified_base (180)..(180): a, c, t, g, unknown or other
  misc_feature (180)..(180): n is a, c, g, or t
tcagagactatactcacgaccggtgctcgatttagtgtcgtcgcaagagaggaggggggggcctcaggaagcagcatcggaggtgcctcagccatggcatggactccctctcttccgtcggccgtccttgcttactgcacgaggatccggtcggtccttcgagtgagctagtactcgacncccaccctcaggttcgtccgtccgtaccccgaggacaggaccacgcccacctactaccaccgtcgcgtacggaccgaagaaactaaaggttgggaaagtaataaacggaaattcgtacgttacgtccgttacggttaacgttaaccgaacggaccggaccggaccgggtaccctaccggtttacccctttaacggttttccgtaccttacgtacctttaccgaaacggtaagtaaacggaccgtacccggtacccgacggtacgggtaaccttaccggacgtaacccgttagttttcccgacggtaccctacccgtaacggttaccgggaacggtaaccaacgtacccgaccttaccgtaccgtacaccgtacgtccgaccgggcccgggacccgacgaccggaaacgtaggacggtaacggacgtaacttaacgtacgtcgtacggagggtacggtaagggggtaactaacgttagttacggtttaggttacggggttaggttaggggtaaccgggtacggaccggaggtccgtacgggacgtaccggtacggtaccgaccggtaccggaccggtcccgtcccccggttaccgtcccggttacccgtcccgtacccgttaccccgttccctcccgttacccg

SEQ ID NO: 2811 - DNA, 763 bp, Homo sapiens
  misc_feature: GYAE6OF01B2ZPJ.26.21.B10.1.454.CMB.1.raw
  modified_base (119)..(119): a, c, t, g, unknown or other
  misc_feature (119)..(119): n is a, c, g, or t
  modified_base (179)..(179): a, c, t, g, unknown or other
  misc_feature (179)..(179): n is a, c, g, or t
  modified_base (217)..(217): a, c, t, g, unknown or other
  misc_feature (217)..(217): n is a, c, g, or t
  modified_base (624)..(624): a, c, t, g, unknown or other
  misc_feature (624)..(624): n is a, c, g, or t
tcagagactatactcacgaccggtgctcgatttagtgtcgtcgcaagagaggaggggggactcctgtcgcccacatggacacgtctttgctccacgctcctgctgctgaccatcccttnagtgggtcttcgtccagtactcacgttaggaaggcgttctggtcctgcgcgtgggtgacnccacgcacgaccctcacgctcgacctcgtccttccgtntcgtaggtactttcactaccaccgaacaccggtactagggtaggttacgaacggttggtcggggtccgttccggggtacccgaccggaacccggggtaacccccgggaaaggtcccggtagggtcgggtcggtcctttacggacctaacttacgtttaacgtttacggtggtacggtcttactcggtaacgaacggttaccgtaacctacgtttccgtacggtacgtaacgggaacggtacgtactaacctacgaacctacgacccgaacggtaaccggtacctaaccgtaaaccgggaaaccgggttccggttacgttaacctaacgaagtcgaaccgtagtactacgtaacttccgtaggtaaccgacgagacgacttaatagttactacgtgtcaacgttaacncgtacggtacctaggaccgtaaccaagaaggtaaacgaagttaacgtaacgtaggtaacggtgggttacggtacgggttaagtttcggttacctaccgcccgtaccttacccgacgtaccctacccggacgttaacccg

SEQ ID NO: 2812 - DNA, 715 bp, Homo sapiens
  misc_feature: GYAE6OF01EBSWY.26.21.B10.1.454.CMB.1.raw
  modified_base (176)..(176): a, c, t, g, unknown or other
  misc_feature (176)..(176): n is a, c, g, or t
  modified_base (238)..(238): a, c, t, g, unknown or other
  misc_feature (238)..(238): n is a, c, g, or t
  modified_base (245)..(245): a, c, t, g, unknown or other
  misc_feature (245)..(245): n is a, c, g, or t
tcagagactatactcacgaccggtgctcgatttagtgtcgtcgcaagagaggagggggggcctcaggaagcagcatcggaggtgcctcagccatggcatggatccctctcttcctcggcgtccttgcttactgcacaggatccgtgccttcgatgagctgacttcacgcccacctnagtcgtccgtcgtccccaggcagacacgccacatcacctgcctggacagaactaagttgganatagaangctgccttgtactacgagacgccacgcctacgtcccttagtttcggtctacttccgtttaaccaaggtaactaaacggacggccgtacccctagaacgggtctcccgtacggtaaccgttattccgtacggtcctacccgtaacgttcgtaacgggaacctaaccgacgaccctacgtctaaccgaacctacgtacccggtacggacccgggtacccgaccggtaccgaacgggtacggtacgggaacggtaacgtaaccttaacgttacgtttacgtacggacgggttacgggtaacgggtaacgtaaacgtttacgttaacgtttaggttacgggttcgggtttacgggtacgggtacgggtaccgtacggtcgtaccggtaccgttaccgtacgaccgtaccgaccgtacggtcccgtcccgtccccgtacggtccaaccgttccgtcccgtcccgtcccgttaccg

SEQ ID NO: 2813 - DNA, 752 bp, Homo sapiens
  misc_feature: GYAE6OF01CV6SY.26.21.B10.1.454.CMB.1.raw
  modified_base (136)..(136): a, c, t, g, unknown or other
  misc_feature (136)..(136): n is a, c, g, or t
  modified_base (169)..(169): a, c, t, g, unknown or other
  misc_feature (169)..(169): n is a, c, g, or t
  modified_base (653)..(653): a, c, t, g, unknown or other
  misc_feature (653)..(653): n is a, c, g, or t
  modified_base (713)..(713): a, c, t, g, unknown or other
  misc_feature (713)..(713): n is a, c, g, or t
tcagagactatactcacgaccggtgctcgatttagtgtcgtcgcaagagaggagggggctgggcctcaggaagcagcagtccggaggtgcctcagccatggcatggactccctctctctcggcgtcctagcttacngacacgaggactccggtggccttacgagtgganctaggtacttcacgccccaaccctgtacgtcgtcccgtcgtaccccgaggaccagacacgccctacgactccaccgtcgcgtcggacctaaggacctaaaggtggggaataagtaaagtaactcgtacgtcgtaccggttagtaacctaacgacggaccggtacccgacggtccccgtaaccgtttacccgttttagtttccggtaaccttaccttaccggtaacctaaaggtaaacgtaaacggacccgggtacccggtaccccgtagggaaaccggttccctaacccggtacgtaaccgtttagttaccgtccgggtaaccctaccgtacgttaccggaacgtaaccaccgaccgtcctacgctaacgcctacgaccgggcgacccgggtaacccaacggacgtaggtgaaacgggagtacctaagtacgtacgtgggacggacggtaggataacgtaagttcgtagttgggtggttacggngggaaggtcgacggttacgacggttccgccgtaaggaccggaccacgggacgcccgtaancccccggtaggtactccgtacctcccgtaccctaccccg

SEQ ID NO: 2814 - DNA, 534 bp, Homo sapiens
  misc_feature: GYAE6OF02G5CLX.26.21.B10.1.454.CMB.1.raw
  modified_base (436)..(436): a, c, t, g, unknown or other
  misc_feature (436)..(436): n is a, c, g, or t
tcagagactatactcacgaccggtgctcgatttagtgtcgtcgcaagaggtaggagggggcctcaggaagcagcatcggaggtgcctcagccatggcatcggatccctctcttcctcggcgtccttgcttactgcacaggatccgtggccttcgatgagctgattcagccaccctcagtgtccgtgtccccaggacagacagccaccagtcacctgctcggcagacaaattcgggagatagaaatgctagcctggtattaccagaggccaggccagtcccctattttcggcgaattcttccaagactaagaagcggcctcagggatccctgaccgaatttctggctccaacgtctgggaacacgagccactctgaccatcgagcggggcccagcccaacggatcgagggacgactactattcgtcaggcgtggganaatactattgtagtgtttggcggtaggacaggctgaccgtcctaggtcagcccaaggcctcgccccgtcggtccactccgtacgttcccgcccttccg

SEQ ID NO: 2815 - DNA, 330 bp, Homo sapiens
  misc_feature: GYAE6OF02IJCAV.26.21.B10.1.454.CMB.1.raw
  modified_base (308)..(330): a, c, t, g, unknown or other
  misc_feature (308)..(330): n is a, c, g, or t
tcagagactatactcacgaccggtgctcgatttagtgtcgtcgcaagaggagtagggggccctcagggatccctggaccgaatttctggctccaactctagggaacacagccactcttgacccatcagcggggcccagccaacggatgaggggagactacctattgtcaggcgtgggagaatacgtattggtacgtgtttggcggagggaccaggctgaccgtctaggtcagccaaggctgcccctggtcactcctgttcccacctctcagtatagtctctgagcgggctggcaaggcgccagtaggnnnnnnnnnnnnnnnnnnnnnnn

SEQ ID NO: 2816 - DNA, 516 bp, Homo sapiens
  misc_feature: GYAE6OF02IXXLM.26.21.B10.1.454.CMB.1.raw
  modified_base (236)..(236): a, c, t, g, unknown or other
  misc_feature (236)..(236): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtcccccaggacagacagccaccatcacctgctcggcagacaaattggganatagaaatgctgcctggtattaccagaggccaggccagtccctatttggtcatcttcaagataagagcggccctcagggatccctgaccgaatttctggctccaactctgggaacacagccactctgaccatcagcgggcccagccaacggatgagggagactactattgtcaggcgtgggagaatactattgtagtgtttggcggtagggaccgaggcgtgaccgtctacggtcgacgcccgaaggctcgcccctcggtccactctcgttcccaccccg

SEQ ID NO: 2817 - DNA, 811 bp, Homo sapiens
  misc_feature: GYAE6OF02F4FM2.26.21.B10.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagaggaggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccacatccacctgctcggcagacaaattgganatagaaatgctgcctggtattaccagacggccgaggcctacgtccccttaagttttcggtctattccttaccgaaaggtaacttaaacggaaacggtccgggtaccccgtcgtaacggggtaaccttaccccgtacggtaaaccccgtaacttttacccgtagggtaccctacccgtaaaccgttaccgtacggggaaaacctaccgtacggaccctaaccttccgtaccgaccctaatcccgaacgggtcccggggtaccccacggtacccgaaaaccgggacgttacgggaacggggaaccgtaaccgtttaacgtacgtttacggttaccggacggggtacgggtacgggggaactaaacgttaaccgtttaaagtttcgggttaagggtttcggtttacggggacgggtaacgggaaccgtacggggtaccgttaccgggtaaccccggttacccggtttaacgggtaccgtaacccggtaaccccggtaacgggtacccgttacccgggttacccccccggttaccggttacccccgaccggtttacccggttccccggtttaccccccgg

SEQ ID NO: 2818 - DNA, 723 bp, Homo sapiens
  misc_feature: GYAE6OF02JHXEX.26.21.B10.1.454.CMB.1.raw
tcagagactatactcacgaccggtgctcgatttagtgtcgtcgcaagagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaattgggagatagaaatgctgcctggtattaccagaggccaggccacgtcccctattttcggtcatcttaccaagactaagaacgcggccctacgagggtactccctgaccgtaattctcggctaccaactcgtagggaacacacgccacctctacgacccatccgacggcccggggacccacggacccgaaaccgggtagtacgggaacggggaacgtaaccgttaaccgttacgtttacggtaccggtacgggtacgggtaggggtaacgtaaacgtaaccgtttaacggtttaggttaacgggtttacgggttttaggggaccggggtaacggggtacccgtaacgggtaccgtacgggtaacccggttacccgttacggggtaccgtacgggtaaccccggtaagggtcccgtaccccggtacccccggttcccgggttacccaccccggtttccgttacccggtttaccccccgtaccccgttccccgttaacccg

SEQ ID NO: 2819 - DNA, 513 bp, Homo sapiens
  misc_feature: GYAE6OF02F1BXV.26.21.B10.1.454.CMB.1.raw
  modified_base (302)..(302): a, c, t, g, unknown or other
  misc_feature (302)..(302): n is a, c, g, or t
  modified_base (317)..(317): a, c, t, g, unknown or other
  misc_feature (317)..(317): n is a, c, g, or t
  modified_base (431)..(431): a, c, t, g, unknown or other
  misc_feature (431)..(431): n is a, c, g, or t
  modified_base (501)..(501): a, c, t, g, unknown or other
  misc_feature (501)..(501): n is a, c, g, or t
  modified_base (508)..(508): a, c, t, g, unknown or other
  misc_feature (508)..(508): n is a, c, g, or t
tcagagactatactcacgaccggtgctcgatttagtgtcgtcgcaagaggagaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggctagacaaattgggagatagaaatgctggcctggtattaccgagaggccaggccagtcccctatttggtcatcttccaagtntaagaagcggccctnagggactcctgaccgaatttctggctcaactctacggaacacagccactctacgaccagtcagtcgggcccagccaacggatgagggagactactagttgtacaggcgtagganagtactatgtagtggttggcggtaggccaggctgaccgtcaggtcagccaaggctcgccctcgtcactcncgtcccncctcc

SEQ ID NO: 2820 - DNA, 603 bp, Homo sapiens
  misc_feature: GYAE6OF02GYRQZ.26.21.B10.1.454.CMB.1.raw
  modified_base (236)..(236): a, c, t, g, unknown or other
  misc_feature (236)..(236): n is a, c, g, or t
  modified_base (425)..(425): a, c, t, g, unknown or other
  misc_feature (425)..(425): n is a, c, g, or t
  modified_base (493)..(493): a, c, t, g, unknown or other
  misc_feature (493)..(493): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggaccagacagccaccatcacctgctcggcagacaaagttgganatagaaatgctgcctggtattaccagaggccaggccagtccccttatttggtcattctccaagataagaagcggcctcgacgggactccctagaccgtaatttcgtggcctaccaactcgtaggaaccacgacgcccaactctacgaccatcgacggccgggacccagacccaacggatggaacggganacctagtattcgacgaggtcggtaggaagattacgtagttagtaggtttgttggacggtagggaccgnggtacgtcggaccgttccgtacggtccgaacggtcccaaacgggtccctaccggtcccccgtacggtaccctaccgttcccgttcccggttacccccgtcccttaccccg

SEQ ID NO: 2821 - DNA, 532 bp, Homo sapiens
  misc_feature: GYAE6OF02IXUKY.26.21.B10.1.454.CMB.1.raw
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattgggagatagaaatgctgcctggtattaccagaggccaggccagtcccctatttggtcatcttccaagataagaagcggccctcgagggatccctgaccgtaatttctggctccaactctggaacacagccactctacgaccatcacgccgggacccacgccgaacggatggagggacgactactagtgtcgaggcgtgggagaagtactagttgtagtgttggcggagggaccaggcgtgacgtcgtaggtcacgccgaaggcgtacgccccgtcggtcctacgtcctcgttccccgtcccg

SEQ ID NO: 2822 - DNA, 790 bp, Homo sapiens
  misc_feature: GYAE6OF02H1HJC.26.21.B10.1.454.CMB.1.raw
tcagagactatactcacgaccggtgctcgatttagtgtcgtcgcaagagagacggggactgggcctcaggaagcagcactcggaggtgcctcagccatggcatggatcctctcttcctcggcgtcttgcttactgcacaggatccgtggccttcgatgagctgattcagccaccgtcagtgtccgtgtaccccaggacagacagccaccatcacctgctcggcagacaaagttgggagatagaaaagtgcgtgccgtggtacttacctagaggcctaggccagtccccgtattttcggcctatctttaccaagacttaaaggaacgtcggacccgtcgtacggggactcccttaggaacccgtaagttttcctagggtaccttaccgaaactcgttacggggaactaactaacggtaacctaccgtacgtacggtaaccctaagttacgaaacgggcccggggggtaaccccaacggtacccgaaaaccgggaacttaccgggaaggggtaacggtaaccgttaaacgttaaacgtttcggttacccgtaaggggtacggtacggggtaacgtaaaccgttaacgtttaacgtttaggttaaacggtttcgggtttttacggccggggttaacggggaaccgtaacgggtaccgttacgggtaacccggtttcccgtaacgggttaccggtaaccggtaccccggtaaaccggtcccggttaacccggtaccccccggtaccgggtttacccgtaacccgtttcccgttcccggttttaacccccccggg

SEQ ID NO: 2823 - DNA, 567 bp, Homo sapiens
  misc_feature: GYAE6OF02F4MJH.26.21.B10.1.454.CMB.1.raw
  modified_base (232)..(232): a, c, t, g, unknown or other
  misc_feature (232)..(232): n is a, c, g, or t
  modified_base (305)..(305): a, c, t, g, unknown or other
  misc_feature (305)..(305): n is a, c, g, or t
  modified_base (389)..(389): a, c, t, g, unknown or other
  misc_feature (389)..(389): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcactgctcgcagacaattggganatagaaatgactgcctggtacttaccagaggccaggccacgtccctatttgcatctacagataagagcgcctnacggactcctgacctattctggcctctaactcgtaggaacacgacgccactctacgaccatcaggccggaccacgccgaacggntacggaggagtacctacttagtcgtacgaggtcgtagggataagttacctagtttgtacggttggtttagggacggtaacgggaccgaggtcgtacgtacccgtcgtacggtcacggacccgaaggccgtacgtcccccgttacggtcctaccgttccgttaccgttcccgtcccccg

SEQ ID NO: 2824 - DNA, 311 bp, Homo sapiens
  misc_feature: GYAE6OF02IKBR4.26.21.B10.1.454.CMB.1.raw
  modified_base (277)..(277): a, c, t, g, unknown or other
  misc_feature (277)..(277): n is a, c, g, or t
  modified_base (303)..(311): a, c, t, g, unknown or other
  misc_feature (303)..(311): n is a, c, g, or t
tcagagactatactcacgaccggtgctcgatttagtgtcgtcgcaagaggaggagggggccctcagggatccctcgaccgaatttctggctccaactctgggaacacagccactctgaccatcagcgggcccagccaacggatgagggagactactattgtcaggcgtgggagaatactattgtagtgtttggcggagggaccaggctgaccgtcctaggtcagcccaaggctgccccctggtcactctcgttccccaccctcctcagtatagtctntggagcgggctggcaaggcgcatagnnnnnnnnn

SEQ ID NO: 2825 - DNA, 696 bp, Homo sapiens
  misc_feature: GYAE6OF02JGKDQ.26.21.B10.1.454.CMB.1.raw
  modified_base (232)..(232): a, c, t, g, unknown or other
  misc_feature (232)..(232): n is a, c, g, or t
tcagagactatactcacgaccggtgctcgatttagtgtcgtcgcaagagaggagggggcctcaggaagcagcatcggaggtgcctcagccatggcatggatccctctcttcctcggcgtccttgcttactgcacaggatccgtggccttcgatgagctgattcagccaccctcagtcgtccgtgtccccaggacagacagccaccatcacctgctcggcagacaattggganatagaatgctgcctaggtattaccagacggccaggcctagtccccttagttttcggtcagttccttacccaaaggtaacttaaaggaacggtccggtacccctacggaggggtactaccccgttagaaccggttaactttcggacggtacctctaaccgtcgtagggaaccacgacgacctacgtacgtacgtaccagtaccgaacggtccgggaccaacggacccgaacggacgtaggacgggacgtacctaacgttagttacgtacgacggtaggtacggtaagtaacgttacgttaagttacggttagttacggttacgggacgggtaacgtaccggtaaggccgtaggtacccgttacgtacggttaccgaccggtaccgtaacgggtcccgttacccggtccccggtacggttacccgtaaccgttccgtacccggtttaccccgacccgtttaccccg

SEQ ID NO: 2826 - DNA, 691 bp, Homo sapiens
  misc_feature: GYAE6OF02ICSH3.26.21.B10.1.454.CMB.1.raw
  modified_base (260)..(260): a, c, t, g, unknown or other
  misc_feature (260)..(260): n is a, c, g, or t
  modified_base (427)..(427): a, c, t, g, unknown or other
  misc_feature (427)..(427): n is a, c, g, or t
tcagagactatactcacgaccggtgctcgatttagtgtcgtcgcaagagaggagggggcgtgggcctcaggaagcagcatcggaggtgcctcagccatggcatggatcctctcttcctcggcgtccttgcttactgcacaggactccggtcggtccttcgatgagctgtattcacgcctaccctcacgtgtccgtcgtccccgaaggacaagacacgccaccactccacctgctacggcaagtaacgaaagttggggaanagtaagaatcgctagcctaggtactaccaggacggaccacggccacgttcccttagtttcgtacactctactaagactaaagaacgccggacctcgaagggtacctcctagaaccgtattcacggcctaccaactcgagtacacgtacacctacgtcacaccgtacncggacggccgggccgtaacgaccgtaaggacgtaggaacgggtacgactaacgttacgttacgacgtagggccggtaggaacgtaattaaccgttagtcgggttagttacgggttacggggtaccggaacgggacccgtaagggttccaaccgggtaacgttacccggtaaggccggtaaccggtacccggtaacgggttccctaccgggtccccccgttaacgggtaccccttacgggtttacccgcccgggtttaccccccg

SEQ ID NO: 2827 - DNA, 739 bp, Homo sapiens
  misc_feature: GYAE6OF02IBXW0.26.21.B10.1.454.CMB.1.raw
  modified_base (211)..(211): a, c, t, g, unknown or other
  misc_feature (211)..(211): n is a, c, g, or t
tcagagactatactcacgaccggtgctcgatttagtgtcgtcgcaagagaggagggggggcctcacggaagcagcatcggaggtgcctcagccagtcggcatggactccctcgtcttcctcggcgtccttgcttactgccacgaggactccggtggccttcgatgagctgacttcacgccaccctcagtgtccgtgtccccaggacagacngccacatcacctgctcggcacgacaagttgggagatagtaatgactgcctgtatacagagaccaggccacgtccctatttcggtcattccttacaagataacgagccgtcctagaggtactcccgtagaccgtaatttaccgcggtacctacccgaacgttccgtacggggtaaaccaccgtacggaaccctaccgttactaccggaacctacgtaccgacgggtcccggggaccccaacggacccgaaacgggtagtacgggaacgggtaacgtaccgttaacgttagtttacggtaccgtaagggtccggttaaggggaactaaacgttaacgtttaagttaacggttagttagggttttacgggaccgggttaacgggtacccgtaagggtccgttaacggacccggttaccgtaacgggttaccgaaccgggtacccgaaacgggtccccgttaccggcccccggttacgggttacccgtacccgtttacccggttaccggtttccccccggtccctttacccg

SEQ ID NO: 2828 - DNA, 588 bp, Homo sapiens
  misc_feature: GYAE6OF02FWAX1.26.21.B10.1.454.CMB.1.raw
  modified_base (236)..(236): a, c, t, g, unknown or other
  misc_feature (236)..(236): n is a, c, g, or t
  modified_base (334)..(334): a, c, t, g, unknown or other
  misc_feature (334)..(334): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaagttggganatagaaatgctgcctggtattaccagaggccaggccagtccctatttggtcatcttccaagataagaagcgccctcaggactcctgaccgtaatttcnggctccaactctacggaacacgacgccaactctacgaccatcgacggccgggacccacggacccaacggactaggaagggacgaacttacgttattcgtacgaggacggtagggaacgtaatacgtagttagtacgttaggttgggacgggacgggaccgaggtcgtcggtaccgttccgaacggttccgacgtaccccgaaggtccgtcgtacccccgttcggtccaacccgtcgttccggtccccgtccccg

SEQ ID NO: 2829 - DNA, 648 bp, Homo sapiens
  misc_feature: GYAE6OF02H1RPW.26.21.B10.1.454.CMB.1.raw
  modified_base (235)..(235): a, c, t, g, unknown or other
  misc_feature (235)..(235): n is a, c, g, or t
  modified_base (314)..(314): a, c, t, g, unknown or other
  misc_feature (314)..(314): n is a, c, g, or t
  modified_base (319)..(319): a, c, t, g, unknown or other
  misc_feature (319)..(319): n is a, c, g, or t
  modified_base (330)..(330): a, c, t, g, unknown or other
  misc_feature (330)..(330): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaaattggganatagaatgctgctggtattaccaggagccaggccagtcccctatttggtctatcttacaagataagaagcgcctcaggntcccngaccaatttcngctccaactctgggaacacgacgccactctgaaccatcgaaggcccggggacccacggacccgaaacgggactggaacggggacgaaccgtaacttagtttcggtacacgggtcgtaggggagaaattacgttaagttacggtaggtttaggttttggggacggtaacggggtaccgagggtccttacgggtacccgttccgtacgggtcccgtaacggacccccggtaaagggtcccgttaccggcccccccgttaccggggttccctaacccggtttccgttacccggtttacccccccaccccgtttaacccccg

SEQ ID NO: 2830 - DNA, 750 bp, Homo sapiens
  misc_feature: GYAE6OF02FE6FZ.26.21.B10.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtcccttgcttactgcacaggatccgtgccttcgatgagctgattcagccaccctcagtgtccgtgtccccaggacagacagccaccatcacctgctcggcagacaagttggganatagaaatgctgcctggtacttaccgagacggccaggccctacgtccccttagtttcggtcattcttaccaagactaaagaacgccggtaccctacgagggtaccttcccgtagtaacccgtatttccgtcggcctacccgtaacgtcgtacgggaaccacgacgtaccctaacttcctacgacctacgtaccgacggcccggggtacccaacggtaccccgaaacgggtacgtacgggtacggggtaaactaaccgtttaaccgttaagttaccggttacggaacgggtcgtacggggtaacgtaaaacgttacgttaagttttaggttaacggtttacgggtttacgggaccgggtaacgggtacccggtacggggtaccgtaccgggtacccgttaccggtaacgggtacccaccggtaaccccggtaaacgggtcccgtccccgggtaccccccggttaccggtacccgtaacccgtttccccggttaccggttcccccccgttacccccg

SEQ ID NO: 2831 - DNA, 687 bp, Homo sapiens
  misc_feature: GYAE6OF02GYVXP.26.21.B10.1.454.CMB.1.raw
  modified_base (232)..(232): a, c, t, g, unknown or other
  misc_feature (232)..(232): n is a, c, g, or t
tcagagactatactcacgaccggtgctcgattttagtgtcgtcgcaagaggagaggggcctcaggaagcagcatcggaggtgcctcagccatggacatggatccctctcttcctcggcgtccttgcttactgcacaggatccgtggccttcgatgagctgattcagccacctcagtgtccgtggtccccaggacagacagccaccagtcacctgctcggcagacaatggganatagaatgctcgcctaggtacttaccagagccaggccgacgtccccttagttttcggcattccgttccaagtagtaaagacggtccgacctacgacggactccgtagaccgtatttcgtaggacctaccaacgttcgtacgggaacacgtacgcctacgtcctacgaacccagtaccgaacggcccggggacccaacggacccgaacgggacgttacggaaagggtaccgtaacgtacgtagttcggacgtagggacggtacgggtaagtaacttaacggtatttagggtacgtttaggggttacgggacgggtaacgggaccgtaagggtcgttaacggtacccgggtacgttaacgggtaccgtaaccgggtacccgtaaggggccctttacccggtaccccgttacggttacctaccgttccgtttcccggtttaccccgaccccttaccgg

SEQ ID NO: 2832 - DNA, 599 bp, Homo sapiens
  misc_feature: GYAE6OF02HY60W.26.21.B10.1.454.CMB.1.raw
  modified_base (236)..(236): a, c, t, g, unknown or other
  misc_feature (236)..(236): n is a, c, g, or t
  modified_base (263)..(263): a, c, t, g, unknown or other
  misc_feature (263)..(263): n is a, c, g, or t
  modified_base (293)..(293): a, c, t, g, unknown or other
  misc_feature (293)..(293): n is a, c, g, or t
  modified_base (432)..(432): a, c, t, g, unknown or other
  misc_feature (432)..(432): n is a, c, g, or t
tcagagactatactcacgaccggtgctcgatttagtgtcgtcgcaagagaggagggggctgggcctcaggaagcagcatcggaggtgcctcagccatggcatggatccctctcttcctcggctccttgcttactgcacaggatccgtggccttcgatgagctgattcagcccacctcagtgtccgtcgtccccaggacagacagccacatcacctgctcggcagacaagttggganatagaaatgactgcctggtactacagngccaggccagtccctatttgcatcttcaanataagagcgcctgaggctcctgaccgtattcgcggctacgaactcgtacgggaacactacgcctactctacgacctagtcgacggccggggacccacgaccgtaacggagtggacgggagtactaacgtagttgaccgnggtacggagggataactacgttagttagtaggtttacggtttgggacgggttaggaccggtaggaccgtaggtaccccgttacggtacggttaccgacgggtacccaacgggtcccgtccggtcccccgttacggtaccctaccgttccgttacccgttaccccccg

SEQ ID NO: 2833 - DNA, 739 bp, Homo sapiens
  misc_feature: GYAE6OF02FRST9.26.21.B10.1.454.CMB.1.raw
  modified_base (240)..(240): a, c, t, g, unknown or other
  misc_feature (240)..(240): n is a, c, g, or t
tcagagactatactcacgaccggtgctcgatttagtgtcgtcgcaagagaggagggggctgggcctcaggaagcagcatcggaggtgcctcagccatggcatggatccctctcttcctcggctccttgcttactgcacaggatccgtggccttcgatgagctgattcagcccaccctcagtgtccgtgtccccaggacagacacgccaccatccacctgcctcggcagacaaagttgganatagaatgctgccgtggtactaccagagaccaggccacgtcccttatttcggctacttacctaccaagacttaaaggaacgtccggtccctacgagggtaccttcccgtacggtaacccgtaatttccggtcggtacccttacccgtaaccttaccggtacgggaaacctacacccggaccctaaccgttcgtaccgtaaccctagtacccgacggggacccccgggggacccaaccgggacccgtaaacgggagttacggggaacgggtacggtaaccttaacgttagtttaccggacggtacgggtccgggttaagggaactaaagtttaccgttagtttacgggtttaagggtttgggtttaaccgggggacgggtacggtacgtacgggaccgtacggtacccggtaccggttcggaccgtacgaccccggtaacggtcccctcccgggtccccgttaccgggttccacccggtttaccgtccccgttacccccg

SEQ ID NO: 2834 - DNA, 636 bp, Homo sapiens
  misc_feature: GYAE6OF02GV6LH.26.21.B10.1.454.CMB.1.raw
  modified_base (240)..(240): a, c, t, g, unknown or other
  misc_feature (240)..(240): n is a, c, g, or t
  modified_base (299)..(299): a, c, t, g, unknown or other
  misc_feature (299)..(299): n is a, c, g, or t
  modified_base (306)..(306): a, c, t, g, unknown or other
  misc_feature (306)..(306): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagtcccaccctcagtgtccgtgtcccccaggaccagacagccaccatcacctgctcggcagacaaagttggganatagaatgctgcctggtactacagagcaggccagtccctatttgcatctcagataagancggcctnaggactccgtacgaccgtaatttcacggtctaccacgtcgtagggaactacacgccctaactctacgacctaagtccgacggcccgggacccaacgacccgtaaacgggtacgtaagggaacgggacgtaaccgttaacgttaacgttggttaaccgacgggtaccggtagggtaacgtaaacgttaacttaaggttacggttaaagtttgggttacgggtacggacggggttaacacgggtctacgacgttaccgtacggtaccgaacgtccgaacgtcccgtccgtccccgtcgggtacctaccgtctccggttcccctcccttaccg

SEQ ID NO: 2835 - DNA, 640 bp, Homo sapiens
  misc_feature: GYAE6OF02G560Y.26.21.B10.1.454.CMB.1.raw
  modified_base (233)..(233): a, c, t, g, unknown or other
  misc_feature (233)..(233): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagcccacctcagtgtccgtgtccccaggacagacagccacatcacctgctcggcagacaagtggganatagaatgctgcctggtataccagacgccaggccagtccccttagtttcggcacttccttaccgaagtaataaggacgccggccctgacgggtctcccgtggaacccgtaatttcctcggcctaccgaactcgagggaacctacacgccactcgtacgacctatccgacggcccgggacccacggacccgtaacgggactaggggaacgggaacgaccgttaacgttagttacggtcgagggcggtagggataacgtacgttagtttggtagttcgggttgggacgggtacgggaccgaagggtccgtacgggtacccgtcgtacgggtaccacggtaccccgtaaggtcccgttacccggtccccgtcggtaccctaccgttccggttcccgttccccgtaccccg

SEQ ID NO: 2836 - DNA, 629 bp, Homo sapiens
  misc_feature: GYAE6OF02ILRC4.26.21.B10.1.454.CMB.1.raw
  modified_base (235)..(235): a, c, t, g, unknown or other
  misc_feature (235)..(235): n is a, c, g, or t
  modified_base (575)..(575): a, c, t, g, unknown or other
  misc_feature (575)..(575): n is a, c, g, or t
  modified_base (577)..(580): a, c, t, g, unknown or other
  misc_feature (577)..(580): n is a, c, g, or t
  modified_base (582)..(582): a, c, t, g, unknown or other
  misc_feature (582)..(582): n is a, c, g, or t
  modified_base (586)..(586): a, c, t, g, unknown or other
  misc_feature (586)..(586): n is a, c, g, or t
  modified_base (592)..(592): a, c, t, g, unknown or other
  misc_feature (592)..(592): n is a, c, g, or t
  modified_base (594)..(594): a, c, t, g, unknown or other
  misc_feature (594)..(594): n is a, c, g, or t
  modified_base (596)..(596): a, c, t, g, unknown or other
  misc_feature (596)..(596): n is a, c, g, or t
  modified_base (601)..(601): a, c, t, g, unknown or other
  misc_feature (601)..(601): n is a, c, g, or t
  modified_base (604)..(605): a, c, t, g, unknown or other
  misc_feature (604)..(605): n is a, c, g, or t
  modified_base (609)..(609): a, c, t, g, unknown or other
  misc_feature (609)..(609): n is a, c, g, or t
  modified_base (611)..(611): a, c, t, g, unknown or other
  misc_feature (611)..(611): n is a, c, g, or t
  modified_base (613)..(613): a, c, t, g, unknown or other
  misc_feature (613)..(613): n is a, c, g, or t
  modified_base (615)..(615): a, c, t, g, unknown or other
  misc_feature (615)..(615): n is a, c, g, or t
  modified_base (619)..(619): a, c, t, g, unknown or other
  misc_feature (619)..(619): n is a, c, g, or t
  modified_base (624)..(624): a, c, t, g, unknown or other
  misc_feature (624)..(624): n is a, c, g, or t
  modified_base (626)..(626): a, c, t, g, unknown or other
  misc_feature (626)..(626): n is a, c, g, or t
  modified_base (628)..(628): a, c, t, g, unknown or other
  misc_feature (628)..(628): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccacctcagtgtccgtcgtccccaggacagacagccacatcacctgctcggacagaacaagttgganataagaatcgactcgctaggtattaaccagacggacctacggccaacgttcccccttagtttttcggtacctacttccgttaccaaagaattaaacggaagccggtaccctacgaacggggtactcccgtgaaccgtaatttccgaggcctaacccgaactcgtacgggaaaccacgaacgtaccccaacgtccgtaacgacccgtaagtacccgggacccgggggaaccccgtaacggtaaccccgaaaaccggggtaacgtacggggaaacggggtaaccggaaccgttaacgttaacggtttacggtaccggtaacgggtaccgggttaaacggganannnnanaganataganananacacnagnnagananananaganacgananang

SEQ ID NO: 2837 - DNA, 393 bp, Homo sapiens
  misc_feature: GYAE6OF02IDH8B.26.21.B10.1.454.CMB.1.raw
  modified_base (144)..(144): a, c, t, g, unknown or other
  misc_feature (144)..(144): n is a, c, g, or t
  modified_base (181)..(181): a, c, t, g, unknown or other
  misc_feature (181)..(181): n is a, c, g, or t
  modified_base (197)..(197): a, c, t, g, unknown or other
  misc_feature (197)..(197): n is a, c, g, or t
  modified_base (221)..(221): a, c, t, g, unknown or other
  misc_feature (221)..(221): n is a, c, g, or t
  modified_base (238)..(238): a, c, t, g, unknown or other
  misc_feature (238)..(238): n is a, c, g, or t
  modified_base (333)..(333): a, c, t, g, unknown or other
  misc_feature (333)..(333): n is a, c, g, or t
  modified_base (371)..(393): a, c, t, g, unknown or other
  misc_feature (371)..(393): n is a, c, g, or t
tcagagactatactcacgaccggtgctcgatttagtgtcgtcgcaagagaggaggggcgtgggcctcagggaaagcagcatcgggaggtgccctcagccagtgggcagtggactccctctcttcctcggccgtccttgacttancgacagaggctccgtggccttgatgaggcttgattcncgacccacctgaggtntccgtccgacccgagaccagacanacccacactcgcctgcncggacaagactaaagttgggaataataacgaaagtgctacgctaggtaccagaacggcgaacgagcctaccgtaccttagtttgacctatacctnaaagataaaggcgcggtcacgaggtccaccgtgtaaannnnnnnnnnnnnnnnnnnnnnn

SEQ ID NO: 2838 - DNA, 695 bp, Homo sapiens
  misc_feature: GYAE6OF02IYKW1.26.21.B10.1.454.CMB.1.raw
  modified_base (201)..(201): a, c, t, g, unknown or other
  misc_feature (201)..(201): n is a, c, g, or t
tcagagactatactcacgaccggtgctcgatttagtgtcgtcgcaagaagagggggctgggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacngccacatcacctgctcggcagacaagttggagatagaatgactgcctgtataccgagacggccaggccacgttcccttatttcggactacttctaccaagataagacgtccggtaccctagacgggtactcccgtagaccgtaatttccgacgtcctacctaacgtacgtacgggaaccacgacgacccactccgtacgtaacccagtaccgaccgggacccggggaccccgaacggtaccccgaaacgggacgtacggggaacgggtaacgtaacccggttaacttagtttacggtaccggtaacgggcgggtacgggtaacgtaaacgttacgttaagttcggttaaggtttacgggtttacgggaccgggtaacgggaccgtaagggtccgtacggtacccggttcgtaaccggtaccgacgtaacccggtaagtcccgtacccggtaccccgttcgtacccgacgtcccggttacccgtcccccgtcccg

SEQ ID NO: 2839 - DNA, 807 bp, Homo sapiens
  misc_feature: GYAE6OF02HYS9M.26.21.B10.1.454.CMB.1.raw
  modified_base (114)..(114): a, c, t, g, unknown or other
  misc_feature (114)..(114): n is a, c, g, or t
  modified_base (233)..(233): a, c, t, g, unknown or other
  misc_feature (233)..(233): n is a, c, g, or t
tcagagactatactcacgaccggtgctcgatttagtgtcgtcgcaaaggtaggagaggggggggcctcaggaagcagcatcggaggtgcctcagccaatggcaatggatccctnttcttccctcggcgtccttgcttactgcacaggatccggtggccttcgagtgagctgattcgaggcccaccctcagtggtccgtgtccccaggaccagacacgtccaccatctaccgtncctcggcaacggtactaaagttgggactaacgtagaagtggactcggccgtacggtaacttaccgaggacgccgaaggcctacggtcccttagttttcggtctacgtttccgttaccgaaggtactaagaaccggtccgacccttacgaagggtacctcccgacggaacccgttaatttcgacggtaccctaccgaaacctcggtaacgggaacctacgtacgacccttaacgtcccgttagaacccttacgtaccggtaccgggacccggggacccacggtaaccccgggaaacggtcggtaccgggaagggttaaccgtaccgtaacggttaaccgttagggttaaccgaacgggttccggtaagggtaacctaaacgggtttacgttaaggttagggttaaccggtttaggggtttaccggacgggtacgggtaaccggtacggtaccgttcgaccccgggtttaccgttacgggtaccggaacccgaacccgggtaggtcccgtaccccggttcccccgtacgttacccgtaccgttccccggttcccgttccccgtcccgttaacccgg

SEQ ID NO: 2840 - DNA, 616 bp, Homo sapiens
  misc_feature: GYAE6OF02HBV32.26.21.B10.1.454.CMB.1.raw
  modified_base (236)..(236): a, c, t, g, unknown or other
  misc_feature (236)..(236): n is a, c, g, or t
  modified_base (339)..(339): a, c, t, g, unknown or other
  misc_feature (339)..(339): n is a, c, g, or t
  modified_base (367)..(367): a, c, t, g, unknown or other
  misc_feature (367)..(367): n is a, c, g, or t
tcagagactatactcacgaccggtgctcgatttagtgtcgtcgcaagaggagaggggggggcctcaggaagcagcatcggaggtgcctcagccatggcatggatccctctcttcctcggcgtccttgcttactgcacaggatccgtggccttcgatgagctgattcagccaccctcagtgtccgtcgtccccaggacagacacgccacatcacctgctcggcagacaaattggganatagaatgctgctgtataccagagcaggccagtcccctagtttcggcatcttccaagtataagacgcggacctcgagggactccccgtgaaccgtatttccgnggacctacaactcgtacggaacacgacncctactctcgaccatcgacgccgggacccaggacccaacgggactggaacgggacaacgtacgtagttacgttacgagtccggtagggactaacgtattacgttagtacggttggttagggacggtagggtaacccgtaggccgtaggtacccgtaccgtaggtcccgtaacggccggtaaacggtccgtacccggtcccccgtacggtccctaccgttccgttcccggtttacccccgccgttacccg

SEQ ID NO: 2841 - DNA, 693 bp, Homo sapiens
  misc_feature: GYAE6OF02GC0US.26.21.B10.1.454.CMB.1.raw
  modified_base (235)..(235): a, c, t, g, unknown or other
  misc_feature (235)..(235): n is a, c, g, or t
tcagagactatactcacgaccggtgctcgatttagtgtcgtcgcaagagaggaggggggggcctcaggaagcagcatcggaggtgcctcagccatggcatggatccctctcttcctcggcgtccttgcttactgcacaggatccgtggccttcgatgagctgattcagccaccctcagtgtccgtgtccccaggacagacagccaccatcacctgctcggcagacaagttggganatagaaatgctgcctggtattaccagaggccaggccacgtcccttatttggctatctacaagtataagaacgccggcctgaggctcccgtgacctagtttctggcctacactcgtaggaacacgacgccactcacgaccagtcgacggccgggacccacggacccgaacggtagtcgggaacgggacgtaaccttacgttagttcgtaccggacgggtacggtaggggtaaacgtaacgttaacgttagtttacggttacgggtttagggttttagggaccggggttaaggggtacccggtaagggttacccgtaaccgggttaccccggttaccgttaacgggtacccgtaaccgggaaccccggtaacggtcccggttacccggtccccccggtttaacggttcccgtaacccgtttccggttccccggtttaccccccgtccccgtttaaccccg

(The sequence listing continues in the following parts.)

The invention claimed is:

1. A polynucleotide library comprising a plurality of compositions, wherein:
each composition comprises:
(i) cDNA molecules derived from a single plasmablast that encode a cognate pair of immunoglobulin heavy and light chain variable regions; and
(ii) a sample identification region attached to the cDNA molecules,
wherein the cDNA molecules derived from the single plasmablast that encode a cognate pair of immunoglobulin heavy and light chain variable regions are coupled to an identical sample identification region and the nucleotide sequence of the sample identification region is unique to the cDNA molecules derived from the single plasmablast and is distinct from the nucleotide sequence of the sample identification regions of the other compositions present in the library, wherein the library comprises an unbiased representation of the antibody repertoire of expressed antibody heavy and light chain variable regions.

2. The library of claim 1, wherein the cDNA molecules are attached to the sample identification region by an adapter region.

3. The library of claim 2, wherein the adapter region comprises at least one G nucleotide at its 3' end and the first strand cDNA molecules comprise a complementary nucleotide C at the 3' end.

4. The library of claim 1, wherein each composition further comprises a universal primer region attached to the sample identification region, and wherein the sequence of the universal primer region is substantially identical on each polynucleotide in the library.

5. A polynucleotide library comprising a plurality of compositions, wherein the library comprises cDNAs encoding immunoglobulin heavy and light chain variable regions from the same clonal family and wherein:
each composition comprises:
a plurality of cDNA molecules derived from a single B cell that encode a cognate pair of immunoglobulin heavy and light chain variable regions, each cDNA molecule comprising a sample identification-adapter region comprising a sample identification region coupled to an adapter region, wherein the adapter region comprises the nucleotide G at the 3' end, where the G nucleotide is complementary to a C nucleotide at the 3' end of the first strand of the cDNA molecule,
wherein the cDNA molecules derived from the single B cell that encode a cognate pair of immunoglobulin heavy and light chain variable regions are coupled to an identical sample identification region and the nucleotide sequence of the sample identification region is unique to the plurality of cDNA molecules derived from the single B cell and is distinct from the nucleotide sequence of the sample identification region of the other sample identification-adapter regions of other compositions in the library, and
the sample identification-adapter region is covalently attached to cDNA molecules in the composition.

6. The library of claim 5, wherein each composition further comprises a universal primer region attached to the sample identification region, and wherein the sequence of the universal primer region is substantially identical on each polynucleotide in the library.

7. The library of claim 5, wherein the single B cell is a single plasmablast.

8. The library of claim 1, wherein the cDNA molecule and the sample identification region are incorporated into the same DNA strand.

9. The library of claim 1, wherein at least two of the immunoglobulin heavy chain variable regions or at least two of the immunoglobulin light chain variable regions share at least 80-99% sequence identity to each other.

10. The library of claim 1, wherein each of the immunoglobulin heavy chain variable regions or each of the immunoglobulin light chain variable regions exhibit at least 80-99% sequence identity to each other.

11. The library of claim 1, wherein the cDNA molecules in each container are not physically linked to each other.

12. The library of claim 1, wherein the cDNA molecules encode immunoglobulin heavy chain variable regions and immunoglobulin light chain variable regions comprising a 5' untranslated region.

13. The library of claim 1, wherein the cDNA molecules that encode the immunoglobulin heavy chain variable regions comprise a 5' untranslated region and about 700 bp of contiguous sequence and the cDNA molecules that encode the immunoglobulin light chain variable regions comprise a 5' untranslated region and about 600 bp of contiguous sequence.

14. The library of claim 1, wherein the single plasmablast is a $CD19^+CD20^-CD27^+CD38^{hi}$ plasmablast.

15. The library of claim 1, wherein the immunoglobulin heavy chain variable region comprises an IgG, IgM, IgD, IgE, or IgA immunoglobulin sequence; a human IgG1, IgG2, IgG3, or IgG4 immunoglobulin sequence; or a mouse IgG1, IgG2a, IgG2b, or IgG3 immunoglobulin sequence.

16. The library of claim 1, wherein each composition further comprises sequences encoding heavy chain immunoglobulin constant regions alpha, delta, gamma, epsilon, or mu attached to the cDNA molecules.

17. The library of claim 5, wherein the immunoglobulin heavy chain variable region comprises an IgG, IgM, IgD, IgE, or IgA immunoglobulin sequence; a human IgG1, IgG2, IgG3, or IgG4 immunoglobulin sequence; or a mouse IgG1, IgG2a, IgG2b, or IgG3 immunoglobulin sequence.

18. The library of claim 5, wherein each composition further comprises sequences encoding heavy chain immunoglobulin constant regions alpha, delta, gamma, epsilon, or mu attached to the cDNA molecules.

19. The library of claim 4, wherein the 3' end of the universal primer region is coupled to the 5' end of the sample identification region, and the 3' end of the sample identification region is coupled to the 5' end of an adapter region, and the cDNA molecules are coupled to the 3' end of the adapter region.

20. A library comprising a plurality of polynucleotide compositions, wherein each composition is present in a separate container;
each composition comprises:
(i) cDNA molecules derived from a single B cell that encode a cognate pair of immunoglobulin heavy and light chain variable regions; and
(ii) a sample identification region attached to the cDNA molecules,
wherein the cDNA molecules derived from the single B cell that encode a cognate pair of immunoglobulin heavy and light chain variable regions are coupled to an identical sample identification region and the nucleotide sequence of the sample identification region is unique to the cDNA molecules derived from the single B cell and is distinct from the nucleotide sequence of the sample identification regions of the other compositions present in each separate container in the library, wherein the library comprises an unbiased representation of the antibody repertoire of expressed antibody heavy and light chain variable regions.

21. The library of claim 1, wherein the first strand of the cDNA comprises a 3' end attached to the sample identification region.

22. The library of claim 2, wherein the 3' end of the sample identification region is coupled to the 5' end of the adapter region, and the cDNA molecules are coupled to the 3' end of the adapter region, wherein the sample identification region is double-stranded.

23. The library of claim 1, wherein the 3' end of the first strand cDNA is coupled to the 3' end of the sample identification region.

24. The library of claim 1, wherein the sample identification region is double stranded and is attached to the 5' end of the double-stranded cDNA.

25. The library of claim 3, wherein the at least one G nucleotide hybridizes to the complementary C nucleotide.

26. The library of claim 3, wherein the sample identification region is coupled to the adapter region, wherein the adapter region is attached to the cDNA molecules by binding between the C and G.

* * * * *

UNITED STATES PATENT AND TRADEMARK OFFICE
CERTIFICATE OF CORRECTION

| | | |
|---|---|---|
| PATENT NO. | : 11,098,302 B2 | Page 1 of 1 |
| APPLICATION NO. | : 13/261763 | |
| DATED | : August 24, 2021 | |
| INVENTOR(S) | : William H. Robinson et al. | |

It is certified that error appears in the above-identified patent and that said Letters Patent is hereby corrected as shown below:

In the Specification

Column 1, Line 7, please replace with the following paragraph:
-- This invention was made with Government support under contracts AR058713, HV028183, and HV000242 awarded by the National Institutes of Health. The Government has certain rights in the invention --

Signed and Sealed this
Twenty-first Day of December, 2021

Drew Hirshfeld
*Performing the Functions and Duties of the*
*Under Secretary of Commerce for Intellectual Property and*
*Director of the United States Patent and Trademark Office*